United States Patent 6,583,275 (NUCLEIC ACID SEQUENCES AND EXPRESSION SYSTEM RELATING TO ENTEROCOCCUS FAECIUM FOR DIAGNOSTICS AND THERAPEUTICS) - sequence listing, part 2

SEQ ID NO: 2521 - DNA (genomic), 1404 bp, Enterococcus faecium; double-stranded, circular
  misc_feature (B) LOCATION 1...1404
  hypothetical: NO
  anti-sense: NO
gttagaatgagtttgactgatatattagtttgcttatcagaaaaacaaaatggacggaagaataacatgagtgatattattattggtattttgttagttatctcattctttttcatggtctggtactgtgtaaaaggctacaacttgatggtcggctttgccatcatggctactgtatggatgggattagcgctagtcggaaacacgttttcaccaaacccggcgatggaagggcaaggagtaattgatgtgttgacgcatatctatacgacggggccagctgagtacgccaaatcgatcttggtaaatgtcttctttggtgcctttttcgggcgtgttctagtagatagcggaatcgcagctaccctgattcgaaaggtagttgaacttggaggggacaagccaagaatcacgatgagcttactatgtattgtaaccgctgttatattcatgtcgatgacaggaatcggaccagtgatttctattgcagttattgtgttgccaatcttgatgtcattaggtatttcagtaccggttgcactgttctcatttatgggctcgattatggctggaatctttgctaatatcgtcaatttcaaacaatatcaaacgatttatgctggtttcaatccagcggctgaaagctatacttataatgactatttccaaattggtatgattgggatgattgtaagcttagttgtggtactaacggtcgctaatatatcaatgaacaaaaagaaacgctatgcaatggcagcaaacgtaccagctgaaggtggcgacgcaccaatgatctcatggttagccgtattattaccagttttaggggtcgttcttttagatcttccaatcatcttaggttttattctagcaggtatctgggcattgctgtttactggaaaattgcgcggaggttataaagaaatctgtcgtcagtttgcgaaattatttacagatggcgcagtagatgttgcaccaatggttggtttcttgatgaccttagcgatgttcaataattcagctgcgtatgcttctccttatttttcagctatttttggagattggataccgcaatcaccattagtcttggcaatcgtatttgctatattgacaccactaggatttttccgcggtccaatgaatctagtcggttcaggctcagctattttagctgtcgtattagctgttaatccaacgatgtcgccagcctttttgttcccgttatttgcaatcacaacgattgctcctcagcatttagatattacacaatcttgggttgcttggggattaggttatacaaaagtaacttctcgagaatatatgaagaaatccatcccaactggttggatcatcggagcgatcttatgcctgatcacgttcttattgtacgggaacgcctag

SEQ ID NO: 2522 - DNA (genomic), 492 bp, Enterococcus faecium; double-stranded, circular
  misc_feature (B) LOCATION 1...492
  hypothetical: NO
  anti-sense: NO
tgcgcgatgagtcgtgcaaccgaacaagaagcttatgaactactaaaaaaactgggtatctcttttcaaaaagtcgatcatcctgcgattacgtcagtcaaaaatgtccctttttccctacctggtccgcaagtaaaaaatctattattgaaatcaagaaaaggaaaacaaatctatcttgtcatcttgcctgatgaaaagcacgccgatttaaaacaactagctgaacaattaaaagaaaagcgcttatcttttgtttctgaagaacagcttcctgacctcctaggcgttccagcaggtacagtgactccattagcattgatgcacgacaaagagaaaaaaatccaagtcgtgatcgatgctgctattgatcgtcaagataccgtaggctttcatccaaatatcaataccactacgttgattatggatttttccgactttgaaaagatacttgtttacttagaacatctgccagtttatgaaaatttgtaa

SEQ ID NO: 2523 - DNA (genomic), 996 bp, Enterococcus faecium; double-stranded, circular
  misc_feature (B) LOCATION 1...996
  hypothetical: NO
  anti-sense: NO
tcttttgtgaggagggaattgtctatgaaaattattaattttgaggaagtagtagcttcttttagttttgaagaagcgattcaagtaatgaaaaaatgtttttttgattatgaaagtggtaaaatcagccaaaatcctcgattggtggaaattttacctgacggaaaaggcaaaaatatgtttgcgatgatgcctgcttatttgggggagaacagatattttggcacaaaagtcattaccgcttttccggataatcatcagtatcatttaccttctcatttaggagagattttcttgtttgatgctcaaaacggactacccaaagcattgataaacgcaaatgcagtcacctggattcgaacagctgctgtatctgcgctggcaacagattacttagcaaatccgcatgcagaaacacttgctttaattggagctggtcaacaagcattgtcgcatttgactgcgatttctaccattcgtcccatcactacagtgtttgtttacgatattttagaagaaagacgaaatacttttatcgctaaagctaaaaaacagtatcctaaaataacgtttataaatgcaatatcagtagaagatgcagtacgtccagcggaaatcatttgtacgttgacctctagtaaagaggcatttcttcaaaaagagtgggtaagggaagacgcacatatcaatgctgtgggcacatttactcctgatacaagagagataagtacatcgttgatggaaacttctcaaatctatgtagatgattactcagctgccttaacagaaagcggggacctgcttatagccatggcagaaggagatttagaggaatcttgtattgttggtacattaggcgaattagtttctgagaaaaaaacattttataaaggagaatcgaggccgacgattttcgacgcagttggtctagctattgaagatctttgttgtgcagaatatatttataacaaattagagaaaggggctttaaaatga

SEQ ID NO: 2524 - DNA (genomic), 219 bp, Enterococcus faecium; double-stranded, circular
  misc_feature (B) LOCATION 1...219
  hypothetical: NO
  anti-sense: NO
gacggtgtgagtgtcgtgttatctgacgaaatagtctcaggtttctcactggaaatagtttctactatattttcgctttcttttggctgttcttcagcagattggacggtttctgttgtttcagcggctggttgtgaaacagttggattggcaaatgaaggggttggttcaaatggaagccagccaaacccaggaaagtacacctctggccaagaatga

SEQ ID NO: 2525 - DNA (genomic), 270 bp, Enterococcus faecium; double-stranded, circular
  misc_feature (B) LOCATION 1...270
  hypothetical: NO
  anti-sense: NO
gaggtcgtgagcctgccgttgaactccgagtcacaaggagcaatttcaaaaaacagcttctcatgttttatgactatggtgacttgtgatcgaggagttggcaggagaatactgtttattcgtaaagaaggggctgtgacaagacttttgtcacagtcccttatttccttttattataggatttcgccatttgattggatgacttgtctgtaccaatcaaatgattttttctttaaccgtttctttgtgccattcccttcgtcatcttga

SEQ ID NO: 2526 - DNA (genomic), 228 bp, Enterococcus faecium; double-stranded, circular
  misc_feature (B) LOCATION 1...228
  hypothetical: NO
  anti-sense: NO
tccaaagtgagggggtgttttatgagtaatgcacaggatattcccgtatgggaaaaatatacccttaccattgaagaagcgtcaaagtatttccgtatcggagaaaacaagttaagacgcttggcagaggaaaacaaggacgctggctggctcattatgaatggcaaccgcatacagattaaacgccgacagtttgaacaggttattgacaaattggacgcaatctaa

SEQ ID NO: 2527 - DNA (genomic), 984 bp, Enterococcus faecium; double-stranded, circular
  misc_feature (B) LOCATION 1...984
  hypothetical: NO
  anti-sense: NO
ttaaaggtgagaaatataatgtgtgagattagtattattgttcctgtgtataaagttgaaaaatatttaagaaaatgtgtagattcgattttagcccaaacatttactgattttgaagttatattagtagatgatggatctcctgacaatagcgggaaaatctgtgatgagtatgctgaaaaagataatcgagtacgtgtgatccataaagaaaacggcggattaagcagtgctagaaatgcggggattgatgttgcgagaggcaaatacttaggctttgttgacagtgatgattatattgatgaagatatgtatgaaattttgtatgagaatttgaaaattcatgatgccgacattagctctgttgaattgattcctttttatggtgatagatataagaaagctaataaagaaaagaaagtaattatattaaataaaaaggaagcaataaaatctgttttagaaggaacgcaattttatgcatacgcatggaataaactttatcgtaaggaactttttaaagataatcgttacttggatggaaaaacatttgaggatgcatatataataatagatctattatttcaaacagaaaaaattgttgtttccaatgaagagaaatatttctatcttcaaagaaatgatagtattatgggaaaaagtttttctatgaataatttcgatgttatagaagcatggcaatataacaaagagaagattttagatgcttttccagatttgcatgattcctattatcgccgactatgttgggcatatttttacgtgttggataaaatggttttatcaagtagttatcaacaaattccacgtaaaaaaacagtaattgaatttttaaagaagaacagaaattttatattaacttataagggattcactaaatcgcgcaaaatagctattattgctctgagctttagagtagattggtataggaaattggttgaacaaaaaaataaaaaaaattag

SEQ ID NO: 2528 - DNA (genomic), 351 bp, Enterococcus faecium; double-stranded, circular
  misc_feature (B) LOCATION 1...351
  hypothetical: NO
  anti-sense: NO
cgagtatcgagatcggccatttggattaaaatgggggactgcttttgcgatggaagaactagtcaacggtatcaaaaaaatgaagaagaagcacgcaaacagcctcttcctaaacaacaaatgacattgcaagaaatcgatagtatactgacagaagcctttttatctcgtaaagcagtaatcattcagctcaatttaaaagatgaatttggaagactcttggatgaggtcgaagggcacttcattggtgaagcctatgaagattactttatgattgaccatcagccgatattgtgggaagacgtacggtatattgagttaaaggaaacaaaaaaatggtttgtgacatga

SEQ ID NO: 2529 - DNA (genomic), 186 bp, Enterococcus faecium; double-stranded, circular
  misc_feature (B) LOCATION 1...186
  hypothetical: NO
  anti-sense: NO
ccgcaaacgagtagaatagggggggacccaaaaatgaaagaactattttcgacatacaagctccctatcatctttggggtacttggattgatattagccgttttatggatcacccgtgggttttttcaagaccttattgatcttgatcatggcagcgatcggcgtcgctatcggttttttaactga

SEQ ID NO: 2530 - DNA (genomic), 1599 bp, Enterococcus faecium; double-stranded, circular
  misc_feature (B) LOCATION 1...1599
  hypothetical: NO
  anti-sense: NO
atagttgcgagtatgcggacggacgttttagctaaaattcttaaaaatggaattaaacagtttaatagcaaaaatctagttgcttttaaaaagaatagcaataagattggtgctattgccggatttacttctaaaacaaacatgataaagactaaaggtcttatatatcgttctattgatcgtgtcttggaagattcagatgtattaacacactggactcctaacgtgtattcatggcttggtggcggtgaaaacaaaacaatttttggtcacaaagaagctaacttaattcagattaatacttttgtagcagatattgactatccagtaggagaaaagaaaacggatttgaatttactagttctttatctattggaagaagggttattgcctacactgattgtagatacgccaaaaggttatcattgctattttctgattcaaaactataaccaagaaactgattcatttgataaggcaagctatatttctaattcaaatgattttaaatctttgagagttgctaaaagaatatcagaaaatatcagaaaatctatccaaaatcgtttaccacaagtcgatatgggctgtaatcattttggtatttttagatttccaactaaaaaaaatattgtacattatgaacctaatttcgtagatacgtttgaagggtatttgaaatggtcaaaagactttgaagaaaaagaatatgctttaaagaggtctaacttgtcattattagctcctaattctactggcaagaaagggtctaaacgacaaattgatactaaatggtacgactttttaattcatacggatattgctgaaggagatagaaataaaactatttttaccttagccctggcatgtaaatcaagtggcttatctattggcgagtgtatggatcaattggatcaacttcaattcaataatgatttgtcctattctgaagttgagagaacaataagaagtgcttatcgtggcgattacaaaggtgctaaaagttcatatgtcaatgaaattatcgaaaattatgctacacctaccgagtttgaaaaatactcaataaatgtaaatagacaagctgttaaacgtaaagggaatcgtgtcgatccgtctaattgggtgaaatttgctaaacctagagaagaacgaaaatatagtcattttgaagaaagtaaagctgatttattagcttacttagaaagaaaacaaagatcattgaaaaaaaatgagttgtttttaagtgtctctatgggaactatatctgaagaaacacaaattcctgtatctacgttaaaggtgattttaaaagagcttagaacggcgaatacagtgatattacgaacgtctcgtggtcggtatggatcgactaaaatagcaacaagcaaatttgtggaagctaaaatattaaatacagttattcagaataaaaaagataaacaagtatttgtcttagaattattaggaacagcaaatagccacgtagaaacgattttaagacgttatgaagacaaaacagtaccgttccatgcgaacatactgaaagaaagagaaaagagcaaacatgcgccaattagaggagctaatacaggttag

SEQ ID NO: 2531 - DNA (genomic), 1170 bp, Enterococcus faecium; double-stranded, circular
  misc_feature (B) LOCATION 1...1170
  hypothetical: NO
  anti-sense: NO
cagcaagcgaggaagaccatgacattaaaagaagaaatcatacaagaaagcaaacgattaggaattgacaaaatcgggttcaccacggcggaaccttttgattcattaaaagaatcgttggaagaacaaaaagcagctggccatacttctggctttgaacatccaaatatcgatgagcgtctttatccagaaatgacatttgatcagccgaaatcgatcatttccattgcacttgcgtatcctactaggatccatgaagaagtgcctagggatgaaaaacgcgggcagtttgctcgtgcttcttgggggatcgattaccatgatatactcagagaccgtttgaaccgattgatcgaattcatccaaacaagagcagaaaaatggcaaaaagaagaggaatggcgtctagctccgcaagtagatactggagaactgatcgatgtcgctgtagcacagcgagctggtttaggatttattggacgaaacggattgttgatcactgaagagttcggttcatttgtctatcttggtgagatcgttactaatattgtatttgagcctgataaaccaggagaatttggttgcggtgactgtatgcgctgcgtgactgcttgtccgacaaaagcattgcttggtgacggaagaatgaatgcccagcgatgtttgtcttatcaaactcagacaaaagggatgatgccggaagaatatcgtaaaaaaatgcgaaatgtcatttatggatgtgatatctgccagttagtctgcccttacaatcaaggaaaagattttcattttcatgaagagatggaaccaaaagtagacgaaatatatccaaaattaaagccaatgctttcgatgtctaataaagacttcaaacagcaatttgggcatttagctggttcatggcgtgggaagaaacctttgcagagaaacgcattgattgctttagctaatctaggtgatcgaacggcattgcctgagatttcagaatgtttaacagatgtccgccctgtcatcagaggaacagcagcttgggctattggacgtctaggaacaaaagaaccggaaaaatggcttgatgtattagatgaaatattagctaaagaaacagaagaagtcgttataaacgaattggaacatgcccagaaattattgcggagaaagttaaaataa

SEQ ID NO: 2532 - DNA (genomic), 1404 bp, Enterococcus faecium; double-stranded, circular
  misc_feature (B) LOCATION 1...1404
  hypothetical: NO
  anti-sense: NO
agagaggcgagagggtacatggaaaaaatagtgattttacatacgaatgatctgcattctcatttagaaaattggccaaggatcagaaggtttttggatcaacgtaaacgagaaaacgaaaagaaagaaaaaacgacaacgattgcagtagatctaggtgattttgtggatcgttggcatccattgtcagaagcaacgaatggacaggaaaatatcttgctgatgaatgaagttggttatgatgcagcgacgataggaaacaatgaaggcgtaggaaattccaaagaagagttgaatcatttatacgatcatgctgagtttgatatcatcctggataacttattcgataaaaatacgctccagccaccggcatggacgaaaccatataaaatcattacaacgaaacaccagacgaaaatcggactaattgcatttactgctccatttccgcttacttataatccgaatggctgggacatacggaatccttatgatattttgccagaattagtcgaagatttacgttcacaagtggatgttttagttttgatgagtcatctcgggattcaggatgatttccaaattgcaaaagaaataccagcaattgatgttattttaggatcgcacacccatcatttattcagagaaggtcacgtaatcaatgatgtccaaatagcagccgctggaaagtacgggcagtatgtcggtgaagtccatttaaccatcgatgaagagaaaaaaatccttaagcattcagccaaagccatccctaccgaaacaatgacagcttttacagaagatgaacaagaaataaatagttatctagaacgtgggcatgaattattaaaagaaaaagaagtagcagatttgccattttctctgagtctagatatcttcaatgagcattcgtttatccaagtagcctttgaggcggtgaaagaacgaggaaagacggaagcagcaatattaaacagtggtctgtttttaactgaaattccaaaagggcgggtcaatcaggatcagcttcacactgcgttgccgcatccgatgcacttgttaaatgtcacattgggtggaaatgatctgatccgcttagttttagaaatagaaaaaaatcgtaactttttacgtaactatcctatgaagggaatgggatttcgcggtaagatttttgggcagatggtctataatggaatcacatatgattctattaaccatcaagtcttttggaagaacaagccaatcgatctgaataaaaattatacttttactaccgtagatcatttgatgtttgttccattttttccaacgattgagattgctggaaaaaatgaatttttgttccctgaatttatccgaagtgtggtaggagattacttgaaagctcactacccaatcaaataa

SEQ ID NO: 2533 - DNA (genomic), 264 bp, Enterococcus faecium; double-stranded, circular
  misc_feature (B) LOCATION 1...264
  hypothetical: NO
  anti-sense: NO
aactatcagagtgagtatgctaataaaaacgattcccacaatccgaaaaagtttctttttcatcccctcactccattctctcttgaacaggtggacgggtatcaaaggcatggaagagttcttcaaagactggatgtacctgaaccacgcctacccgaccatacaaatcctgcatcaagcattggccattttccaaatctcgtaggcgtttttgattgctttcatcttctcgatccaagccaaagaattccaaggttttcttga

SEQ ID NO: 2534 - DNA (genomic), 1380 bp, Enterococcus faecium; double-stranded, circular
  misc_feature (B) LOCATION 1...1380
  hypothetical: NO
  anti-sense: NO
attcttaagagtaaaatacgaagtataacttggatttggaaggatgattggatgaaagctattacgcctgatatgacaacaaaatttaacaaacagtttcaagcaaatatcaaacagcatgcattgcagcgggcagttgtgaaaaaaggaattactgcttctgctgaaaatgtttcagcacatgtggagaatacaccggtattttctatagatttggctacggggaaagtggctaatcaaatgcaatcggggcgttgctggatgtttgctgcactgaacacattccgtcataagatgctgaatcaattccatttaaaagagtgtgaattatcacaaaattacacttttttctgggataaatatgaaaaggcaaattatttctatgaaaacatcattgcaacaggaaaagaggcaatcgatagccggaaagtagctttcttactcgctactcctcaacaagatggcggccaatgggatatgatcgtttcattattccaaaaatatggcgttgtgcctaaatcggtgatgccggaaagtgcgaatagttcaaattctcgagatttgaataactacttgaacaaattactgcgtaaagatgcagtagtgttacggaaaatggttgctcaaggagaaacattagacgctattgaagaaaagaaagaagaaatgctagaaagcatttataacttcttagctatctcattaggaacacctccaaaagaattcgattttgagtaccgcgatgaagaaaagaactatcatcttgaccgaggactgacaccacaaattttttatgataaatacatcggtgtaaaattagatgattatgttagcgtgatcaatgcaccaacaaaagacaaaccattcaatcgttcttatacagtagagatgctaggaaatgtcgttggcgggaaagaagtcaaatatctgaatgttgatatggaaactttcaaaaaattagcgattgctcagcttgaagaaggagaatctgtttggtttggttgtgatgtaggtcaatcttctactagaactagtggcatcatggccttagatgcttattcaatggatgatctatttgatacggattttacaatgactaaagctgaacgtttagattttggagaaagtctgatgacccatgcgatggtattgaccggtgttgacttagtagacgggcaatcaacaaaatggaaagtcgaaaatagctggggcgaaaaagttggaaagaatggcttctttgttatgagtgatgcctggatggacgaatatacgtaccaaatcgttgtaagaaaagatttattgacgaaagagcaattaaatgcgttcaatgaagaaccaattgttctatctccgtgggatccaatgggtgctttagcatag

SEQ ID NO: 2535 - DNA (genomic), 651 bp, Enterococcus faecium; double-stranded, circular
  misc_feature (B) LOCATION 1...651
  hypothetical: NO
  anti-sense: NO
atgattaagagaaaaaatgataataaatggaaatatatttgtggtgttttaattattattttagttttaggtggattgttatctcaacttcatacaagtaacattcaagcaaaaaataaaaaattggatcaagaagttacacaactagaagaacaaaatagcaagttaagtaaaaatattagtgatctaaatgcaaatgtagaagcgaacttaactaatgatgatggcagtgaattaaataaacaaattgctgaagttgctaagaaatttgttgagctatatccggtatatgatattgaaaaagtagaagaaaagaaagctgatttagagaaaatagctactccttctgtagctgattctatcgtgccggacgacatgattacaacgagtaaaaagactttagaaagtaaatctactactcaaaaaggagaagcatattcaagtgatccaacattcaaaagtaaatataaagattcaaaattatatacgaattatgttaacgccaatactattaattattttgctgaagtaaattataaaacagaatcttctagtggagatacagaaaatacagtctatatgctttttgaagtaaccaataaagacggccaagtgttggtagataattatgaaatcaagtacttaaaatag

SEQ ID NO: 2536 - DNA (genomic), 198 bp, Enterococcus faecium; double-stranded, circular
  misc_feature (B) LOCATION 1...198
  hypothetical: NO
  anti-sense: NO
aaacataagagactgtttttacttggctcttcttattacttgatgcagaacagctttttcacaacctcttccttaaacggtgttctcctaccaactcctcggtcacaagtcacaatattcatcaaacatgaaaagctgttttttgaaattgttccttgtgactcagagttaaacggcaggctcacaacctcttggtaa

SEQ ID NO: 2537 - DNA (genomic), 348 bp, Enterococcus faecium; double-stranded, circular
  misc_feature (B) LOCATION 1...348
  hypothetical: NO
  anti-sense: NO
atggataagagatcattatacgacggattgaatcaattagaatcagagttgagaaatacattaacagaacttgttgaaatgaagcatgctttgcatgagatcgtagaaaaaaatacaactttggagatggaaaatcaacgtctgcgggaacacctgcgggaattgaaccaagttgcacaagctccagctgaaaatgtgaagcaggaactttctaagtctcgtatgaatcttgaaaaaatttatgaagaaggattccatgtctgctacgatttatatggatcaagaagggacaatgacgagccttgtgcgttttgtctagaagtgatctatcgcgaaagcggtcgatga

SEQ ID NO: 2538 - DNA (genomic), 2199 bp, Enterococcus faecium; double-stranded, circular
  misc_feature (B) LOCATION 1...2199
  hypothetical: NO
  anti-sense: NO
aaaagtaagagaagggatggagtaaaaatgaacgggaacgatatggagaaaaaacaggagcataaaaaagaagcaggaaacaaagaaagtgctcattcaaacgaaaaacagatggagatgaagcatgaccatagccagatggaccattcaatgcatatggaacataaccatggagatatagcggacagcaaacaaatggaccattcgatgcacatggatcacgatcatggcggtatggatcattccatgcacatggggaatttcaaacaaaaattttggctatcgcttatcctagctatcccaatcattcttttttcaccaatgatgggaatggaatttcccttccagataacatttcctggttcggattggctcgtactgatcttagcaactatactgtttatctatggcggacagccatttttaagcggggcaaaaatggaattgaaacaaaaaagtcctgctatgatgacgctgatcgcgatggggattacagttgcatatatttatagtgtctattcgtttatcgcgaatctgatcaatcctcatacgcacgtcatggatttcttctgggaattagctacattgatcgtcattatgttgctaggtcactggatcgaaatgaacgctgtttcgaatgccagcaatgctttacaaaaactagcagaattactgccagaatcagtgaaacgcttgacgaaagaaggaaaagaagagacagtctcactaaaagaagtaaccgaaggcgatcatttgatcgtccgttccggtgacaaaatgccaacagatggtgttatcttgaaaggtgaaactatcgttgatgaatcagctgtgactggcgaatcaaaaggaatcaaaaagcgagccaatgataaagtgatcggcggttctatcaatggggatggaacgatcgaaatcgaagtaactggaactggtgaaaatgggtatctagcgaaggttatggaaatggtgcgaaaagcacaaggagaaaaatccaagctagagtcattatcagataaagtggcaaaatggctgttttatattgccttaattgtcggtatcttggcatttatcgcatggttgttcttgacagatcttcctaatgcattggaacgtatggtcactgtttttatcatcgcctgtccccatgctctaggtttagctatcccattagttgttgctcgttccacatcgatcgccgctaaaaacggattgcttttgaaaaaccgtaacgcactagagcaagccaatgatctagatgtgatcatgctggacaaaaccgggacactgacagaaggaaaatttacggtaacgggtgtcgaagttcttgatgatgcgttcaataaaaatgaaatccttcaatatttaggagcattggaagcgaatgccaatcatccattggctattggcattatgaattatttgaaagaacatgaaatcaagccttatcaagccgaaaatctaaaaaatctttcaggagttgggctagaggcaacagtcaaaaaccaacaagtgaaaatagttaatgaaaaagaagttgagcgtctcggattaaatgtagaacaagcattattgaaaccttaccaagaacaaggaaataccatcagcttcctgattttagaaaatcatctagctgcaatcgttgctttaggtgatgtagtaaaaacagaagcaaaagagtttatccgaacattgaaggaaagaaaaatcactccagtcatgcttactggcgacaataaaaatgctgctcaagcagtagcagattatttaggaatcgaagaatattacggcggtttattaccagatgataaagaagctgttgtccagaaatatcttgaccaagggaaaaaagtaatcatggtgggtgatgggattaatgatgcgccaagtttagcccgtgcttctattgggatggcaataggtgcaggaacagatatcgcaatcgattctgcggatgtcgtcttgacaaacagcgatccaaaagatattttgcatttccttgatttagctaagcaaacgcgaaagaaaatgatccagaacctctggtggggagctggttacaatattctcgcaattccactagcggccggaatacttgcaccaattggtatcctattaagtccagcagttggtgctgtcttgatgtcgttaagtacggtagtcgtagcgctgaatgctttgacattgaaaatcaaataa

SEQ ID NO: 2539 - DNA (genomic), 213 bp, Enterococcus faecium; double-stranded, circular
  misc_feature (B) LOCATION 1...213
  hypothetical: NO
  anti-sense: NO
aatggcaagagggtgaggcaaatggaagcaggaaaagtattacaggaagtaaaagcactatgtgcagataaaaaatatgaagaagcgaaaagcctgatcgaaaagaacaaagaaaatttggaagaaaagtacccgatcgcacaagaatttatagaattaaaacaaggaacgatccttcaccgattcaaacatttttttggtataacagaatag

SEQ ID NO: 2540 - DNA (genomic), 714 bp, Enterococcus faecium; double-stranded, circular
  misc_feature (B) LOCATION 1...714
  hypothetical: NO
  anti-sense: NO
gatagaaagagagggaaagatatgctgcagtcattagataaaataaacggaaggctaaatcgtattttacagttggtttatttgaattttctgtggggcggtttagtcatcgcaggtttgggagtttttactttcggtcctgcatcgtatgcgatggttgcagtgattaaaaaatggctgcgctcaaaagaaacgtttcctttgacgaaaacgtacttcacatattttaaagaaaactatcgtgaaaccttgctgatgagctggatatatggcgccatcgggattgttttacttgtggatctttctttcatacacaattggtatcttaggatcgctttgtatattgctgcgttcatatatgtgctctcagcactctatattttcccaatcatggctcattatgattggaaaggatattttttcaaaatgaaaatggcatttttattcggattctcacatcttcattactcattagtgttgatattaagtatggtagggatttatctgatgatcatccaaacaatgccaggtgttttaacctttatcggtggcagtctcttcttttccgcagtcacgtggacagcaaattctatattttgccatttggaatggaagaactcatatacagaaaaaacagaagaaaacaaaaatattattaaaacagtgaaggagaaaatttatgaaaaaagcaacgctcgtaaaattaggtcttag

SEQ ID NO: 2541 - DNA (genomic), 624 bp, Enterococcus faecium; double-stranded, circular
  misc_feature (B) LOCATION 1...624
  hypothetical: NO
  anti-sense: NO
aaaggaaagagaatgaagatgaaatttattggattagtaggaacaaattcaacgcggtcaacaaaccgtgaattattacagtttatgaaaaattattttgtaaatgaggcagaaatcgaaattgtcgaaatcaaggagctgccactatttaacaaacctgaaaacacagaactaccaaatgttgttaaagaaattgctggaaaaattgaacaagcagatggcgtaatcatcagcacaccagagtatgaccatgcggttcctgcttcattgattaatgcattaaattggctttcatatggtatttttccgtttgtggataaaccagtgatgattaccggagcgtcttatggcacgttaggttcttcacgcgcacaagcacatttgcgccaaatattggattcaccagagttaaaggcacgaattatgccaagctcagaatttttattgggtcattcactccaagcctttgatgagcaaggacgactcattgatgaagaacaagtcgcaaaattacgtgaactattcaaagatttcttactctttgtcacaatcactagtcaattgcaacatgcgcaccaagcaaataaacgtgaagccgaaagcttttcatgggaaacgatttaa

SEQ ID NO: 2542 - DNA (genomic), 1227 bp, Enterococcus faecium; double-stranded, circular
  misc_feature (B) LOCATION 1...1227
  hypothetical: NO
  anti-sense: NO
aaaggaaagagagaaacaaaagtgttttcagataaagaagtcttattaaagtctcttcatgtttgtttaaagttacctatcgtggtttttaattccgaattcagtattataaaagagtatcgctcagatagaactacttattttttttatgattataaaaagttactaactgataatattaaaaaaactaaagatttccatttctttactggtgattttaatgagatgtttcttctatacatgtttaaaaccagatattacttatttggtccatttagagcaaataatattgataaagttttttttaaactaaaaatgaacaatttgaatgttgcaatggctgatagagaacgactctataattcattgcaaaatttgactttgtattctttaggagacattcgagatattctgattttagttcattatttttttactggaaaaatagaagatctattccatgaaccgttaattgaatatacagaaaatctaagtaaaactatcgagcaaatcaaaatagataatctgttatcacaaaattacgatccagaaatatatctgtttctttatgaaaataaaatactggaatatgttaaaaatggagatattcgaaatttagaaaacatggtttttaatctgagtaatggaataattccaagtgttagtggagatacgattcggtctgaaaaaaattattctatcattgtttttgaaaagttagcacaaacgtctataacattaggaatggatataatagaagcgtatcaaagtagagatgctttgatacaagaaaacgaattagctgtatcgttacctgaggtcttaaaagtgagggattctgggattgtttattatactaaggaaatcggaaaaactaagatagagcatctttctcccttaatttcttctgtcgttcaattcatcggcttaaatatctataaaagaattactgtaaaggaaatagctaattatttttctgtaagtgaaactaaattaagagaaagctttaagaatgaaatgcatattacgatttataattatatctctaagcgaaaaatttctacggctaaaataatgttgaaatcaaaccatactatcagtgaagtttctttaggtttaggattttcagattcttcacacttttcgagagtattcaaaaagtacgcaggtgtatctcctaagcaatatcaattaggtttagtggacaatttcaacaacattagctga

SEQ ID NO: 2543 - DNA (genomic), 504 bp, Enterococcus faecium; double-stranded, circular
  misc_feature (B) LOCATION 1...504
  hypothetical: NO
  anti-sense: NO
tggatgaagagacagtcaccagcattggtcttgttattgaaagaacatccggaatgtgcgatgttagcacctaagattcttaatgaagatggaacaactcagcacctcatccgtgagcagctggctgtttttgattacgttttgcgctttgtgcctttcaaatgggtcaaaaaaaagtttgacaaacgactggctgtgtttgaatgccgaggattgcctactgatgctaatagttatgtacggatgatctcaggtagttttatggtagctgatattgataaatttaaagagataaaggggtttgatgagcgtttcttcatgtactttgaagacaacgacttgtgtttgagttttgaaaaagcaggttacaagttattgtacacacccttttatgcagttatccatttttacgggaagggtgcgcatcgaaatgcaaaactgtttcgcgtgtttttgacttctatgatgaaatttttcaataagtgggggtggcgttttttctga

SEQ ID NO: 2544 - DNA (genomic), 1227 bp, Enterococcus faecium; double-stranded, circular
  misc_feature (B) LOCATION 1...1227
  hypothetical: NO
  anti-sense: NO
cgaaagaagaggtgggttaagttggaacaggcaaaaaatcttacggataaaaaagagaaaaaactaaatttgaaaagtagagcagctgatctttttggtcgctacagcatggtgatcattttagcgggactacttattgcgtttcaattgatgacggatggtattttctggcgtccattgaatataactaaccttgttctgcaaaatagccatatattagtactagctgcagggatgttattagttgtgctcttaggtcatgtggatttgtcggtagggtcagtgatggcgtttgttggtgcaattgcgggcatgatgatggtcaatcgccaaatgaacccgtggatgacagttatcgcatgtcttgcagtaggcgggctgatcggcgcatggcaaggtttttgggtagcttatgcagggataccggcgtttatcgtgactttagcaggattgctgatgtttcgtggactgacacaagttgttctaggaggccaatctctagcaccttttccagctgttttccaaaaaatgtgtacgggttatttaccagacttaagcgaaggaagcagccttcacttcttgacattgattttaggaatgatcatcacgatcgtgttagttgttggtcaatggcgaacaagaaatcgtcggaaaaatcatttatttgaagtggaatctccaacagctttcttggtaaaggcggtatttacagcagtcgttgtactaggaataacttatatctttgcctcttatcaagggtatccgattattttgatcattcttggtttgatcgttgcagcatatgggtttttgacaaataaaacagtagcaggtcgacagatttatgcgacgggcggaaatcgaaaagcggctgaactatcagggatcaaaacaaagcgaatcacgttctgggtattcgtcaacatgggagtcatggcagctttagctggattagttttagctgctcgattgaatgcggcaacacctcaagcaggtacatcgatggaactggatgcaatggcggcagtatattttggtggtgcttcgacttccggcggcattggaacaatcatgggtgcgattgtcggtggcttggtcatgggtgtattgaacaatggcatgtcgattttaggcgtcggggtagactggcagcaggcaatcaaaggattgatcttgcttttagccgttgtgctagacttgtataataagaaaaaacgaacaacgtag

SEQ ID NO: 2545 - DNA (genomic), 681 bp, Enterococcus faecium; double-stranded, circular
  misc_feature (B) LOCATION 1...681
  hypothetical: NO
  anti-sense: NO
cagaagaagagaaaaagaaggaatgaatccttcatgacaatgaagggctatccacgtataatcagagataaaggagagatgtggatgccaaaagaaacttttttcaatttatcgaacgcaaagaaacagagaatcgatgacctattactggagatattttgctcacagcacatcagccaagtcaaagtctcagaaatcgttgacaagatggggatgtcgcgcggtgctttttataaatattttcaagatttggaagatgcttatttgtatacgatcaaaagcagttctcacatagtccatcaagatatcttaaaattcattagcgaaaacaaacaacatttctttttggggatcgaaaaatatttagagtggtgctgcgacttagatcacgaaagtatctattggcaaaggttatacttgttaacccagcgaaatgatcagcagacaaccaaacgtagagaactatcggctgattctccaatgaacgaaaaatggctggaattattaagaatcaatcatttctccattcaatcgtcggaagaagcagttagtttcctatacttttccatgaccctcgtaatgaacactttgacggatctcattgcaaataattggacaaaagaagagttgttaaaagactttcgctataaatctcgttggattgctgaaggaatacaataa

SEQ ID NO: 2546 - DNA (genomic), 828 bp, Enterococcus faecium; double-stranded, circular
  misc_feature (B) LOCATION 1...828
  hypothetical: NO
  anti-sense: NO
aaaaggaagagggataccatggtaaagaaacagataacaggtgaagaaatcaaacgaatcattgaggaagaaaacgtacgatttttacgattgatgttcacagacatcttaggtacgatcaaaaatgtagaagttccagtgagccagatcgacaaagtattagaaaataaaatgatgtttgacggttcttcgattgaaggatttgtacgaattgaagaaagcgatatgtatttgtatccagatctctccacttggatgatcttcccgtgggaaagtgctcatggaaaagttgctcgtttaatttgtgatatctataatccggatgggacaccatttgccggcgatcctcgcgggaatttgaaacgagcattgaaagatatgcgcgaccttggttttacctctttcaatttaggacctgaaccagaattcttcttatttaaattagacgaagacggtgggatcacaacgaccttgaatgataaaggtggttattttgattttgcaccaacagatttaggtgaaaattgccgccgtgacatcgtgttggaattagaaagtctaggctttgaagtggaagcttcacatcatgaagtagcgccaggacagcatgaaattgactttaaatatgcagatgtggtagatgcttgtgataatatccaaaccttcaagctcgttgtcaaaacgattgcacgcaagcatggacttcacgcgactttcatgccgaaaccgttatttgggatcaatggttctgttaatgccattgcaatatgtctttgttcccatgatgaaagaaatgtctctatgataaagacggtgaattggaactaa

SEQ ID NO: 2547 - DNA (genomic), 2025 bp, Enterococcus faecium; double-stranded, circular
  misc_feature (B) LOCATION 1...2025
  hypothetical: NO
  anti-sense: NO
aggaggaagagccccgtggcagaaaaggaaactttttatatcactacgccaatctattatccaagcggcaaacttcatatcggcaactcgtatactacgattgcatgtgacgcaattgctcgttataaacggttgatgggctttgatgtgttttatctcactggagtggatgaacatggtcaaaaaatcgaaacaaaagcagaagaactaggtgtaaaaccgcaagaatatgtagataaaatggcggctgatgtcaagaaattatggaaaacgcttgatatcagttatgataaattcattcgcacgacagatgattaccataaagcagctgttcaaaaaatatttgatcgtttattagaacagggagatatttacttaggtgaatatgaaggctggtactctgtttctgacgaagaattctttacagaaacacaacttgcagaagtgtacaaagatgacgaaggtaacgtgatcggtggtaaagcgccaagtggacacgaagtagaattggtaaaagaagaatcatacttcttccgcatgagcaaatacgcagaccgtctattggaatactatgaagaacatcccgaattcatccagccagaatctcgtaaaaacgaaatgatcaacaactttatcaaaccaggattagaggatcttgcagtttcacgaacaacttttacttggggagtaccagtcaagagtgatccgaaacatgtggtgtatgtatggatcgatgcattatccaattatattactgcactaggatatggctccgaagatgaaagtctattcgaaaaatactggcctgcagatgttcagatggtcggtaaagaaatcgttcgctttcatacgatctattggccaatcatgctgatggcccttgatttgcctctacctaaaaaagtatttgggcatggctggctattgatgaaagacggaaaaatgtctaaatcaaaaggaaatgtcgtttatcctgaaatgcttgtggaacgttatggtttagatgcactccgttattatttgcttcgtgctgttccgtttgggtcagatggtgtctttacgccagaagattttgtttcccgtgtcaattatgatctggcaaatgatctagggaacttattgaatcgaacgattgctatgatcaacaaatattgtgatggactcgttcctgactatgcctcacttgtcactccatttgatagtgaactgtctacgacggctgctaacgttgtcggacgttaccatgatgcaatggaaaaaatggaattcaatacagcattggctgaaatctgggtgctgatttctcgtgcaaacaaatacattgatgaaacagaaccatgggtattagcaaaagacgaagaaaagaaagctgaattgaatagtgtcatgatccatttagctgaatctttgcgtatcgcagcgatattacttcagccaatcatgacagaaacgccagagaagatcttcaatcaactaggattggactctgaaacaatgaatcttgaaggattacactttggcgaatttccttcaggaacaaaagtagttgcaaaaggtacaccaatcttcccacgtttagatatggaagaagaagttgcttttattcaagaaaaaatgtctgaaggtactcaaacaaacgaagatacagtcaaatgggatccagaagaaacagaacttgtttcaacgaaagaaaaacaaatcaaatttgatgtatttgaaaaagtagaactaaaagtagcagaagtcatcaactgtcaaaaagtagaaggggcagataagttgctgcaattccgactagatgctggagacagccaagaccgtcaaatcttgtcaggaatcgctgaattttatcctgatccaagcgaattgatcgggaaaaaagtcgtcattgtagcaaatctgaaaccacgaaagatgcgtggacaaatcagtcaaggaatgatcctttctgcagaagcaccagatggctctttacaagtaatcgaagcaccaaaatccatgccaaatggctcagaaatcgcatag

SEQ ID NO: 2548 - DNA (genomic), 1320 bp, Enterococcus faecium; double-stranded, circular
  misc_feature (B) LOCATION 1...1320
  hypothetical: NO
  anti-sense: NO
acaactgagaggacgatatgctatatgaatgattctatcaaaaaaatgctgcgattaatagagaaagatttgatgattacagaggtctcttacgagacctttcagaagaaaaagacgttgatcgtcgatgctgttttctcacctgctccccatacctgtagaaattgtggttctactgtggtagatggaaacgggaaagtaattgtagtgaaaaatgggaagaaggaaacgattgtccgctttgaacaatacaatcacatgcctttggttatgcgcttaaaaaagcagcgctatacctgtaaaaactgtcgaacccattggacggctcaaagttattttgttcaacccagacattcaatcgcgaatcatgtcagatataaaattgcttctttactgactgaaaaagtatctttatcttttattgcgaaaaattgtcaggtatctttgaccaccgttattcgtacgttgaaagagtttaaaagctacttaccaaagcaatctaagaggattctccccagagtattgatggttgatgaatttcgttcgcacgcttccatagaagataaaatgagctttatttgcgcagatggcgaaacaggacaattaattgatgtcttgcctacgcgtaaattgcctcgattaacaagctatttcttaggctgcgctaatcctgaagaagtaaaatttttagtcacagacatgaacgccgcctacttccagcttaccaaacgtattctgccaaatgcgaaagtagtgattgatcggtttcatattatcaaacacatgaatcaagcctttaatgagttgcgtatccgtgaaatgaatgaacttcgtaaagtaggacagaaaagtcaggcagaaaaactgaaaaagaactggcgctttttgctaaaaaatcgtgcaaacatcaaccattatgaatacaaaacatggaaaagttttcgagcaccaaaatacccatttcttacggaagcgatgatgattgatcgattgcttggcttttctacgtccctgaaggaggcgtatccctattttcatgaattagttgaagcctttcgagacaaagaccctgacttatttttctccttattggcagaacttcccgaaacgttagatgacggctttcgggaaaagctccaaaaccttctgacctatgaagaaggcatcaccaacgcgatgatctatccttattccaatggaaaaatagaagcgaagaatacccatataaagacaatgaaacgagtatcctacggatttaaatcatttgagaacatgagaattagaatctttttgatcaatcaattaatcaaagtaagataa

SEQ ID NO: 2549 - DNA (genomic), 249 bp, Enterococcus faecium; double-stranded, circular
  misc_feature (B) LOCATION 1...249
  hypothetical: NO
  anti-sense: NO
acaactgagagaacgatatgctttatgaatggttctatcaaaaaaattctgagatcaatagacaaaaatttgatgattacagaggtctcttacgaaaccttacagaagaaaaaaacattgatcgttgctgcagttctcttccctgctccatgtgtctgtagaaattgtggttctgctgtggtagatggaaataggaaattaatggtggtgaaaaacaagaagaaggaaaccattgtccactttgaataa

SEQ ID NO: 2550 - DNA (genomic), 1320 bp, Enterococcus faecium; double-stranded, circular
  misc_feature (B) LOCATION 1...1320
  hypothetical: NO
  anti-sense: NO
acaactgagaggacgatacgctatatgaatgattctatcaaaaaaatgctgagaataacagagaaagatttgatgattacagaggtctcttacgagacccttcagaagaaaaagacgttggtcgtcgatgctgttctctcgcctactcctcgtgcttgtagaagttgtggttctactgtggtagatggaaacgggaaagcaattatagtgaaaaatggaaaaaaggaaacgattgtccgttttgaacaatacaatcatatgcctttggttatgcgcctaaaaaagcaacgctatacctgtaaaaactgtcgcacccattggacggctcaaagttattttgtccaacccagacattcaatcgcaaatcatgttagatataaaattgcttctttactgactgaaaaagtatctttatcttttattgcgaaaagctgtcaggtatctttgaccaccgttattcgtacattgaaagagtttaaaagctatttaccaaagcaatctaagaagatcctccccagagtattgatggttgacgaatttcgttcgcatgcttccatagaagataagatgagctttatttgcgcggatggcgaaacaggaaaattaatagatgttttgcctacgcgtaaattacctcgattaacaagctatttcttaggttgtaccaatccagaagaagtagaattcttggtgacagacatgaacgccgcctacttccagctcaccaaacgtgttctgccaaatgcgaaagtcgtgattgatcggtttcatattgtcaaacacatgaatcaagcgttcaatgagttgcgtatccgtgaaatgaatgaacttcgtaaagccggacagaaaagccaggcagaaaaactgaaaaagaactggcgctttttgctaaaaaatcgtgcaaacatcaaccattatgaatacaaaacatggaaaagtttccgagcaccaaaatacccatttcttactgaagcaatgatgattgatcgattgcttgagttttctccgcccctaaaggaggcgtatcccttttttcatgaattagttgaagcctttcgagacaaagaccctgacttatttttctccttattggcagaacttcccgaaacgttagatgacagctttcgggaaaagcttcaaaaccttctgacctatgaagaaggcatcaccaacgcaatgatctatccttattccaatggaaaaatagaagcgaagaatacccacataaagacaatgaaacgagtatcctacggatttaaatcatttgagaacatgagaattagaatctttttgatcaatcaattaatcaatgtaagataa

SEQ ID NO: 2551 - DNA (genomic), 1320 bp, Enterococcus faecium; double-stranded, circular; identical to SEQ ID NO: 2550
  misc_feature (B) LOCATION 1...1320
  hypothetical: NO
  anti-sense: NO

SEQ ID NO: 2552 - DNA (genomic), 1320 bp, Enterococcus faecium; double-stranded, circular; identical to SEQ ID NO: 2550
  misc_feature (B) LOCATION 1...1320
  hypothetical: NO
  anti-sense: NO

SEQ ID NO: 2553 - DNA (genomic), 1320 bp, Enterococcus faecium; double-stranded, circular
  misc_feature (B) LOCATION 1...1320
  hypothetical: NO
  anti-sense: NO
acaactgagaggacgatatgctatatgaatgattctatcaaaaaaatgctgcgattaatagagaaagatttgatgattacagaggtctcttacgagacctttcagaagaaaaagacgttgatcgtcgatgctgttttctcacctgctccccatacctgtagaaattgtggttctactgtggtagatggaaacgggaaagtaattgtagtgaaaaatgggaagaaggaaacgattgtccgctttgaacaatacaatcacatgcctttggttatgcgcttaaaaaagcagcgctatacctgtaaaaactgtcgaacccattggacggctcaaagttattttgttcaacccagacattcaatcgcgaatcatgtcagatataaaattgcttctttactgactgaaaaagtatctttatcttttattgcgaaaaattgtcaggtatctttgaccaccgttattcgtacgttgaaagagtttaaaagctacttaccaaagcaatctaagaggattctccccagagtattgatggttgatgaatttcgttcgcacgcttccatagaagataaaatgagctttatttgcgcagatggcgaaacaggacaattaattgatgtcttgcctacgcgtaaattgcctcgattaacaagctatttcttaggctgcgctaatcctgaagaagtaaaatttttagtcacagacatgaacgccgcctacttccagcttaccaaacgtattctgccaaatgcgaaagtagtgattgatcggtttcatattatcaaacacatgaatcaagcctttaatgagttgcgtatccgtgaaatgaatgaacttcgtaaagtaggacagaaaagtcaggcagaaaaactgaaaaagaactggcgctttttgctaaaaaatcgtgcaaacatcaaccattatgaatacaaaacatggaaaagttttcgagcaccaaaatacccatttcttacggaagcgatgatgattgatcgattgcttggcttttctacgtccctgaaggaggcgtatccctattttcatgaattagttgaagcctttcgagacaaagaccctgacttatttttctccttattggcagaacttcccgaaacgttagatgacggctttcgggaaaagctccaaaaccttctgacctatgaagaaggcatcaccaacgcgatgatctatccttacaccaatggaaaaatagaagcgaagaatacccatataaagacaatgaaacgagtatcctacggatttaaatcatttgagaacatgagaattagaatctttttgatcaatcaattaatcaaagtaagataa

SEQ ID NO: 2554 - DNA (genomic), 246 bp, Enterococcus faecium; double-stranded, circular
  misc_feature (B) LOCATION 1...246
  hypothetical: NO
  anti-sense: NO
acaactgagaggacgatacgctatatgaatgattctatcaaaaaaatgctgagaataacagagaaagatttgatgattacagaggtctcttacgagacccttcacaagaaaaagacgttggtcgtcgatgctgttctctcgcctactcctcgtgcttgtacaagtcgtggttctactgtggtagatggaaacgggaaagcaattatagtgaaaaatggaaaaaacgaaacgattgtcccgttttga

SEQ ID NO: 2555 - DNA (genomic), 1320 bp, Enterococcus faecium; double-stranded, circular; identical to SEQ ID NO: 2553
  misc_feature (B) LOCATION 1...1320
  hypothetical: NO
  anti-sense: NO

SEQ ID NO: 2556 - DNA (genomic), 1320 bp, Enterococcus faecium; double-stranded, circular; identical to SEQ ID NO: 2550
  misc_feature (B) LOCATION 1...1320
  hypothetical: NO
  anti-sense: NO

SEQ ID NO: 2557 - DNA (genomic), 822 bp, Enterococcus faecium; double-stranded, circular
  misc_feature (B) LOCATION 1...822
  hypothetical: NO
  anti-sense: NO
ctgttcgagaggcaagtaagtatttataagaaagcgagacgacaagagatgagacgcaaattatttgcttttgatattgatggaacgttgttagattcaaacaaacaagctttagatagcacaagagaagcattggaaaaattacgcaaagccggtcttctggtcacgattgctacagggcggagccgatttcatgcgcaagagatcattcgcgatcttgattttacgaactacattttatgtaatggagcggccggttttttagaccatgaacaagtatataagaatttactagatcgcgaccagttggatgcgttcgttcaagaagcgcatcatgagcagatcgatacagcttttgtcagcttagacaatatcaagcgttcttcttccaatgatgtaacggtgatggaagaagcgatgcattctttcggtgctgtcttgcctgaattagatcagttttttgcagaggaacaagaaatataccaagcgttagcatttttcgatcaaacatatgatgggaagttctcttcatatgataaaattcgatttgtccgctggcatgagaacagtgtagatgtcgtacctaaaaatggttctaaagcagcgacaattctgcacttagcagaacaagtaggcatccctcatgaagacatcatcagctttggcgatggacaaaacgaccgtgaaatgttgcgcatgtcaggaattgggatagctatggggaatgctgtgccagaagtacaagcagaagctaagatggtcactgatacaaacgatcaggatggaatttggaaggcattgaaagagttaagcgtgatttaa

SEQ ID NO: 2558 - DNA (genomic), 1026 bp, Enterococcus faecium; double-stranded, circular
  misc_feature (B) LOCATION 1...1026
  hypothetical: NO
  anti-sense: NO
gaagcagagaggggtattcgattgtccgataaccaattattagaagttcagaacctacatacaggattccgactcaaagatgactattacgatgcagtagatgacgtttcatttactttagacaaaaacgagattttagcaatcgttggggaatctgggtgcgggaaaagtaccttggctactacgattatgggattacttgatcctaataacacaaaaattacaggtgagattttatataacgatctgaatttaatcgacctgaacgaaacgctctataataaaatccgcggaaatgatatcggaatgattttccaagatccgttgtctgcattaaatcctctcatgagaatcgaagaccagatcaaagaaggactttcctatcacacaaagatgaatgcagaacagcgtcaagctcgtgcactagaattgctagaacaagtagggattcctaatcctgcgagagttggacgccaatatccccatgaactatcaggcggtatgagacaacgtgtcatcatcgcaatcgcaatcgcctgcaaacctccaatcgtcattgcagatgaaccgacgacagccctagatgtaaccatccaagcacagattcttgatttactgaaagaccttcaggaagaaacaaaaacagggatcatcttgatcactcatgacttaggagtcgtagcagaaatggctgatcgagtggcagtgatgtatggcggacagttcgttgaagtagcaggtgtaaaagaactgtttgatcatcctaagcatccttatacacgctctttactgaactctataccacaagaaggaaatcatgatgcagaactccatgtgatcgaaggtgtcgttccttctctgaaaaacatgcctcgtaaaggttgtcggtttgcaccacgtattccatggataccagcaagcgatcatgaagaagagcctatccttcatgaagtcgcaccgaaccacttggtacgttgctcctgctataagcatttccactttagagacgaaaaaggagaggtgtag

SEQ ID NO: 2559 - DNA (genomic), 342 bp, Enterococcus faecium; double-stranded, circular
  misc_feature (B) LOCATION 1...342
  hypothetical: NO
  anti-sense: NO
ttaaaagagaggagtgatcgaatgattacaacaacaacgaacagtgtagagggaaaagccgtagtagcttataaagggatcgtttttggtgaggtcattactgggatccatgcatttaaagacttggaggcggggttgcgaaatatctttggcggccgctcaaaaagctatgaaaacgaactaatgggtgcaagagaagaagcacttgccgaaatggccgaacgtgcaaaagcattaggagctgatgcgatcattggcgtaaaaatggactatgaagtattaggcagcgacaatggcatgctgatggtcacatgtagtggaacagctgtctccacgagataa

SEQ ID NO: 2560 - DNA (genomic), 1548 bp, Enterococcus faecium; double-stranded, circular
  misc_feature (B) LOCATION 1...1548
  hypothetical: NO
  anti-sense: NO
gtcagagagaggataagaattatggcggattgtattttaaaaatggcagatatcaccaaaaaattttctggaatccgagcgttagattgcgtgaatctgatgattgaacgtggggaaatccatgcattgtgcggagaaaacggagcgggaaaatcaacattgatgaatgtcttgagcggcttgtatccatatggctcctatgacggggaaatcttttatgatggaaagctgtgtcaatttaaagatttgaaagatagtgaagaaaaaggcatcgtcatcattcatcaagaattagcactaagtccttatctttcaataaaagagaatatttttctcggaaatgaacaagcagaaagaggcgtgattgattgggaactgacagaaaagaaaacatatgaactgctgaataaagtcggtttgtctatcgacccgaatcttctagtatcccagattggcgtagggcaacagcaactagttgaaatagctaaagcattatcaaaatccgtccgtctgttgattttggatgagcctaccgctgcattgaatgaagaagaaagcgcgaatttgctgagattgatccgagagttgaaagagcaaggtgtaacctccatcattatttcacataagctgaatgaaatcgtggatatcgcagatcgaatcaccattttacgggatggacagacgattgagacactagaaaatgaaatgatcagcgaagagcatattattcgcggaatggtgggcagagatttagttgatcgttatcctgaaagaaaaccggatattggagaagtttattttaaagtagaagactggacggtctatcaccctcttgatcacgagcgaatcataaacgaccacatcaacttgcatttgaaaaaaggagagattgtaggaatagctggactgatgggagcgggcagaactgaattcgctatgagtctatttggacattcttatggaagcaagatatccggacgtatattaaaggaaggggcagagatatcagttaagaccgttccttcagccattgcaaacggactcgcttatgtctcggaggaccgaaaatctttaggactgaatctgctgatggatattcgggaaaacgtgacgctgagcagtttggataaaataagtcaaaaaggagtattagataaagaaaaagaagtaactgaggcagaaaatttccggaaaaagatgcgtataaaaacaaactccatccatcaaattgtcagtagtcttagtggtgggaatcaacaaaaagtcgttttatccaagtggctgatgacacaacccgatattctttttttggatgagccaacccgtgggatagatgttggggcaaaatatgagatctacacgattatcgaagaaatggcagcaaatggcaaagctgtctgtcttatctcttctgaacttcctgaaatattagggatgtgtgatcgaatctatacgatgaacgaaggacgtattacaggagaagtctcgcgagaagatgcagatcaggaagtcttgatgaaattaatgacgaaagaagaggtgggttaa

SEQ ID NO: 2561 - DNA (genomic), 960 bp, Enterococcus faecium; double-stranded, circular
  misc_feature (B) LOCATION 1...960
  hypothetical: NO
  anti-sense: NO
ataaaggagagaaaaaacatgaaaatcgcaatagctggggccggagcaatgggcagccgaatcggattgatgctacatcaaagcggaaatgaggtcctcttgatcgatcgttggcctgctcacattgaagccattcgtacaaatgggttgattgctgactttaacggtaaagaagtggtcgcaaaactgccaatctattcaccagaagaaatcatcgaaagcaacgaacacgtggacttgatcgtagcattaacaaaagccaatcaattagatgatatgttttgttcgatccaatccattattactgacaatacttatgttttgtgtttactaaatggattaggtcatgaagatgtactggaaaaatatgtgccaaagaaaaatatcttatttgggatcacgatgtggacagctggtctagctggtcccggaaaagtcacattgttaggtgatggagaaatcgaactagagaacttggaaccagaaggcgaagcatttacaaaaaaagttgtagaagtctttcaagaagcaaatttaaatccgatctatagccataacgttcgttattccatttggcgaaaagcttgtgtaaatggaacattgaatggtttatgcacgattttggattgtaatattgctgaactaggcgcgcaaaaagcggcagagagcatggttcgaacaatcgtatctgaatttgcttctatcgcagcaaaagaaggaatcatactagatcaagaagaagtgtaccaacatattgcttctacttatgatcctgacaacatcgggttgcattacccatctatgtaccaagacctgatcaaaaaccatcgtttgactgaaatcgactacatcaatggtgccatttggcgaaaaggacaaaaatatgatattgctacaccatattgtgcctttttgacccaattagtccatgcaaaagaaggaatccttggcgcagaataa

SEQ ID NO: 2562 - DNA (genomic), 1254 bp, Enterococcus faecium; double-stranded, circular
  misc_feature (B) LOCATION 1...1254
  hypothetical: NO
  anti-sense: NO
gaaaaggagagcaaacaaatgaatcgagtggtaattactggctatggagtcacttcacctattggaaatgacgcagacagctttttgaatagcttaaaagaggggacgaatggcatcgcaccgatcactaaatttgatgcttcagaaacagggattaccttagcgggtgaagtcaaagatttcccttacgataaatattttattaaaaaagatagcaaacgaatggatatgttttcgatctatggaatctacgctgctttagaagcaatggagatgagcggtttagataaagaaaaaatgaatcaagaccggtttggcgtcatcatcggatctgggatcggtggtcttccaacaatcgaaaaccaagttattcgtctacatgaaaaaggtgcaaaacgagtttctccaatgttcgtaccaatggcgattgccaacatggcagctggaaatattgctttgcgtgtaggtgcaaaaggtatttgtacagctatcgtaacagcttgtgctagcggaacgaattcaattggggaagcattccgtaacatcaaacatggctattctgatgtcattcttgctggaggaacagaagcaacgatttgtgagatggggattgctggatttgcagctttaacagcactctcagaatcaactgatcctaatcgtggttcgattccgtttgacgaaaatcggaatggttttgtgatgggtgaaggagcaggcgttctagttcttgaatctttagaacatgcacaagctcgcggtgccaaaatctatggagaaatcgttggatacggtgcaaactgtgacgcttaccatatgacagctcttactccagatggttctggtgcatctaaagcaatgaagcttgcgatggaagaagctggtgtacagccggaacaagtcggatatatcaatgctcacggaacaagtacaccagccaatgaccaggcagaagcaaaagcaatccaaatcgcattaggtgaaaatttcagagatacttacgtcagcagcacgaaatcgatgactggacatttattgggagcagccggcgggatcgaagccttggcaactttgctggcattagaacatcaatttatcccacctacgatcaatgtagaaaaacaagatcctgagattgacttgacagttgtcaaaaacgaaagcaaacctgcaagttttacttatgcaatgagtaattcattagggtttggcggacataatgcggttctgtgcatgaaacgctgggaggaataa

SEQ ID NO: 2563 - DNA (genomic), 1569 bp, Enterococcus faecium; double-stranded, circular
  misc_feature (B) LOCATION 1...1569
  hypothetical: NO
  anti-sense: NO
gaaaaggagagacaaatggatcaagaactatttattatcgaagtattatcagctaaacaaaaaattatcgagaaagcgaaaaaaagagcgaaaagaataatgttcaagcttttaagcttagtattttcctctggtgtgctttttttcggagctgtatcgttcctatatcgccatatgagtgcagtagtccgttcagctgaagggatgcaaaaattaaataatttgtatcacttttcgtggggagttggcggaataacaattgttgtgcttattgtttttcttctacttatttggctccgttaccatcaattgtcgcgtcatttcgatcaatggcttagtcaaagagcacaacagtttttacataataaaccaacttctcaagatgatgactatctttattttgagaagacttcgacgagtcaagcttttcggatacaaaaaagtgattgccagttattgctgagatcacttgatgatttacctatctacttaggcgaaagcaaatcaaaattcggaatgaacacattccatatttttttactagaaaacgaacccagatgggaaaaaagccagtcttcgcctggtggatacctgacaactaagatgagtacattagtcactggttttttcctcattcttttagctggaacaatctattatgggagatacactcagccaaaaatgtcttctcatataaatgctgcttctcacatgacaatgaactcaactaacgatacgcatatacaaaagacaaatgaagggttgttagctgatcctaagcaaaaggtaaatttgacaacacaaaagataaatgatctcaaacttgatacagagacgcactctctctatatgacaacagatagtggtgctaattgggtatttgtgccgattgattcgcaatggttgcgttttggcgaatacaccctgacaacggggctgattcctgaaggttattggatggacaacacatatgatatttccgccgatttctcatggtttatctattcttctggggatgatgtacgtctgctgacttcaagagataatggtaaaacatggcaaacgtctattatcacccaatcagttcagccgatacgttatcgaaaagcggtattttatggcaacgatggtctatttatctgtacatcagccagtgggatgtctgcagaaactttgtacatttacactactatggatggcggaatcacttggataaaaagtggaagtacaatgatcaatcagccagtacaaaatgtcagcttcgttacaacttctttaggttttgtttcgacacgtgaaagtttgttttatacaaacaacggaggacgctcattcaaagaatcagttctgtcgattccggaaaactatcagacaggggggatagatctttttcaatcaccaaatgaagttactcaaataagcgcgaatacgttagagacaaaattttatttgttgaaaaaaggaccaatcgatgcagggaaaatgtttgcctgcctcttccgttcaactgataacggggaaacatggcaattcgttcagcaactatcgcaagtagaacaaggagattaa

SEQ ID NO: 2564 - DNA (genomic), 2217 bp, Enterococcus faecium; double-stranded, circular
  misc_feature (B) LOCATION 1...2217
  hypothetical: NO
  anti-sense: NO
aaggaggagaggaagaaaatgaagaaaagtacagtattttataaaatatttttaccgatgtttttattaggagccgtacttgtcataggatttagtttattcatttaccagaatacctatgaatcgatcgaatcgagttatttaacagacaaaaagaatttgctcaggcaagttaaaactaacgttgaatggaaaattagaacgattgaatattcgttttctacgtatggttcgaccaaaaatttctcggacatattcaagcatccgctgacatatacagattactccacttattctgaaatcaggaaagaactaaattttatagaaacgattgttatggatgataataattatgatttagtcagtttggctggtaaatggggagtaatcaatggatcgttgagtcaactgaccgaagaggaagttgaaaagtatcaacagaagtacataaataacaaaaataatttattttggcaaaagaaaaacaaaggaatcgaaatggtgatttctttgccaatgtttgaaaaagaaaaatatgcattgggaattgctacgatagagaaacatacaatagaacaagttgttggtgaaagtggagaagacatactttctattgaaaacgaagttggcaacctttttactactcagacagtaaaaaataaagagcaaccaactgtattaacggacgtggatctagattacaatcagctgaaagtgataagagaaaaagataaaacgtatatagtactgaaatcagattataataattggatttacagattagaagttgactctagtgcaattggcgcaatgatccgcaatctgagaatcgggctagttgcagtgtctttaacactggtaggactcattggtcttctttcctacttattttcggacagatttgcccgtccgatttctcaaatacaggaacgtctgaatcttaaatcaaaaggattcagtgggaaagaactagatttggtcgctcaatcagtcagtcggatcataggagaaaaagaagcgttaagtgcacacttagttacccaaaagccacagctggaaacgctatttgtacttagtttatttagaaatcgagtagaaaggcgagaactagatcagcggttgcagcaatttggttatagttctcaaaatgactgctattatacagctttggttcaaatcgatctgttagaagatagtcacggtggggagcgtgatttgctacttttagcgatcaacaacatgatcacggaaattgtgccaaaggaaaatcgaatgctgccgatcgttttgaatgaagaaatgcaagccactatttatcgaatggataaagatgatgcagaagcaagcaaaaaagtcatggagtattgccgactcattcaaaaacgtgtaaaagaatacttgaatttaactatcagtataggcatcagtaaccggttcgaaacgctgaatgaaagcaagcaatcggttgatcgggcaaaagaagccctgtattatcgtgtaaatactggtccaagttcaattattttttatcaggaaatcgttcctgctgctcatgaaaaaacacttattagatatccgatagaagaacaaaatcgattgtttgaagccattcgttctggaaatcaggaagtgaagaatttagtacatgaattgattgatgcattgtttgcacaaaataaaaatcctttgagtcgggaagtagtttcggtccgcttgatcaatgaactcgttcaattaggacagttattgggagtagattcaaaaaactttgataacatgaaacaaatttatgtaaaagcactgaacaattatcatcccaaagaactagaaaaacttgttttagaacaattagttctgccaatcacagaatgctctcaagcaatcactgatcatgaatttaaaaatttgtcggagaatattatgcatatcgtctacacagaatatgatcgtgatctgtctttagatgtgatcgctgataggttgcattataaccctaactatttaagtaatgtatttaaaaaggaaacaggagaaaaatttggtgattttgttcaaaatcatcgtttagaggtagcaaaaaaatggttgaaagagactaacctctccgtaaaagagattgcagaaagattgcaatatcgaaatccgcaaaattttattcgtttctttaaaaagaaggaatcgattacgccgggagaatatcgaaaaaaatatttgtga

SEQ ID NO: 2565 - DNA (genomic), 939 bp, Enterococcus faecium; double-stranded, circular
  misc_feature (B) LOCATION 1...939
  hypothetical: NO
  anti-sense: NO
gtacgggagaggtacatgaaagtttggaacaaaataaaacaaaatgaaaatctgatgcgctttattgagacgactcaaaagcgcatcactgattcagaaatgagtacgacctctgtcgtcgttgcttattatttactcttgtctttatttccattgattattgcttttggtaatattttaccgtttctccacatcgatcaagagactgtactgacctatttacgagaagtgattcctgagaccgtttaccagtttatcggtcctgcaatcaaagaccttttgacacaaagttcaggaggcttgttatccgtttctgcattagcggctttatggtctgcaagtcaaagtatcaatgctttgcaaattgcgatgaataaagcgtatggcgtagaaaatagaaaaaattttttgatcgtccgtttcttctcactaattgtcattgtcttgttcatgattgctattagtggggtaactatcgttcttgggttgggacagctgattttggatgctattcagccaatcgtacaaatacccgtgaactttatcgatcagttccaaactttgaagtggccaatcacattggtagctttatttgtcatcatgttcttgatttatttaattgtccctaatgctcagttgaagttgaagacgatcattccgggcacgatcttcgctactgtcggctggatgctgttatcacaagtgtttagtatctatgctaggtattttgcaacgaggatcagcggttatcagatcataggaagttttattgtactcatgctttggcttaattttgctgctacgatcatcattttgggcggaatcatcaatgcagttgttcaagaatacgtgacgggtcatcaaatcaaaaaacgtcgagatccaagccgaaaatggttcaataaattgaaaactaaattttctcataaaaaaaagtag

SEQ ID NO: 2566 - DNA (genomic), 3675 bp, Enterococcus faecium; double-stranded, circular
  misc_feature (B) LOCATION 1...3675
  hypothetical: NO
  anti-sense: NO
atgaaatggagggaaccccttttgatcgatgtaaataaattcgaaagtatgcaaataggtttggcttctcccgaaaaaatcagaagctggtcttacggtgaagtaaaaaaacctgagacgattaactatcgtaccttaaaacctgaacgcgaagggttgttctgtgagcggatttttggtcctacaaaagactgggaatgtgcctgcggaaaatacaaacgtatccgttataaaggaatcgtttgtgatcgatgcggagtggaagttactcgttcgaaagttcgccgtgaacgcatgggacatattgaattagcagctcctgtttcacatatctggtactttaaagggattccttcacgtatgggtcttgtattagacatgagcccacgcgctttggaagaaatcatttattttgcttcatatgtagtcatcgaaccaggaaatacgaatttagagaaaaaacaattgttgacagaacgcgaatatcgcgaaaaacgtgaacaatatggacaagaattccaagctgctatgggtgcagaagcgattaaacaattacttgataatgttgatctagatgcagaagcagccgaattgaaagaagaattgaaatctgcacaaggacaaaaacgtacacgtgcaatccgccgtttggatattttagaagcattccgcgcttcaggaaatcaaccaagctggatggttatggacgttatccctgttattccaccagatttacgcccaatggttcaattagaaggtggacgttttgcaacaagtgacttgaatgatctttaccgtcgtgtaatcaaccgtaataaccgtttgaaacgtttgttagacttgaatgcacctggaatcatcgttcaaaatgaaaaacgtatgctgcaagaagcagtagatgcattgatcgataacggtcgtcgcggacgtccagttactggaccaggtaaccgcccattgaaatctctttctcatatgttgaaagggaaacaaggtcgtttccgtcaaaacttgctaggtaaacgtgtccactactcaggtcgttccgttatcgttgttggacctttcttgaagatgtaccaatgtggacttccaaaagaaatggccattgaattattcaaaccattcgtgatgcgtgagcttgttcaacgcgaactagcttcaaacatcaaaaatgcgaaacgtaaaatcgaacgtcaagaagacgaagtatgggatgttttagaagacgtaatcaaggaacacccagtattgctgaaccgggcacctacgcttcaccgacttggtatccaagcattcgaaccagttttagtacaaggacgcgcaatccgtttgcatccacttgtatgtgaagcttataatgccgatttcgatggagaccaaatggctgtccacgttccattgaatgaagaagcacaagcagaagcacgtatgttgatgttagctgctcaaaacatcttgaaccctaaagatggtaaaccagttgttactccttctcaagatatggttctaggtaactactacttgacaatggaagaagaaggacgcgaaggcgaaggaatggtcttcagagatcaaaacgaagccgttatcgcatggcgcaacggatatgttcatttacattcacgtatcggtgtgaaccctaactcattaggtgaaaaaccatttactgaatggcaaaaagaacgtacgatgatcacaacagttggtaagatcatcttcaacgagatcatgcctcctgaattcccttatctgaatgaaccaacagacttcaacttgaccgtccaaacaccggacaaatactttgttgaagctggtactgatattcctgcacatatcaaagagcaagaattagtattaccgttcaagaagaaaaacttaggaaacatcatcgcagaagtcttcaaacgattcaaagtaacagaaacttctaagatgcttgaccgtatgaaagacttagggtacaaacattcgacacatgccggtatcacagtagggatcgctgacatcagtgtactgaatgaaaaacaagaaatcattgaaaatgcccataaacaagttgaaactattacaaaacaattccgtcgtggtctgatcacagatgacgaacgttatgaacgtgtcattgctgtttggaatgctgcaaaagacagcatccaacaaaaactgatggaaggtttggaagcgaaaaatccaatcttcatgatgtctgattctggagctcgtggtaacatttccaactttacacagcttgccggaatgcgtggtttgatggccgctcctaatggtcgaatcatggaattgccaatcatttcgaacttccgtgaaggactatccgtcttggaaatgtttatctcaactcacggggctcgtaaagggatgaccgatacagccttgaagactgccgattcaggttacttgactcgtcgtctggttgacgtggcccaagatgtaatcatccgtgaagaagattgcggtactgaccgaggtcttgaaatccaagccatccgcgagggaaatgaaatcatcgaatcattaaaagatcgtttagtgggacgttacacccgtaaagaagtacgtcatcctgaaacaaatgaattgatcattgcaggaaaccaattgatttccgaagacatcgcaaaacaaatcgttgatgcaggtgtcgaaacagtgacaatccgttctgtcttcacatgtaatacaaaacatggtgtctgcaaacattgttacggacgcaaccttgcaactggctctgacgttgaagtcggagaagcagttggtacgatcgccgctcaatcaatcggtgaacctggtactcagttgacgatgcgtacattccatacaggtggggttgccggagacgatatcactcaaggtcttcctcgtgtccaaaaaatctttgaagcacgtaatccgaaagggcaagcagtgatcacagaagtaacaggggatgtcatcgatatctcagaagatcctgcaacacgtaccaaagaagtaacaatcaaaggaaaaacagatacacgtacgtatactgttccttatacagcacgtatgaaagtagcagaaggcgatatgatccaccgtggtgcaccattgacagaaggatcaatcgatccaaaacaattgttgcaagttcgcgatgtattatctgttgaaaactacttgcttcgtgaagtacaacgtgtttaccgtatgcaaggggtagaaatcggcgacaagcatatcgaagtaatggttcgtcaaatgctgcgtaaagttcgtgtaatggatccaggtgatacagatatcttaccaggtacattattagacatcgcagactttaaagatcaaaactacaatacgctagtctcaggaggcgttcctgcaacttctcgacctgtcttactaggtatcacaaaagcatcattagaaacaaatagtttcttatctgctgcatcattccaagaaacaactcgtgtcttgacggatgctgcgatccgcggtaagaaagatcctcttcttggtttgaaagaaaatgttattataggtaagatcatcccagctggtactggtatgcaacgttatcgtgacatggaaccaaaagaagtcggtgtagcaagcgaaaatgtctacagtatttcagatattgaagcgcaaatggctgcagaagacgcaatgaacaatcaaacaaaatag

SEQ ID NO: 2567 - DNA (genomic), 723 bp, Enterococcus faecium; double-stranded, circular
  misc_feature (B) LOCATION 1...723
  hypothetical: NO
  anti-sense: NO
acgaaatggaggagaatcaaattgactgagttttttgtgaatccattatttggcttaagtttgactttaggagtgtacgtattatctgacaaatttttgcggaaatataaactgcctgttttgaatcctctcgtattatcgattgttgttattatcttatttttgcatttttctgggatcagctataaagactataatatcgggggcaattttttgactatgctgattactcctgcgacagtggcacttgccatccctctttataaaaacttccgtttactgaaagagaatttttatcctgtaatggctgcgattttagcaggaatagtcgcaaattgcttggttagtgtagggttcggttacttcttctctcttcataaagagatggtgatctcattactacctaaatctgtaacgacggctatttctgtcgatttatctcatacggtgggcggggtgaatgccgtgacacttgctattgttgtctctacaggtatttttggttcgctgatcgccactcatattttccgcctattcaagatcgaaagtccagttgctcgcggtgtggcgttaggaagtacttctcatgctattggtacagcaaaagcaatcgagattggtgaaatagaaggaatcatttccggacttgcgatatgcgtcaacggaatattgaccgttttattgctaccgttattctttcagccttttgctggcttgttttga

SEQ ID NO: 2568 - DNA (genomic), 1017 bp, Enterococcus faecium; double-stranded, circular
  misc_feature (B) LOCATION 1...1017
  hypothetical: NO
  anti-sense: NO
aggagatggagaaaaatgcgcgaaatagatacctgtattgtgggggcaaccggattagtcggccaaacgatgctcaaagtgttagaagaatatgattttccagtaggacgattgaaattattagcttcaaaacgttcagccggtaaagtttgtgtattcaagaaaaagaaacacactgtacaggaattgacagaaacttcatttgaaggatatgatttagcgctattttctgcaggtgcttctgtatccaaagagtttgcgccaatcgcacgaagtcagggactatttgtcatagataattcctcagcatggcgggaagattcggatattccattaatcgttccagaggtcaatctggaagactatacattgaatcggctgattgcaaatccaaattgttcaaccattcaagcggtacttccgcttaaagctttacaagaagcctttggtatccagcgagtcaattattcgacctatcaagcagtttctggttccgggcaaaaaggcattgaagatcttcatcgtacgcaaaatgacgaggaaccagttttgtatccttataatattagccaaacggtgattccggaaatcgatcagcctttggaaaatgggtatacaaaagaagaacagaaaatgataaatgagacccgtaagattctgcatcagcctgctttgccagtatcagcaacctgcgtacgtgtgccaatcgaaaatggacatggagtctctgtggcagttcaactgcaaaaagagtttacgacggaagaaattagagagtgtctcagccagtttccagggattcaattagaagatgatctagcagcacataaatatccgacgagcattcttgctagaggaacagatatggtttatgttgggaggatcagaaaagacacttctttagagaacggattgttgttctatacgactgccgataacatacgcaaaggagccgctgcgaatgccgtacagattgctgcagctttaatgcagaaaatagcggaggtggcaagatga

SEQ ID NO: 2569 - DNA (genomic), 2382 bp, Enterococcus faecium; double-stranded, circular
  misc_feature (B) LOCATION 1...2382
  hypothetical: NO
  anti-sense: NO
agaaagtggaggaagtatatggcagtagttatattagcagaaaaaccagatcaaggagcaaaatttgcttcagcattggccggaaaaaaattatcgaaaaagagtgggaagtatgaatttaaaagtgaaatatttggagatactattgttacttggggaataggtcatttggtaggattatcattacctgaaaagtatgagtggctaccgaataaagataaatggcatttagataatttgccttttctacctaaattcaatgaattaaagtatgaagtctctaaaggaaaaaaccaacaattttcaatagtgaagtcatgtttagaaaatgcagatgagataataattgctactgatccggatagagaaggagaaaatattgcttataatattttcaaattatgcaagcagtcgatttttaataaaccgataaaaagattatggattaattctttggttcaaaaagaaattatcaaaggatttaaaaatctgcgaaattctgaagaaacgatctcttacttcaaagaagctaatgctagacaaattgctgactatctagtagggatgaattatacagagttgtattcattaaagttgcaagaaaaaggtatatcgggtgtggtatcactcggtcgagttcagacaccggtaaacacacttgtggttgaaaacgatttggcaattagaaattttagaccggaaaaatataaaacgattgaatgtcatacaaccgataagcaaccaaaagcaatatttaagaatagtcttgaatactttaaattagaaaaatttgaagaagacactaaaaaattcggccttgattccgccagtactggaatcataaaaaaaattgaggttagtaaaaagcaaacagaaccacaaaaattgtttagcttgggtggtattcaagaatacgctaataaaaaatggaaatattctgctaaaaaaacagataaaattatccaaagtctatatgatcgtggatatttatcttatccaagaaccgatagtgaattgataactacaaatgaatttgagtatttaaaagcgaatttagacgtgtataagagtgttttagggatcagtattgatacaccttgtttagagcctaaaaagcggtttgtagataatgacaaagtattagagcattatgcactaataccaacaatggatattcctgatatagcaaatctgacattagatgaaaaaaatatttatgagatcgttactaggcgtgcgtgtctaatgtttgcagaaccttacaagtacgaaaatacaaaagttacattagatgtaaacggcttagaatttaccacaagtggtaatgtacctatatctttaggttggaagcaagtagatactaatttagatgaatctgatgataaagaggaaacattacctaaatttcatgaacaagagacaataaatatagatattagatttattgataaattaactaaggaacctaaaaggttgactgaaggtaaattattaggtaaaaccggtattatggcgaaattagggctaggaacgcccgctacacgttctaatattgtagacactcttctaaatagggaatatattaagatagaaaacacgaatgtttatcctactccaaagggatatttattatgggatttgacaaagaataaagacctattgattggaaaaccagaaaatacagcgatatgggaagaatcacttgggaaaattgcgcaaggtagctatacacaggaagcttttttaagaaatatctataactatatcaataagactgtttcagatttgaaaaaagtagaatttacttcggattatttagaaaagactgtaaatcaaaataaatttgatataggtagttatcaagtggaagaaaagaaaaaagtttattctattttaaatattactagtggtgaacagttcgtgatatttaaaaatatatcaggaaaagcaatcaataaaaaagttcttcaagaactattactaaataatcgtacagataaagtcctttccggctttaagtcaaaagaaggaaaagcttttaatgcaagattacttttcgatccaaatgtgatgaaagtggtaatggagtttgaaaagaacagtccaaaaggcgataaaaagagcaaacacgatacagtaaatggttatgaaatagttgaaaaagcaaaagtatttgaaataaaagaattagcaacaggtgaaagttttattttctataaaaataatagtgggaaaactttaagttcaaaaacagtcaaagaattgttagaaaatgggaaaactaaagagaaagtaacgggttttataagtaaagacaataaaaaatatagtgcttatcttgtctttgataataaaaacaaagttataaagaaagaattttaa

SEQ ID NO: 2570 - DNA (genomic), 813 bp, Enterococcus faecium; double-stranded, circular
  misc_feature (B) LOCATION 1...813
  hypothetical: NO
  anti-sense: NO
atttgtcggaggaatttattttgtcacaaaattgattcgcgaaaggaagagtatcctatgattgatttacaaaaggtcaataaactgtaccatggaaaatcagtggttaaagatgtacagttaacgattcctgaaaagaagttgactgcttttatcggtccaaatggtgctggaaagtcaacggtgttgtcgatgatcagtcgtttgataccaaaagatacaggtgaaatctatttagaccataacgaagtaaaggcttggaaatccaatgaattagccaaaaaattatcgatcctacgacaatcgaatgaaataaatgtccaaatcaccgtgaaagaattagtagaatttggacgatttccttatacgaaaggaaaattgacgacaaaagacgaggaaatcgttcaggaatcactggaacaccttgggttagaagaaatagcggatcaatcgattgacactctttcaggcggtcaactccaacgtgcgtatattgcaatggtgctagcgcaagacacggattatattttactggatgaacctttgaacaatctagatatgaattttgcggttcaaatcatgcagattttaaaaaatttagtacaagaaatcgggaaaacaattgttattgttcttcatgatatcaactttgctgcaagttatgcagacgaaattgttgcaatgaaagatggacagttatttacgcaaggaacgacccaagaaatgataaaaaaagatgtattggatgaattatacgaaatggacatacggatttgtgagattgaaggccgcagattctgtctttatttctaa

SEQ ID NO: 2571 - DNA (genomic), 210 bp, Enterococcus faecium; double-stranded, circular
  misc_feature (B) LOCATION 1...210
  hypothetical: NO
  anti-sense: NO
acaccccggagatttaatttggagcanagaatgctgttgctgtctgatagaaaacnnnatcacttggattgtatttacaaaaccagagagcaattaaataagttagatactgtcagatattattttacctacttcagtgagaatgacgaacaaagatgggatatttttcatgatggtaattacgaagaatttttttacactgaaagttaa

SEQ ID NO: 2572 - DNA (genomic), 273 bp, Enterococcus faecium; double-stranded, circular
  misc_feature (B) LOCATION 1...273
  hypothetical: NO
  anti-sense: NO
gacagacggagtaagcatggcaaaaaaattagtctgacgatggatctattgatacccgtaattgcatttatagacgggatttctttgggcgtcactgaaaatcctttggtaaatagaattgcgaaaggatcactatttcttgtattcgtgtatcttgtctgttcttatcttttaaaaagagcaggaaaggataattccttttggcgattgactaaagtcacagtagcagcgacagctgttatacttacggctattctaccgctttatatgtag

SEQ ID NO: 2573 - DNA (genomic), 2616 bp, Enterococcus faecium; double-stranded, circular
  misc_feature (B) LOCATION 1...2616
  hypothetical: NO
  anti-sense: NO
cccattaggaggataatgatggctaaagtaatagaaaaagaaaaaacgaagacaattgacgtacaagcaatgattgatgatttggcagaaaaagcaaatgcagcattgaaagaaatggaaagctttgatcaagaaaaagtagaccatatcgtgcatgaaatggcaatggcagctttggatcaacatatgccattagcgaagatggctgtagaggaaacaggccgcggtgtttacgaagataaagcaatcaaaaatatgtatgcgtccgaatatatttggcataatatcaaacatgataaaacagttggtgtgatcaatgaagatgtccaaaaagggttgattgaaattgctgaaccagtcggtgtggtttgcggagtaactccaacaacgaatccgacttccacaacgattttcaaatcaatgatcgcgttgaaaacaagaaatccaatcgtttttgctttccatccaagtgcccaaaaatcttctgcagaagcagcacgagtggtacgtgatgctgctatcgctgccggagctcctgaaaattgtatccaatggatcgaacatccttcgatcgaagcgacttctatgctaatgaaccatccaggtatcgcgatcgtcttagcgacaggtggagctggaatggtcaagtctgcttactctacaggaaaaccagctttaggtgtaggtccaggtaacgtaccagcttatattgaaaaaacagcaaaaattaaacgtgcagtgaacgatttgatcgtttcgaaaacatttgataatggaatgatttgtgcttctgaacaagctgtgatcgtggataaagaaatctatgcagcagtaaaagcagaattccaagcacaccaagtttatatcgtaaaaccagatgaattgcaaaaattagaagatgcagtgatgaacgaaggaaaatatgcggtcaatccatcaatcgttggacattctgcgatggaaatcgcaaaattggcaggaatcagtgtaccaaaaggaacgaaaatgctgattgctgaattggaaggcgtaggcccagattatccgctatcaagagaaaaactttctccagttcttgccatgatcaaagctaacaacacggaccatgcgtttgatttgtgtgaaggtatgttgaatcttggaggattaggacatacagcagttatccattcagaaaacgaagagttgcatgtcaaattcggtcttcgaatgaaagcttgtcgtattttagtgaatacaccatctgcagaaggcggcatcggtgatatctataacgaaatgattccgtcattgactttgggatgcggttcttatggtaagaactctgtttctcgtaacgtctctgctgtaaacttaatcaatgtcaaaactgtagcgaaacggagaaataacatgcaatggttcaaattaccgccaaaaatcttctttgaaaagaactctctattgtacttagagaaaatggaaaacgttgaacgtgtcatgatcgtttgtgaccctggtatggtccaattcggttactgcgatacagttcgtgaagtattggcacgacgtaaaaatgatgtgaagatcgaagtctgctcagatgttgaaccgaacccatcgacaaataccgtatacgcaggaacgaaactgatggcagacttcaagccagatacagtaatcgctcttggaggcggttctgcaatggacgcagctaagggaatgtggatgttctatgaacacccagacacatctttctttggtgcaaaacaaaaattcttggatatccgtaaacggacatataagatcgacaaaccagaaaaaacacaattcgtatgtatcccgacaacatcagggactggttctgaagtaacgccatttgcggtcatcactgacagtgaaacacatgtgaaatatccgttagcagattatgcattgacgccagatgtcgcaatcgtcgatcctcaattcgtcatgtcagttccagcatctgtcacagcagataccgggatggatgtgttaacacatgcaatcgaatcctatgtttcagtcatggcttcagattatacacgtggattgagcctacaagcaatcaagttagtctttgactatttagaaaaatcagtaaaaacacctgatatggaatcacgtgaaaaaatgcacaacgcttctacaatggctggtatggcgtttgctaacgcattcctaggtatttgtcactcagtcgcacataaaatcggcggggaatacgggatccctcatggacggacaaatgcgattcttttaccgcatattatccgctataatgcaaaagatccacaaaaacatgcgatgttccctaaatatgactatttccgtgcagatacagattacgcagatatcgcaaaattcttaggtctgaaaggcgaaacaacagaggaattagtcgaagctttagcaacggctgtttatgaattaggaaaatctgtcggcatcaacatgagtctaaaagctcaaggagtcacacaagaaacactagatacaaccgtagaccgtatggctgaattagcttacgaagaccaatgtacgacagctaatccgaaagaaccattgatctctgaattgaaacagatcatcattgatgcttacaacggataa

SEQ ID NO: 2574 - DNA (genomic), 534 bp, Enterococcus faecium; double-stranded, circular
  misc_feature (B) LOCATION 1...534
  hypothetical: NO
  anti-sense: NO
caacctaggaggaaacaaagagtggatttaaaagattatattgccagtattcccgactatccgtcaaaaggaattgtgtttcgagatatttccccactgatggcagatggtgacgcttatcgggaagctactaaacaaatcgtaaattatgcaaaagaaaaacgaattgatatggtagttgggccagaagcccgtggattcatcgtaggatgtcctgttgcttatgagttaggagtcggttttgccccagtccgcaaaaaagggaagttacctcgagaaaccatcgaagtgacttatggattagaatatggaacagatacattgacattgcataaggatgccattaaaccaggtcaacgtgtgctgatttgtgacgatttgctagctactggaggaacaatcaaagcgacgatcgaactgatcgaacaattaggcggtgtagtcgtaggctgcgcatttttgatcgaattgatggatctccatggacgcgacaaaatcaaaggatatgacatcattacattaatggaatattaa

SEQ ID NO: 2575 - DNA (genomic), 585 bp, Enterococcus faecium; double-stranded, circular
  misc_feature (B) LOCATION 1...585
  hypothetical: NO
  anti-sense: NO
gtttataggaggtggaaaatgaataaggggttaaaaataatcggtgttatcatgagtttactgctactttcagtatttctagcgattgcgttgatcaatgcgccgtatattatgcctgaacaattggaacgatttcgcttctttactttaacgaattactacatgcaacaatatattttctgggcagctgtagtatttgccgttcttgctattatcatcttgctagtcgttcttttctatccaaagtcaagaggaactttcgttatgaaacgggaagatggcaaactaacaatcgacaaaaaagcgatcgaagggttggtacgttcccatttacacgaagaagagttcattcattcacctaaagtacggatacgttcaacgaaaaatcgaatccatatccatgtcaacggagacttgaaacgaacttcttcattagtagggaaaacaggtgtattgatgcaagatatcgaagaagaagtaactaaagtactcggaacaaaagaaacggtcaaagtggcagtcacatacagcggttatgaagaacaagaagatacaagagactacaagcactctcgagtggaatag

SEQ ID NO: 2576 - DNA (genomic), 867 bp, Enterococcus faecium; double-stranded, circular
  misc_feature (B) LOCATION 1...867
  hypothetical: NO
  anti-sense: NO
gaaaataggagtgtggctatattgaaaaaaatagatattttacaagcgccttatgtgaaagaaatgatcgaaacgacgtcgaatctttatcgcttgggatgggatgaaagaaatggcgggaatatttcttatttactaaaagaagaagagatcacaccgttcttggatcctgaaaaagtgatccgccgcatctcgatgatttttgatgccagccgtttagcaggatgctattttattgtaactggttcaggaagatattttaaaaatgtagcgagcgaacctgccgagaatcttggaatcgttcgagttgctgaagatggcaaaacactggaacttttgtgggggctggaaaacgaatgccttcctacaagcgagttgccaagtcatttcatgagtcatatcgcccgtttagaagtagacccagataatcggatcgttatgcattgccatgctagtcatctattagcgatgagttttacgcatgaattagacgaacgttcctttagtcgtacgctatggcaaatgtgtacggaatgcttagttgtttttccagaaggaatttccatcattccgtggatggttccgggaacaaatgagattggggaagcaacagctgaaaaaatgaaagaaactcgattggttttatggccacaacatggaatctacgggtcaggaaaagacatggatgaagtctttggtttgatcgagacagcagaaaaggcagcagaagtctatacgtacgtcaaagcgcaaggaccaatcttgcaaacaatcacggacgaaaacctgtggcatttagcagatgcgtttggtgtcactccaaaagcaggttatttggaggaagttcatacgaaagcaggtgtctga

SEQ ID NO: 2577 - DNA (genomic), 996 bp, Enterococcus faecium; double-stranded, circular
  misc_feature (B) LOCATION 1...996
  hypothetical: NO
  anti-sense: NO
gttaacaggaggaaatttatcatggatacacaaatcagaggaattcaccacgtcacagcaatgacatctagcgctacaaaaatctaccgcttttttacagatattttaggaatgcgcttaatcaaaaaaacagttaaccaagatgacatcgaaacttaccatctttactttacagacgatactggtgcgccaggaacagatatgactttctttgattttccaaatcagccaaaaggaaaaaaaggaacagatacgatctctcgtgcttctttccgtgtgccaagtgacgcagcattagacttttggttggaacgttttgaaaaatatgacgttactcattcagcaatcaatgaacgtttcggcaaaaaatatatcgaatttgaagatttcgataatcagtattatcaattgatctctgacgaaaacaatcaaggtgtagcagctggcattccttggaaaaacagcaatgtaccgacagagtttgcgatcacaggacttggacctgtctttgtccgtgtcagtcaattagagcatatccgcttgattcttgaaaaaatcttaggattcaaagaaacagaccattcaggagatttctacttatttgaaatcggtgaagggggaaatggtgcaagcatcattattgaacatcggacagacttgccaaaagcaatcgaaggatttggaaatatccatcacttagcattgcgtgtagcagacaaagaagcattggaatactggattcaagtaatcaataagattgaattgccaaattctggtttcgtcgatcgtttctatttccaatctgagtacttcctagccgctcatcacgtactgtttgaattagcaactgatggtcctggattccttgaagatgaaccagcagaatcagcaggagaaaaactatctcttcctccattcttagaagaacgtcgtgaagccattgaagcttatgtccgtcctttcgatacaagtgatgcaaataaaaaacgtgaataa

SEQ ID NO: 2578 - DNA (genomic), 717 bp, Enterococcus faecium; double-stranded, circular
  misc_feature (B) LOCATION 1...717
  hypothetical: NO
  anti-sense: NO
aacgacaggaggaaaataaaaatggctaaaaaaggtggatttttattaggtgcagtagtcggaggcacagccgcagcaatcgccgcgttattgttagcaccaaaatctggtaaagaacttcgggatgaattagctgcccaagcggatgatttgatggatatggcttcagattacacagatatggcgaaagaaaaatcgactgagttaacaggtattgcaaaagaaaaagcgcaagatctttctcaacaagcaggtgatctagcaggtagtgtcaaacaaaaagtaagtgaatcagcagatgaagcaggaagtgaatctgacgatatcttgttaaatcttaaagaacaatcagctgacttatctaatcgtttcaaaaaaacggcagaagatatgaaaaaacctgcagatgaattaggaagtattgctaaagatacttcagaagatatcatgattgatgtaaaagacgctgctggtaaagcaggagatactgtcaatgaaggaatgtcagaagcaaaaccagttgcagatgactcaaaagaaatgatgaaaatggcaaaagaagatgcgaaagaagctaaaaaagaaataaaagatacaatgacagattcatctacaaatcactcaaatcacaaatttatagaatataagggtgggagcggactagctctcaccttttctactataatttttataagacaagtaattcttgtggtgtag

SEQ ID NO: 2579 - DNA (genomic), 1050 bp, Enterococcus faecium; double-stranded, circular
  misc_feature (B) LOCATION 1...1050
  hypothetical: NO
  anti-sense: NO
gaattaaggagaaattttcttatgaaaaacatcattgttaccggaggtgccggattcatcggctctaatttcgttcattacgtggtaaacaatcatccagaagtgcatgtcactgttttggataaactgacttatgcaggaaacaaagagaacttggccggacttcctagcgatcgcgtagaattggtcgtaggagatgttgcagatgcagaattagtggaccgtctagtaaaagaagcggacgcagttgttcattacgcggcagaatcccataacgataattcattaaaagatcctttcccatttgtacaaacgaatatcattggtacgtatacacttttagaagcttgccgcaagtatgatgtacgctatcatcacgtatctactgacgaggtttacggcgatcttccattacgtgaagacctgccaggacatggggaaggcgaaggagaaaaattcactgcggaaacaccatataatccttcaagtccatattcttctacaaaagctggttcagatctgttagtaaaagcatgggtgcgttcttttggcttacgtgcaaccatttcaaactgttcaaacaactatggtccttatcagcatattgaaaaatttattcctcgccaagtaacgagtatcttaagcggtattcgtccaaaattatatggcgaaggaaagaatgttcgtgactggatccatacgaatgatcattcttcagcagtgtggctgattttgacgaaaggcagaattggcgaaacctatctgatcggtgcagacggtgaagaagataataagaccgtgatggaattgatcttagaaatgatgggccaaccaaaagacgcatacgaccatgtaaacgaccgcgcagggcacgatttgcgttatgcaatcgattcgacaaaattgcgagaagagctaggttggcagcctgagtttacgaacttccgtgatgggttggctgacacgatcaaatggtacgaagaacatgaagactggtggaaaaaagaaaaagaggccgttgaagcagcatatgccaaaaatggacaataa

SEQ ID NO: 2580 - DNA (genomic), 552 bp, Enterococcus faecium; double-stranded, circular
  misc_feature (B) LOCATION 1...552
  hypothetical: NO
  anti-sense: NO
tttataaggagatgcttaaacatgaaagaatttaaagaattggaagattttattggaactcactttatctatacgtatgacaatggttgggaatatgaatggtatgccaaaaatgaccatactgttgattaccgtatccatggcggaatggtcaaaggccgttgggtaaaagaccaagaagctgatatcgttaaattgacggacggcgtattcaaaatcacttggacagagccaacagggacagacgtggcattggactttatgccaaatgaaaagaaacttcacggaatgatctttttccctaaatgggttgaagaacatccagaaatcactgttactttccaaaacgaacatatcgcagaaatggaagcagctcgtgaaaaatatgaaacttatccaaaattacttgttcctgaatttgctacgatcacttatatgggtgatgcaggtatagacaatgaagatgttattagcgaagaaccatacgatggaatgccagatgatatccgtagcggaaaatacttcgatgaaaattataaacgagtaaaataa

SEQ ID NO: 2581 - DNA (genomic), 222 bp, Enterococcus faecium; double-stranded, circular
  misc_feature (B) LOCATION 1...222
  hypothetical: NO
  anti-sense: NO
aacacaaggaggatttttattatggagacaggtacagtaaaatggtttaactcagaaaaaggatttggattcatcactgcagaaaacggaaacgatgtattcgttcatttctcagctatccaaggtgacggattcaaaactttagaagaaggccaaacagtaactttcgacgttgaagaaggtcaacgcggacctcaagcaacaaacgttactaaagcttaa

SEQ ID NO: 2582 - DNA (genomic), 1692 bp, Enterococcus faecium; double-stranded, circular
  misc_feature (B) LOCATION 1...1692
  hypothetical: NO
  anti-sense: NO
aacacaaggaggaaatcaatggatacagctgcaatttatcatcgaccggaaagtgaatatgcatttctatatacgaatacaagatttcgtattcggcttcgtactaggaaaaatgatatcaaaaaagtatatgtgctttgtggagatccatataccataacaactgaaaaatggtatcaaaaacaacgaccaatgaaaaaatgtctaagtaccaatgttcatgattattgggaaattgaagtgacgagcgaaacaaggcgcttacagtatgcgttccatgttgttggggaagataacacggactgtttttacggtgatcaaggaatttttccttatcgagaaaatgtgattactgaaccaaatttttattttcgaataccttattttcatcaaatcgatcgattcactattccagaatgggtaaaagaaacagtatggtatcaaatttttcccgaaagatttgcaaacggggacaaagcaaatgaccccgaacacattttactttggggaagtaaagatccagaccgagaagatatcttcgggggagatttgcaaggtgtgagggatcatttggattacttgacggaccttggcgtcaatggcatctatttttgtcccatatttaaagccacatccaatcataaatacgatacgattgattattatgaggtggatcccgcttttggcgataaaaaacttttaaaaaacttgattgatgaagcacataaaagagggatacgtatcatgttcgatgctgtattcaatcatatgggtgtccattcaccacagtggcaagacgttctcaaaaacggagaaaaatcgatctataaagactggttccacatccgttttttcccagtagattcttatcagatgactgacttaccagaaactgctgaaaatatcccatatgatacttttgcttttactccattcatgccgaaactaaatacagcaaatccagaagtgcaaaaatatttgctggatatcgcaacttattggataaaagaattcgatattgatggatggcgtcttgatgttgctaatgaagtcgatcatcatttttggaaaaaattcagagaagcagttacagaaatcaaaccagacatctatatccttggagagatttggcattcctctcaagcttggctgcaaggggatgaattccatgcagtgatgaattatgcattcacagattcgattaaagattattttgcaaaaaagaaaatcacagcttcacaaatggtcagtggaatgaatcatcagcaaatgctttacagagatcaggtgaacgaaggaacattcaacttattagattctcatgatactgccaggatcttgaccctttgccaaggtaacaaagaattgatgaagtctgtgatggcctttatgtttcttcaaaaagggtctccttgtatctattacgggacagaaatagggatgactggtgaagatgacccggattgccgcaaatgtatgatatgggagaaggaggaacaagatctagagctattcggttttataaaagaacttgtttctctaaggaaacagttgtctaagattatttctgaaggttctactcagtggctaatagtatatgatcgtgaagataagctctatttcacacgggaactagagggacagatcatctatgtttactataatcagtcaaaagaaccggggctaggagca

SEQ ID NO: 2583 - DNA (genomic), 1692 bp, Enterococcus faecium; double-stranded, circular; identical to SEQ ID NO: 2582
  misc_feature (B) LOCATION 1...1692
  hypothetical: NO
  anti-sense: NO

SEQ ID NO: 2584 - DNA (genomic), 1275 bp, Enterococcus faecium; double-stranded, circular
  misc_feature (B) LOCATION 1...1275
  hypothetical: NO
  anti-sense: NO
aatcaaaggagtaatcgtatgaacacgattgaaagaaattacgaacaagcaaaagaaaaatatgcaactatcggtgtagatacagatgctgtactagaaaagatacaggacatcaaaatttctatgcattgctggcaaggagatgatgtcaaaggtttcttgacaccggatggcgaattgaccggtggaatcatggcgacagggaattttccaggagccgcacgaacacctgaagagcttagacaagatctggagaaggcttattcgttgataccgggcaaacacaaattgaaccttcatgctatctatttggatacagaagaatctgtcgatctaaatgaaattgagccgaaacattttgaaaaatgggtagagtgggcaaaaaaagaagaaatcggtcttgacttcaatccgactttcttttcgcatccaatgatgaaagacggctttacattggctcatccagataaagaagttcgtgaatactggatcgaacacgggaaaagaagccgcaaaatcgcggagtactttgggaaagaaactgggcaaacaagtatcaataacttttgggtacctgatgggatgaaagataatccgattgatcgttttaccccacgggaacgtttaatggaatcactcgatgaaatttttacagaagagttagatgaacggtatgtacaagatgcagtagaaagcaaactatttggtttaggcgctgaagcttatacagtcggttcccatgaattttatatgggttacgggttgactcgtgacaaacttgtttgtctagatgctggacattttcatccaacagaagtgatttccaataaattatcttcattagctttattcagcaaaggaatcatgttgcatgtttcccgtccagtgcgttgggattcagaccatgtggttttgatggatgatgaattgcaggaaatcgctaaagaattagtccgtaacgaattgttggaaaaaacaaatatcggtctggatttctttgatgcaacgatcaaccgtatcgctgcttgggtcatcggtacgagaaatacacaaaaagcactgctgaaagctatgctggaaccagttgagcgattgaaagaaatggagctggcttttgactttacttcaagaatggcttatacggaagaattgaaagatttcccgtatgccgatgtatggaattatttctgttacaaaaatcaagttccagttggtttggattggctggaagaagtccaggaatatcaaaaagacgtgttggaattaagaaaatag

SEQ ID NO: 2585 - DNA (genomic), 873 bp, Enterococcus faecium; double-stranded, circular
  misc_feature (B) LOCATION 1...873
  hypothetical: NO
  anti-sense: NO
gaacaaaggaggaataagatgatttctggacaaaccaaattagctgggctctttgctgatccggcttctcacagtttatccccattgatgcacaatactgcttttgaagcaaacaacatcgatgcggtgtatttagctttccaagtaaatccaatgaatttgaagcaagcagtcgaaagtattcgaacttttgatatgttaggtgtaaatctttcgatgccgaataaaacagcggttattccttatctggatgaggtaagccaggaagcgcaattgatcggagcagtgaatacgatcgtgcacgaaaagggtcgtttgattggctataataccgatggtgcgggcttcatgcaatccgtgcaagaagctgggatttcgatcaaaaagaaaaaaatgactctactgggagctggaggtgcagcaaaggcagtcactgttcaagctgcgttagacggcgctgaggaaatcgtagtttataaacgaaacaaccaaacattcgctcaagtaaaagaaacattcgaacaactcagctatcgaacttcttgtaagataaaagttcgtgactttgccgatacgcatcaattaagaaaagacttgaaagaaagctgtcttctagtcaatgcaacagatatcgggatgggaaagaaaatcaatcagtcaccgctcttagatataagcatgatgcatgagaatctagcggtttttgatttgatttatgcacctagagaaacacgtttattaaaagaagcaaaaaaagtaggagcaaaaggatacaatggacttggcatgttgatctaccaaggagcaatcgcgtttgaattatggacaaaggaaaagatgccgatccatgtgattgaaaagctgtttgattaa

SEQ ID NO: 2586 - DNA (genomic), 243 bp, Enterococcus faecium; double-stranded, circular
  misc_feature (B) LOCATION 1...243
  hypothetical: NO
  anti-sense: NO
aataaaaggagattggttatggaaattttaatagcattagtccctatgttggcatggggtagtattggtttagtaagtggtaaaattggtggcgatgccaatcaacaaacactaggaatgacgatcggtgcatttctgttttctttagttgtctttttcgttgttagtcctgtaatcaccccttggattttcttgatcggatttttatccggcttagcttggagtgttggacaaaatggacag

SEQ ID NO: 2587 - DNA (genomic), 918 bp, Enterococcus faecium; double-stranded, circular
  misc_feature (B) LOCATION 1...918
  hypothetical: NO
  anti-sense: NO
ttaaaaaggagaacgtatatgccagaacataaatcagggtttgtcgcaatcgtcggccgcccgaatgtaggaaaatccacattattgaaccgaatcgtgggtcaaaaaattgccattatgagtgacaaggcacagacaactagaaataaaatccaaggagtatatactacaccagaagctcagctgatttttatcgatacaccaggaatccataaaccaaagcatcgtctaggagattttatggtagaagcagcttacagtgcgttgaaagaagtggatgcagtcttatttatgatcagtgctgatcaaaaacgcggccggggagacgattttattattgaacgtctaaaaaacgtgcattctccagtttatctgattatcaataaaatcgataagatccatccagacgagttgctgggaatcatcgaagattattcgacgcagatgccttttgcacaagtgattccgatctctgctacagaaggaaacaatgtcgaacgcttaatggatgtattagtcagtgaaatgccagagggcccacaatattttccagatgatcaagtgactgatcatcctgaatactttatcgtttctgaattgatccgtgagaaagtcttgtttttaacacgagacgaagtgcctcattctgtcgcagtcgttgttgattcgatgaagcgaaacgagaatgataaaatccatatccaggccacgatcatcgtcgaaagagatagccaaaaaggaatcattatcggcaaaggcggaaaaatgctgaagcaagtaggaacgaaagcaagaaaggatatcgaaaatcttttaggagacaaagtatttctagaactttgggtcaaagtccaaaaagactggcgagacaaaaaagtctatctgcaagactttggctaccgaaaagacgaatactga

SEQ ID NO: 2588 - DNA (genomic), 429 bp, Enterococcus faecium; double-stranded, circular
  misc_feature (B) LOCATION 1...429
  hypothetical: NO
  anti-sense: NO
ttaaaaaggagtgagaaaatgataaaagtatatacttcgcctagctgtacttcctgtagaaaagcaagagcatggttgcaagcgaatcaacttgaatttgaagagaagaatatttttgccgaaccgttaacagaaagtgagatcaaaaagatcttggcagcgactgaaggaggagttcaagatattatttccactcggtcgaaaatttacgaaaagctgggcatagattttaacgaattaactttaaagcaaatgatcgtcttattcaaagaatatccttcattattgagacgacctattttgattgatgaaaaaagaatactaatcggatttaatgaagatgagatccggtcatttgtccctcgtgaaattcgatgtgttgccagaaatctgatctatttacaaaacaataacatcttaaattcatag

SEQ ID NO: 2589 - DNA (genomic), 1440 bp, Enterococcus faecium; double-stranded, circular
  misc_feature (B) LOCATION 1...1440
  hypothetical: NO
  anti-sense: NO
agaaaaaggaggaaaacaaccatgaaaatcgttggtgtaactgcttgtccaactggaattgctcatacttatatgtcggcagaaaaattagaagtaacagcaagaaatctaaaccatcaagcaaaattcgaaacacaaggtgtaaaaacagaaaatcagttatctgaacaagaaatcaaagaggcagatgcaatcattcttgcagtagataaagaaatcgaattggaccgatttgccgggaaaaaagtaaagcgtgtctctacaagccgagcaatcaaagaaccgcaagtagtaatagacgaagcattgagagatattggcgtattcgttgtgtctaatgaaaaagaaccagctgcaaatgagaaaaagccgacaatctataatcatttcatgaatggtgtgaattacatgcttccatttgtgatcgcaggcggaatcatcatcgcactgagttttgcctttgggattacagcggctgatcccaactcagcagactataatgtgttagcagctgcattttcaaggatcggaggagatacagcgtttgccatgatggttcctgcgttaggcgcggggattgctacatcgattgctggaaaagcaggttttgccccaggaattgttgccggattactggcctctacaggtggttcaggttttcttggcggaatgattggtggcgtgctagcagggtatatctgtgattttctggcaaataaaatcagcgtaaaaaaagaattttctgctatttatcagctgattgtcgtcccccttttatcgatcttaattattgggcttttgatggtatttgtgattgaacaaccgatcacatgggtgttggatgctttgacaaattggctgaatagcttgggaaatacatccgggctattgttcggattacttatcgggatcatgatggcagctgatatgggtgggccgatcaataaatcgatttcgactttctcgatcggtttgatgtcagctggagtaaatgcaccgattgctgcttgtatggctgcaggaatgacacctcccctaggtattgctttagccactttattattcaaacataaatttactaaagaagaacggacttcaggtcaatcatgctggattttaggcgcttcgtatattacagaaggtgctataccgtttgcggtatctgacccgattcgcgtgatacctagtttgatgacaggttcagcagtcgctgcagggatttccatggcagcaggagtaacttcaatggcacctcatggaggaatttgggtgatgctaattccaaatgtcatgaacaatttacctatgtatgtcttggcaattgcagcaggtacagtcactacagcctttatgcttggactattgaaaaaaacagtgaaagagaaaaaacaagacaagtggacgaaaaatgaaaatctaacaaatgaggtggaagcgtaa

SEQ ID NO: 2590 - DNA (genomic), 729 bp, Enterococcus faecium; double-stranded, circular
  misc_feature (B) LOCATION 1...729
  hypothetical: NO
  anti-sense: NO
acgaaaaggagtgaaacgaaaatgtatggttatggaatgtatggttttttagatccgacatttcttttggtcattcttggattagttatttccggaattgcgtcagcgtacgtcaatagtactttccgaaaatacgatcaagtgagaagcaaaaacaatgtgactggtacacaagcagcacaatatatattacaaagtcaacagataaataatgtcggtgttcaacaaattgccggagatctcacagataactacaattcaggtaataagatgttgagtttgtctcaagcaactgcacagtctacttcagttgctgcgataggtgtagcagctcatgaatgcggacatgcggtacaagatgcttcgggttatgtcccattgaagattcgtgcagcacttgttccagcagctaactttggttcgatgatttcgttccccttgattatggtaggtgtattgcttagctggaactctacgttaatcaatatcgggattttcgctttttctttagcattacttttccaattggtgacattaccagtcgaatttaacgcgtctcggcgagcaatccaaattttgagtgaaggcggactactgacggaagaagaagtaccgatggcaagacacgtattatttgcagcagcactgacttatgttgcagcagcgctttcgacattcctgcagctgttgcgcttgatcttattgttcggcggcaaccgaagagattaa

SEQ ID NO: 2591 - DNA (genomic), 240 bp, Enterococcus faecium; double-stranded, circular
  misc_feature (B) LOCATION 1...240
  hypothetical: NO
  anti-sense: NO
caaagaaggagaaaaaagatgacatttgaagaaattttaccagaattgaaaaaaggtgcaaagattattcgtaaaggatggagtggatttgaactttatgttgttctcgtatccgatgatgaatttgatggctgtccggtgacgccgtacttattgatcaaaacaagtgacgaaggtttttccagcttcgctcctacagtttgtgatattttagcagatgattgggcgatcgtagaatga

SEQ ID NO: 2592 - DNA (genomic), 933 bp, Enterococcus faecium; double-stranded, circular
  misc_feature (B) LOCATION 1...933
  hypothetical: NO
  anti-sense: NO
gtacagaggaggcaagaaaatttgaagcgtttatctatccgaaagaaaaaagaagcaagatgggcctatttatttatctcgccttttattatcgggttcttggtatttatgctagggcctatgcttttttcagttattggtagtttcaccgattataatttgacatccaagatgaatttcattggtctagcaaatttcaaaagaatgttcgttcacgatgatttattttggaaatcgttatacaacaccgtttatttcgtcatcttcaatgtaccgctgacgacgattttcagtgtgtttttagccacagtactcaatcaaaaaatcaaaggaatcagtgtattccgtacagctttctatttaccggcagtcttatcaggagtagcagtctacatcttatggatgcagctgctttctccatctgcaggattgatcaacacatttctgggctggttccatatccctggaccagcttggctgtttgatccacaatggacgaaacctgcgttgattttgatgaaaatatggagttctggaggagcaatgctactttacttagctacattacaaaatgttcctagatctttatatgaatcagcagaaatcgatggagcaggcgtttggggaaagttcaaaagtattactttgccattaatcactcctattattttttacgatgtgatcacctctacgatcggttctttccaaatttttcaagaagcttatgtcatgacgaaaaatggaacaggcggacctgcaaattctttgcttttttataatctgcatatgtggaacaaggcgttcgtagcttttgatatgggttatgcgatggctatgtcaatgatcctgtttctgatcgtgttggttctgacgtttgtcaatttgaagcttgcacctaagtgggtctattattctggaggtgacggcaaatga

SEQ ID NO: 2593 - DNA (genomic), 312 bp, Enterococcus faecium; double-stranded, circular
  misc_feature (B) LOCATION 1...312
  hypothetical: NO
  anti-sense: NO
ctaaagaggagttggcaacagaaattggcttatgaaatcgttccttcaaaacatgtcattaagtatttaaaaaagctaaaagagaagccattgaaagaaaaatttttgaatttaatttatgatgaaattgcgattgatccatataagggtgaacaaaaaactggggatttatcagttatttggtctagtgggtttaaatatgcgggcacaacatatagagtagcttacgagattatagaaaacaaggttattccagtattgttatgtggaacgcatgaaaaattttatgaacagttgaaaaaattaatctag

SEQ ID NO: 2594 - DNA (genomic), 2154 bp, Enterococcus faecium; double-stranded, circular
  misc_feature (B) LOCATION 1...2154
  hypothetical: NO
  anti-sense: NO
aaaaagaggagaatgtgtatggtcaacacacaaaaacagttagaagaagcatatctgaagaacgtgtatcaaaagctaattgataaaaaaaacgaactgcgggaatcgatggatacggcaaaaatagaaggaaaccagtcgttgaaagaaatggctggcgagcttcgattgaattttgacagttacttagataacctggatactttttcgatgattgaaatgaaaaatagagaaatcgatcagatgaatatcaaacagaaaaacgcagaaaatcagctagcaaagatcgaacgtttattgaaaagtccctactttggaaaagtcgttgtagactttctggataatgagccaaaagaatccttttatatcggtacagcaaatttcacagatgatgcagatgaaaatcttgtttatgattggcgttcaccaattgccgaacttttttacaataacatgattggtccatcttcttatacggttcgtcaaaataaaatcgatacggttattaaagaaagacgacaatttcttttggaaagagatcgtttggtcaagttttttgatacgtctgtagctattcaagatgacgtattattagaagtcttaggccaagatgagaccaatgaaatgaaggctatcactgctacgatccaatcggaacaaaacacaatcattcgggatgtgaaaagtcaaaatatcttggtaaatggcgtagcaggaagtggtaaaacctctgctatcatgcagcgtattgcgtatctgctctatttatatcgagatacgatgacatccgatgacttgctgattctatcacctaatcatcggtttatcgactatatttcgaatgtcctaccatcattaggtgaaagaaatccactgaatctaaccatcatacagctggtttcacagctttcagcagaggaaatagaaggtgaagaggcttatttcaaacgtatcacgggagaaaatgtatcggagcagacagaacgtttgcgtagcaaaaagtttatcgataatctaaaacaatcagatcctttgtttttagatcatccgaattttatccgtggacttactaaaaatggaaaaacagtcctttctaaaaaaacgatcgaaaaaatatatgagaaagttcctgctcatcctaaattgatcgataggcttcaagcaacgaaaaaggcactgatgagcgaatggaagaatcatcttttgaaacaagcaaaaagtcctgctgtgcagaatcaggtactctcgttgacagaagataggcagttggaattattcggtaaattgatttctgatgattcggaacaaagtattgtagcttatgcaaggaaacttttacaaaaaaaatatcgaaaaataaccagacaaatcgaagaaatggcatgggtggatgagcatcagttgtttgaaagaatttatgaaaaacgatatggctcagcttatgcttggcaacccacacgtactgttgatgaagcagtcattatattagctattcgtcatttacttgttgaaaaggtaaatgtaccagcatttcgctatctattgattgatgaagtacaagattataccctggcacaattaggtctattgatcgaattatttccaaaaactcactttactttagtaggtgacgagaatcaggcaatctttaattcttccactacttttgctgatattatgcgttgtttcgacgactaccatctgccgatccatcggtatgatcttagaaatagttaccgttctagcggagcaatcacagagcttttcaaaacctatgctgtggatcaagagaagatcgacatcgtatcgatccgaccgcaaggaaaagaacccgaataccgctcttttcgatcctctgaagaattgttgaaaatactagctgagattttggtttctctaaaaggagaaaaagcggcagttatcacccaaacagaagaggaaacccaaacgctacaagaatcgattaaaaaaaattcatatggattagaaaactgccaaatcattcctttgagtctagcaaaaggactggaatttgatcatgtaatcttatatccatttgaaaacgatggagatgagcaaagaagacgcagacaaatgtacacggcgatatctagaggaatgaaaagcattgtcgtattggaaagagcaacataa

SEQ ID NO: 2595 - DNA (genomic), 1047 bp, Enterococcus faecium; double-stranded, circular
  misc_feature (B) LOCATION 1...1047
  hypothetical: NO
  anti-sense: NO
gtcgagaggaggaaggaaatgaaaacatatgatgcaatcatcatcggttcaggtgtgagcggcttaagtgctgcttatggattgaaagaagcaggtaaaacagtactagtggtcgaagaagatctatggggcgggacttgtcctaaccgtggatgtgatcctaaaaaagtcttgttaagtgcagtagaggcacgtaatcgggtaaaacaattgagtggaaaaggttttaacgagatcccaactgccaactgggaagaacttcaaaaattcaaacgaacatttacggatccagtcccagaaagccgaaaaaaacaattagcagaagctgaaatcgatcatctttcaggaaccgctcgttttttggatgattcatctattgaagtcaacgaagaagtcttccatgcggattacttagttttggcaaccgggcaaagacctacgatcttaccagtggagggaaaggaatacttgaaaactagtgcagactttttatcattgcctgtactgcgtaaagaaatcatttttatcggtggtggttatattgcttttgagctagctacgattgccaatgctgcagggagcaaagtaaccattgtccatcataatcaacggccattaaaagaatttgaggcgtctttggtagaggaagccgtccatcaaatggaagcatctggcattcagtttgcttttggtgttgaaacccaaaagatcatttcagaaggtactcgctatcgtttagtcggaaaagagacggaattagtagcagatatgattttttgtgcgactgggagacagccgaatacagaatctttagcacttgagcaagcgaatatcgtctttgataaacacggaattgcagtcaatgattatctgcaaacgagcaatccaaaaatttttgcgtgtggagatattgtttcaaggaaaaccccaaaattgacaccagtcgccacttttgaaggaaattatgtagctaagcggataacggatgcaacaagcgaacctatcaaatatccgattatacctacgatgcgtctacgccagtcctaa

SEQ ID NO: 2596 - DNA (genomic), 654 bp, Enterococcus faecium; double-stranded, circular
  misc_feature (B) LOCATION 1...654
  hypothetical: NO
  anti-sense: NO
aataggaggagaatcatggagacaacagaagaacaagcaaaagtattagaagcaaagcggcaaaagagcttttggtttgcagactggtcttttccgctaatcgtaggaattatgtccgctgctgtatttgcaggaacacacatgtatgtgatgtatggtgtgggtgcattcaatgaagtttcgatcgtggcgatgttaaaagccgggctggatggcggatcctatggcgcagcggcagcgtttggtgctagtttcttatttgccagaattttagaaggctctttagttgggatcttggacttaggcggttcgatcctaactgggatcggaattggggtaccagcaattctcttaagtatgaaaatagcggcaccaatcgataattttgcactctctttattgactggtttggttctaggtttgattgttggtggcatcattgtcttgattcgtaaatttacgatcaatcaatcaaattccacttttggtgctgacgtcatgatgggggcaggaaattcatctggacgttttttgggtccattaattatattaagcgcgtgtgcagcatctattccaatcggcattggcgctacattaggagcactaggattctatgcttggaaaaaaccaattgctggaggtgctattttatga

SEQ ID NO: 2597 - DNA (genomic), 867 bp, Enterococcus faecium; double-stranded, circular
  misc_feature (B) LOCATION 1...867
  hypothetical: NO
  anti-sense: NO
aaaaggaggagaggtttattggcaaataattatcaagcagcaacggaattacaaaagtcgggatggtcaatttatcccttatctcctggaactaaaattccaataaaaggctctagtggttggaatgatgcaactaacgattctaatcaaattaatgaatggtggacggaagatgcaactagaaatattgggttaatgcttgaagatcatcaaatggtggtagttgacctagatcaacattctgaaacacgaaacggcgttgagaattataaaaaacttgcttcaatgtatgatccatttccttctacttatacggaaatcacaccaggtaaaggaatccatttcttctttaaaattcctgatggtgtaattatccaacaagaaacaggtgcatttgctgatatcttcgggcgtgatgataaaggtaaaagtttaagcgggattgatattatcactaaaggagttccaatagcgccaactatgattatttcaagaagtgttgggagagcatatgaacctattgaaaacgtatctctaaataatattgcaccagctcccgattggctagtgaacctactgctaaaaaaaccgcaagaaataaagactcaataccgacccgtagcaaaaacagggacagcaaaaaaattagatatgattgttcaaggcgctggcgaaggtagtagaaacgatcatttaactaagttatgcggttggttactatggcacggtgtagataatcaaactttagcagaattgatttatacagcaaatgcgtacaatgaaccaccgctaaaagataaagaagtgaatcaaattattcgatcgatgattaaaaaagatttgagggggaaagctcatggctcataa

SEQ ID NO: 2598 - DNA (genomic), 888 bp, Enterococcus faecium; double-stranded, circular
  misc_feature (B) LOCATION 1...888
  hypothetical: NO
  anti-sense: NO
caagttgggagtgtttacatggattactgggaaaaagccaaccactcatggtcggaagactcaaaaagagtgatcttgacgcctacacaaagaagcaggaatttatttttttatatccaagaaatcggttacttcaaagcaccaatcccttactatactgaacgagcacatttaccttcttacttgataaagtttactttgtctggcaaaggttcgcttacatataatgataatcagcaacagctaaaagctggagacttattttttattgactgccaagaatatcagcgttatcaaacgatcagcgaagaaccatgggaaatggattggatccatttgaatggtcagaacgtccaatcattttatcaggagttcacaaaagacggccataacaccttccattcaacaggggatccatcagaaaacaagatccaccatttgatcacagaattgatccacatgcaacaaggcacgaatgcccgtaccgatttccagtcctctgtagctatccacgagttgctgaatgaactgattttgcaaaagtatcagctagatttcgaagaagaggatattcccgcctacgtttacaaactgaagcaatacttagacgaacatttcaaagaaacgattacacttgatcaattagaacaacaattcttattgaataaatatcagctgagcaaagatttttccaaatttatcggttctccaccaatcgattatttgatcagcaaaaaactttcttacgctaaagaccttcttcggtatacagaatttacggttcgaatgatttccgaagaaatagggattgagaattttgcttactttagccgcctgttcaaagcaaaaacaggactatcgccgagagactttcgtaaattcagctga

SEQ ID NO: 2599 - DNA (genomic), 1227 bp, Enterococcus faecium; double-stranded, circular
  misc_feature (B) LOCATION 1...1227
  hypothetical: NO
  anti-sense: NO
cgcttagggagggcaactatgaacaaaaagaacaacggcatgatgaaaaatgccttgtattatgtcctcgtaatcttagcgatggtaatggtcgtttatttcatttttggtaataacggccagcgatcgtcagatatcgagtactcaaaattcacagaacaactacaagcaggcaagatcaaagaatttgaagtgcagcctgcaaatggtgtatataagatcactggtgaatacaaagaacagcagaccgtcgctaacagcggtgggttagctatcttaggttcaacagatacgactactacccatttcacaacaatcattttgccaaatgatacaacattgagccaagtaacagaactggcaaaagaaaacaaagttgctacaacagtaaaagaagaatcaagcagcggtatatgggtttccctattgcttagcttcttgccaatcgtaatcatcatctttttcttttacatgatgatgggacaacaaggcggcggcggtggcggtggcggccgtgtcatgaactttggtaaatcaaaagccaaagaagcagacaaaaaagctaatcgcgtacgtttttctgatgtagcgggtgcggaagaagaaaaacaagaactagttgaagttgttgaatttctgaaagatcctcgccgatttgttgaattaggtgcccgtatcccggcaggtgtacttttagaaggacctccaggaacaggtaaaaccttattagcaaaagctgttgccggagaagctggagtaccgttttactcgatctcgggttctgatttcgtagaaatgtttgtcggtgttggagcaagtcgtgttcgtgatttgtttgaaacagcgaagaaaaacgcaccagctatcattttcattgatgaaattgatgcggtaggtcgtcaacgtggtgccggtatgggcggcggacatgatgaacgcgaacaaacattgaaccaattgcttgtagaaatggatggcttcgacggaaatgaaggagtaatcgtcattgctgcaaccaaccgttctgatgtactagacccagcgttactacgtccaggccgttttgaccgccagattttagttggacgtccagatgtaaaaggtcgtgaagcaatcttgcgagtccatgcacggaataaaccgatggcagatgacgttgacttgaaagttgtggctcaacagacaccaagtttttgccggagcagatttagaaaatgtcttgaatga

SEQ ID NO: 2600 - DNA (genomic), 1329 bp, Enterococcus faecium; double-stranded, circular
  misc_feature (B) LOCATION 1...1329
  hypothetical: NO
  anti-sense: NO
aagatagggagaaacgtattgcggacaaaaaaagggattatcaatgctttgaactttaaaacaaacgacactcaacaagatgatacaataatactgcaaaaagcaatcgatcaaggtgcgaaagaacacttacctgtatttattccaaaaggcatttatttagtcggagccctttttttaaaagataagagtcatcttatctttgaagaaggtgcagtcctcaaggggagaacagatatcgaagcatttccagaaatcgatacacgagtagccggcgtagaaatgaaatggccagcagcgattttgaatgttctctcggcgaaagatattcttatagaaggaaaaggaataatcgacggtcaaggagaccattggtgggagctgtattggggaaaagatcaaaaaagcgggacaagagctgaatacgatcaaaagggacttcgttggattgcggattatgctattaaacgtccacgcgcttgtttactgtatcatgcagaacatgttgttgttcgtgatttgatttttcagaaatcaggtttttggaacttgcaaatcacttattctaacgatgtattagtagaaaaagtaatcatccgcaacaatgatggaccaagtacagatgggattgatattgattcttcaacaaatgtgcgtgtctatgaatgtgatttggcctgtggtgatgattgtattgctattaagtctggcagagatggcaatggtgcaagagtcaatcgaaaatcatcaagaatcgaggttgctagatgtaaaatccgttcaggatacggtgtaactattggtagcgaagttagtgctggagttagtgacgtatatattcacgatatcgatttttttcagtcagactgtggtattcgaatgaaatcttcaaaagaaagagggggagtgatcgaaaatatcagggtagaaaatctgaatatgattgatgtacaatttcctttttcttggataatggactggcataatgaatacaatagaaaaaatagcaatgaccttgctcaaatgccagaaagttggcaagcagtggctgaagaaatacctgaatcaaagcaaatgacgaaagtcaaagacatacacatcaaaaacgtacaggcatgcctttctccaggttactcacttccttcccgagcttttgatttagtagcatttcctgaaaagcctatagaagatgtctgcttttctcattgccaaataactgcaaaagaattcgggcgaatcgaagcagtacaaaacttatgtttcaaaagctgtgatttatctatagaaactggcaacacagctgcaaacaatacttttgacaatcgttga

SEQ ID NO: 2601 - DNA (genomic), 498 bp, Enterococcus faecium; double-stranded, circular
  misc_feature (B) LOCATION 1...498
  hypothetical: NO
  anti-sense: NO
aataaagggagtgaatcaatgatgagtcaaacaaaagtcgaacgttatttagaagaacaaaagatcagctatcaaccacttgattttagtcatgtggtagaagaatctttcacagaagaactacaaaaaagagggattgatccagctttgatatgtaaaactctcgtagtgaaaggaaacaaaactggggtgatcatcgcattgattcctttgaacgatcacttagattacaaaaaaacgagacaagtgacgaaagatcgtaaagttggttttcctggaatggattttgtattaatgcatacaggatatccccacggagcaaacacccctattggaataaaactcgcacatcctgattattgttttttagcagacagttctttaaaagaaaaagaagaagtaattgtgtcaagcggtgaaatcgggagaagccttcggataaaagtagccgatttagaaaagatcgtccatcctatttacgctgatttaattagttaa

SEQ ID NO: 2602 - DNA (genomic), 417 bp, Enterococcus faecium; double-stranded, circular
  misc_feature (B) LOCATION 1...417
  hypothetical: NO
  anti-sense: NO
agtagggggagtcaaatgggattttttgataaaatcaagcgtgcttttactggcgaagagaaaacagaagaagttgaagtacaggagaagtacgacaagggtttagaaaagacgcgtaaaacatttggtgaacggatgaatgagttgtttgccaattttcgaacagtcgatgaagacttttttgaagaattagaagaaacacttatcggtgcagatgtaggttttgaaacagcgatacgaatcaccgaagcattacgtcaagaagtgaaactcagaaatgcgaaaaaatcggcagaagtccaaaatgcgatcatcgagaaacttgtggatctctatgaagcggaaggaatcaatgaagtaaatgaactaaatatccaaggaagacggactaacagttattttgtttgtcggtgttaa

SEQ ID NO: 2603 - DNA (genomic), 216 bp, Enterococcus faecium; double-stranded, circular
  misc_feature (B) LOCATION 1...216
  hypothetical: NO
  anti-sense: NO
ccgtccatttttataaaaaatggaacaggtgcttcagataaaagtggcaagagcgagatggaaaattatcttgctcttgttgccattatcttaaaagcagtttgcggtttagcaagtttagagggggcattcagatgcagcaagataaaacaagcaatatcaacgaaaaaaaaatcacgctttgttcacttattccagggatggggcagtttgtaa

SEQ ID NO: 2604 - DNA (genomic), 372 bp, Enterococcus faecium; double-stranded, circular
  misc_feature (B) LOCATION 1...372
  hypothetical: NO
  anti-sense: NO
aattcttttggtgtttatttaggagagcctagctcggaacagttaaataaaggtgaagctcgtcatgctctatgtcgaaatatattttatggtagaaaaggcaaactttatcaaacttattacgacggtatggaggaacagctcaacgcattaggattagtaactaatgctatcatatattggaattcactatatttagaaaaagtctttgaacaaattaaaacggaagggttcgactgttccgaagaagtgttacgcaagcaatttccattaattagtgatcacattaattttgttggcaaatatagtttccgctatgaaaaagaattatcgaatggaatactacgtccgttaaatatagagaattattga

SEQ ID NO: 2605 - DNA (genomic), 354 bp, Enterococcus faecium; double-stranded, circular
  misc_feature (B) LOCATION 1...354
  hypothetical: NO
  anti-sense: NO
gatagttttggagggaaaaagatggataaaaagcgttctttatacagtatgcagcaggaagtggatgaatatatccagcaattcaaggtggggtatttctctccattagctcagatggctcgattaactgaagaagtaggtgaattggcaagagaagtcaaccacacttatggagaaaaaagcaaaaaggcttctgaaccagttaactcggtagcagaagaacttggtgatgttttattcgttacgatgatcatggctaattcattgaatatcgacttaactgaagtttttgaaaaaaacatggaaaaattcaatcaaagagaccataatcgctttgagcgtaaggacgagtaa

SEQ ID NO: 2606 - DNA (genomic), 270 bp, Enterococcus faecium; double-stranded, circular
  misc_feature (B) LOCATION 1...270
  hypothetical: NO
  anti-sense: NO
aacaaatttgggacaagcaagacttgtcaacagtcaattctggtactttctctttcagtgctttttcataagcttgattttttacccgtacaatcctaccgaataatcccaacttgtttattttgtgttttttttactgccgctctagtaccgggaaggatcacaccgatgactggaatagaaagagcagctttgatttcttctaaagccaccgcagttgcggtattgcaggcgatcaccagcatcttgattccttgctccaccagataa

SEQ ID NO: 2607 - DNA (genomic), 1143 bp, Enterococcus faecium; double-stranded, circular
  misc_feature (B) LOCATION 1...1143
  hypothetical: NO
  anti-sense: NO
aaactgtttggggagtgggctataaagttgaataaaacaggtgatgccaaaaattcttcacgtttaaaaaaacgcttgctgaaacgattagctacacaattaagtatttttactgtagcaacaatcagtgcttttatgatgtttttttttgttagtcgctttttattcgggctctatacgtgggaatggtcggatagattctatcaatttgcgaaaaacctagaaagaaattatatttttgtcgttttgattgcgttactagctggaggattggttattttacttagaacatggtcaagaagtatggcacagttggatgaagtacttgaagcttcaaggaaactttatcaaaatcaaatagaacctctcaaactttctgaagatctacaggagtttgaatgggaattgaatcaaattcgtcaggaagtagttttgagtcagcatcaagccaaagaagcggagcaacgaaaaaacgacttaatcgtttatttagctcatgacttgaagacgcctttgacttcagtgataggctatcttacactgttacgagatgaacaggaaatttcttctgaactaagaaaacattatctatcaatttccttagataaggcagaaagactagaagaactgatcaacgagttctttgaaattgctcggttcaatttatcaaatatcgaattgatgccgacaaaagtccatctgaagatgatgttagaacagctaagttatgaatttttgcctcttttgtcttccaagcagctgactctagaaagtgagttagaagctgatctttcgattcgttttgatgtcgataaaatgcagcgcgtttttgataatctcttacaaaacgcaatcaactacagctatgaaggagcagtgatcaaactctcggcaaaaacagatcaagacaagaaacgggttaagattattttctctaatcaaggtccaactattccacctgaaaaactatctaggatttttgaacaatttttccgattagacaccgcacgacaaacaaatcgaggaggagctggactgggattagcaattgccaaacaaatcattgaacttcatgctggccaattgactgcacaaagtaaagatgaagagacaagcttcacaattgatttgccgctttcgtag

SEQ ID NO: 2608 - DNA (genomic), 957 bp, Enterococcus faecium; double-stranded, circular
  misc_feature (B) LOCATION 1...957
  hypothetical: NO
  anti-sense: NO
actgagtttggaaaaatctcttcgaccacagctgctttctcaatatatcggacagagaaaagtcaaacaagaacttcagatttacatcgaagctgccagaaatcgggaagaactttagatcatgttctgttgtacgggcctcctggattaggaaaaacgacgatggccatggtcattgctaatgagatgaccgtaaatattcgtacgacgagtggccctgctatcgaacgtccgggtgacttagtagcaatcttgaatgaactggaagcaggggatgtcctgtttatcgatgagatccatcgattacctagagtggtagaagagatgctttattcagctatggaagatttctatgtagatatcatggtaggacaagggccaaccgcacatccggttcatttccctcttcctccctttactttgattggcgcgacgacacgggcaggtatgctttctgcacctttacgagatcgatttggcatcatttctcatatggaatattatgacgaacaggatctgcaggagatcgttttacgttcttcggatatttttcaaacagagatcattgaagaaggggcattggaaattgctcgccgatcacgaggaacgcctagaatcgctaatcgcttgctcaaacgggttcgtgattttgcgcaagtccaaggagacgggaaaatcgatcgtcctatagcggatcaggcacttactttgctacaggtcgatcaggctggattggattatgttgaccagaaattgttgcgaacaatgatcgagttatatggcggcggaccagtagggttaagtacgctttcagtaaacataggagaagagcgtgagacggtagaagatatgtatgaaccgtatctgatccaaaaaggatttttaaagcgtacacctagagggcgaattgctactgcttatgcctatgaacattttggttacgactatcatatatga

SEQ ID NO: 2609 - DNA (genomic), 972 bp, Enterococcus faecium; double-stranded, circular
  misc_feature (B) LOCATION 1...972
  hypothetical: NO
  anti-sense: NO
aaacttcttggtacaatacagaaagaatcaaattttagaaaagaggattttatgttttcattattagcaactgccggtacgacagactcttctggcgagacattgacagatcaagctgtcagcaaagtaaatgcgtttcagcggttttgggacgggattgattgggacgccattttggctgcctttatccaaaaaagtttatatctgatttttttgatcgtccttttttggattcttcaccgtgtgggaaaatatctgattgataagtcttttaatcagtattctaaaaaagccattctaaacgagagccgcttaaagactttacatagtcttttaaatactatttttcattatacccttggtttcttttttatctatgcaattttatctgctatcggtgtgccgatcggatcacttttggctggtgccggaattgcaggtgtggcaatcggtcttggtgcccaagggttcatgagtgatgttattaccggattttttattatcatggaacaacagatggatgttggggactacatcaagctagcaaacttaacgattgaaggaaccgtcgtatctgttggtatccgtacccttcagctgaaagcaacggatggtactgtccatttcatcccgaatcgaaacatcaccacgatcagcaatctctctcgtgcaaatatgcaagtacttttagatattcggattgttcctgaagaaggatatgacaaaatctatgagatcattgatcgagtaaatcgtacattagctgaaaaataccaagaagagctccaaactgaaccttctatctttggattagtggatcttggaaacagcaattttgcgattcgtacggtctgctacgcattgaacggaaaacaatatgccttaaaagaagagttcttgagctcctatgtcaaagaattgacagcttctggtttcacgattccgaacagtccaattgctgtcggaaaataa

SEQ ID NO: 2610 - DNA (genomic), 498 bp, Enterococcus faecium; double-stranded, circular
  misc_feature (B) LOCATION 1...498
  hypothetical: NO
  anti-sense: NO
acgaatcttggagatcggagcagctatcggtttttcatcaagtgtcatggccacgacaatcggagaaaaacgctcatgttacgacaattgatcgttttcgatgtcatgatcgagaaagctaaaaaaaactatgaacgtctaggactgacagataaagtgactttgcttgaaggtcaagcagcagatatcttgccggagttgtctggtccgtatgactttatttttatggatagtgcaaaatcaaaatatattgaatttttacctgaatgcttacgtttgttaagaaaaggtggcgttttgatggtagatgacatcttccaaggaggaacgatcttgctcccagatgaagagattccccgtggcaaacgagctatccatcgtaaattaaatgaatttcttcgtgttgtgatggatcatcccgatttgacatcgacaatcttgccattaggtgatggtgtgatcttaatgacaaaggaatcagaaacaatcgagttgtga

SEQ ID NO: 2611 - DNA (genomic), 186 bp, Enterococcus faecium; double-stranded, circular
  misc_feature (B) LOCATION 1...186
  hypothetical: NO
  anti-sense: NO
gctggccttggtgaagaccagcatcctatcgacgggatgttggcgcccgatgtcggctcgtcgcatcctggggctgtagtcggtcccaagggttgggctgttcgcccattaaagcggcacgcgagctgggttcagaacgtcgtgagacagttcggtccctatccgtcgcgggcgttggaaatttga

SEQ ID NO: 2612 - DNA (genomic), 1203 bp, Enterococcus faecium; double-stranded, circular
  misc_feature (B) LOCATION 1...1203
  hypothetical: NO
  anti-sense: NO
gaaatgcttggatggaaagaggggtgcgttatgacgctttataaaacgatttggacattgcttaaagcaaataaatcgaatttactgataggtgtaattatcactgttgttgccacattcttttttgcgcaaaatattgatgttgaaaatacctctctgcaagatgcgaaaatcgccttgattagtgaagaagagtcgcctgtagtcgatggccttcgtaaatatttgaatgacaaggaaacagtcgttacattggatggaacctcacaaaaagaaatcgatgatgctctttattttaatcgtgtaaacattatcttacatctgcctgcagactttaccgaacaagtcgaagtaggaaagatggcgacgatcaagatacagagtcgcccagatgccttttctaaaacagttgttacacagcaagtgaacacctttttgcaaacactgattctgtttcaagaagaagataaaacaatcgatgcagctatggaacagacacaaatggcactctcggttactggagaagttgagctaagtgcgggatatagtcagcggatgaaaaagctgttgacgggcacaacctttaatttcttgtcttatgggttgtttctatccatttttagcggtttcagcgtcatcaatctagcgtttaatcgcaaagagatcagtaaacgaaaccagagtgcgcccattaccaaacgaaacttgaatcgcaaagtaacctttagtttgattagttactcgctgctgttgttcagtggcttcttacttctaatggttctgttagtgatccacacctcgtgggatataacggtatggtatcatattttaaatactttcttgtttttattgccgatcattagcttttcggcttgtatcacttcattggtaaaaaactcagaaaccagcggtgggatcaaagatatttttatcacaggcagttgctttatcggtggggtgtttgtaccagcagaatacttgccagaaatggttagcaaaatagcggcattcacaccaacatattggtttgttcaaaataataacttgatcagtgaaacactcagttacaatcaaacatttgcagaatctttttggttcaatggttgtgtcttagttgcttttgctgcggtgttttcaatgatccaatttattttgggtaaagaaagaaactatcgatggcaacccaattgggcaaagaattaa

SEQ ID NO: 2613 - DNA (genomic), 579 bp, Enterococcus faecium; double-stranded, circular
  misc_feature (B) LOCATION 1...579
  hypothetical: NO
  anti-sense: NO
cgagttattggaggaacagcgatgaataaacaggaagcaatcaaaaagttagaaagtattaaagcgataggaaatgatgcaatagctgcttgctataacgagagtataaattcaggtattacgttaatgaaaaaaatagacgaaccgcagaaaccagttattccacaactcgtggccggttggcttgagaaatctacggacccttttacaaaagctgaaaaaatagcgtatttaatcaaatctaaagatggtgattcatattatttctgtgattggtttgtacgagatggcatagtgacgcaagagcaaggagaagaattactcgcttgggcaacaagacaatcatatgaaacactattgagcctatacaacggctacgaggttgagaaagagccgttatgggcaataaagaatgccgatggaaactatcttactaaatgtgctttatggggaaaagatggagtaaattatagttttgaatgcaatccatctcatcgattgcttttcactgataaagcaacagcggatgctgcagcattgttggtgaatggaacagtggaagaggtggtagaaagatga

SEQ ID NO: 2614 - DNA (genomic), 717 bp, Enterococcus faecium; double-stranded, circular
  misc_feature (B) LOCATION 1...717
  hypothetical: NO
  anti-sense: NO
cgagttattggaggaacagcgatgaataaacaagaattgattgatgaattagctaaatatgtaaagagttatgagaacgttatggatgagcatggtcaaggaaggtacggcgcttatgaagtatctttaaagttggtgaaaagactaaatgaatcaaaaattacagacgaacaagcttggaataaggtagctgaggcttatcctgaatcggcacaaagcttgagaaacactttagataatgctgtatttggtaagactggtgaaccgcagaaacacgttatgccgaagttttttgacaaatgggcaaaacaagtcctggaaaaacgtgacaagttttatgctatctctcttattacacgcgcgggctgggggtatggtgttgattatgaactcgataatggcagatcgccatcaggaacaaaagagctgttgaactggattgttgagaatgaaggtgatgattatcctaataaaaagaaagcaacagaagctttgttatacggctacgaggtcgaggaagagccattgtattatgtgaagttaccagttgtgtattttaatcatttggatttagagacgtatctaatgaaagatgatcgaggaaatataacaattgcagacaacaatgattttgatgatatgaaatttacggaatcagaaataaaagcaattgatgaaagatactggccatttgctgtgccagtcgagaaagtgtag

SEQ ID NO: 2615 - DNA (genomic), 1059 bp, Enterococcus faecium; double-stranded, circular
  misc_feature (B) LOCATION 1...1059
  hypothetical: NO
  anti-sense: NO
aatcctattgggctttttcgactggaggtagaaatcatcaaaatgtacaaaggacatcgcatacgcgcaggagatcaacacttgatttatcactttgttcttggctggctaagtgccttattcatcggttggatgggcgtcttttattttccagagcttagacaatttggtctttctaaggtatcattttccactattgaaatcgcttggtccatgaaagatttagtatgtctgcttggaagtctcgctctttcaggaagtatgatgttgctttatattcatttttttcctgatcattggcgaagtttgtggaatcgacaaaagctagccagaatgattctagaaaaccattggtacgaagtgaagcaaactcaaagtgatggctttttcaaagatttgaataggagtcgaaccaaagagactatcagttacttccccaaagtttattatcgaatgaaagatggcttactgtctattcgcgttcaaatttcactgggaaaatatcaagatcagctattgaagttggaaaagaagttagaaagcggactgtattgtgagttagtagaaaaggaactcaaagactcctatgtggaatacaccttgttatacgatatgattgccaatcgaattgggatagaagaagtagtggcagaaaatgggacgttgcgattgatgaaaaatcaagtatgggcgtatgattccttgcctcatatgttaatcgctggtggcacaggtggtgggaagacctatttcttactcaccattattcaagcactattgaagtcagatgcagaattgtttatcctcgatcccaaaaatgcggacctcgccgatttaggtacggtaatgcctcatgtctattctcaaaaagaagaaatttctaaatgtgtggaagatttttacgaacgcatgatggctcgtagtaggtcaatgaaagaaatgcccaactacaaaacaggagagaattatgcgtatctcggacttccgcccaactttttaatctttgatgaatacgtggcttatatgggtgcgaatcgttttcctacaagcatcgaatag

SEQ ID NO: 2616 - DNA (genomic), 753 bp, Enterococcus faecium; double-stranded, circular
  misc_feature (B) LOCATION 1...753
  hypothetical: NO
  anti-sense: NO
actggtattggagcggtgcttgtcggcttactcgttcaattattcgcttctccagctggtatttcagtgactacatttttgattagtttactttctggtgcattttgggttattggacaaacaggacagtatacatctttcaacttgattggtgtttctaaaacgatgccaatttcgactgcattacagttagtcggaacctcgttgattggtgtcttcgcttttggagaatggtctggaagtatggggaaaatcattggagcagcagcaatcattcttcttgtatttggttctgctttaacggcaatcagtgatgatcctggaaaaaaaggcggtatcacaaaaggaattagtctattagcatcaacaagtattggttattgggtatacagtgcattgcctaaactagttgatgcaagcggactttccattttctttccgcaaatgatcggtgtctttttaggggcagtgatttatgtgattttccgtaaaccaaccgcattttctgaagacaagagttggaaagcaacgatcgttggagccatctttagtgtgtcagcattggcttatattttttcagcaaatgaaaatggggttgctactgcatatatcattacacagctaaacgtanttatctctacattacgcggtatgtacatcctgcatgacaataagagcccaaaagagaaaaaattaacgattatcggattattgctgatcgtantacgaagcatggtccccgtctttatttga

SEQ ID NO: 2617 - DNA (genomic), 1383 bp, Enterococcus faecium; double-stranded, circular
  misc_feature (B) LOCATION 1...1383
  hypothetical: NO
  anti-sense: NO
cgaaacattggaatgaaggaggaagcgacaacgttaccacagcaatttatcaaaaaatatcgtcttcttttaggcgaagaagcatccgattttttttctgcgcttgaacaaggaagcgtgaaaaaaggatttcggtggaatccactaaaaccggcaggattggacatggtccaaacttaccatagcgaagaattacaacccgctccctacagcaatgagggatttcttggcactgtcaatggaaagtctttcctccatcaagctgggtatgaatatagccaagaaccaagtgcaatgatcgttggaacagctgctgcagcaaaacccggtgaaaaagttttggatttgtgtgcggctcccggtggtaaatcaacccaattagctgctcaaatgaaggggaaagggttattagtgacgaatgagatctttccgaaacgtgcgaagattttatcagaaaatatagaacgatggggagtttcgaacgcaatagtgacaaatcatgcacccgcagaacttgtccctcatttttcgggcttttttgatcggatcgtggttgatgctccttgttcaggagaaggaatgttccgaaaagatccaaatgcaataaaagagtggacagaagaatctccgctatactgtcaaaaacgtcagcaagagattttgtcttcagcaataaaaatgctaaaaaataaaggacaactgatttattcgacttgtacgtttgcaccagaagaaaatgaagagatcattagctggcttgtagaaaattatccagtaacgattgaggagattcctttgactcaatccgttagttcaggacgttctgaatggggaagcgtagctggtttggaaaaaacaatacgtatatggcctcataaagatcagggtgaaggacattttgttgcaaagctgacttttcatggacaaaatcagatgcataaagaaaagaagacacgaaaaaaaagtaaagtgcaaatgacaaaagagcaggaaaaactctggacggagttttcaaatgattttcattatgaagctactggaagacttttagtgttcaacgaccatctttgggaagttcctgagttagccccttctctcgatggtttaaaagtcgtacgtacaggtttgcatttaggagatttcaaaaagaatcgatttgaacctagctatgcattagcgcttgctacaaaaaagatagagaatataccttgcttgccgatcactcaaaaggaatggcaatcttacacagcaggagaaacatttcaacgtgatgggaatcaaggatgggttttgctagtattagataagatacctgtcggatttgggaaacaagtaaaaggaacagtaaagaactttttccctaaaggattgagatttcactga

SEQ ID NO: 2618 - DNA (genomic), 273 bp, Enterococcus faecium; double-stranded, circular
  misc_feature (B) LOCATION 1...273
  hypothetical: NO
  anti-sense: NO
ttcggaattggcaggagaacaccgtttattcggaagaataggactgtgacaagacttttgtcacagtccttttttcgaattcaacaagtaaaacttttaagaaatattcagagagtaaaattaaaaattgctgataaacgaagatggaaattttatgtatttttattggtctatgcaataaataaattaaatattcagaatacaattgattttaacgaaagggcttctatcaatggttgtgttgtatttatctgcccaggtagagtaaaatag

SEQ ID NO: 2619 - DNA (genomic), 774 bp, Enterococcus faecium; double-stranded, circular
  misc_feature (B) LOCATION 1...774
  hypothetical: NO
  anti-sense: NO
ggtctgattggagagaaaataatgaacattgaaaaatttattacggcaagaaaggctgccaacttatctcaaaaagaagtgtctgaaggaatttgtacacaagcaacattaagtaaatttgagaacaatggtcaagtcccttcgttaaaaattttaatcaaattatgtaatcgaatcaatcttccgttagttgaacttttttcttcgatgaacgtgatcaatacacaacttgatgaacagctagaaaaagcagagttttcactgattacgagtgaatatgaacaattgacacagattttagcagccattgatcccaaggtaattgacgagtctgagctgattgcacgttactactatctaaaaggatttgaaatgatttttacgaatgcaccaattacggatgtgttgttccattttgatcagttgttgatggcagaaacagccaacacgttgtttcgtttattggcatatacaggtattggaatggtctatgctagagaaaaagagttggaaaaagcagaagtttatttcaatcgagtgtttgaaaaaatttatacgtatccgattcgtacaacagaagatatctggcgggtgttaaatatcgtctttcattgtggtgttttttttgcgcaagacggtgatttggaaacaagtgatgcactactaaattacgcaatcgatatttgttcggataaccatttgacttattacttagcacgagccgctgcccaattagtgaagaaagcgtcggtattcacgcctagtttggcccca

SEQ ID NO: 2620 - DNA (genomic), 921 bp, Enterococcus faecium; double-stranded, circular
  misc_feature (B) LOCATION 1...921
  hypothetical: NO
  anti-sense: NO
atgaagattggtgtaatcggtgtagggaatatcgcagaaaaagcatatttaccaacttatgcgaaaaaacaaggaacacttgatttttattttgcaacaagaaataaagaaacaaaagaaagaattcaaaaagagtacgggttccaacatctatatgaaacgatcgatgagcttttagaagaaaaaatcgaagcatgtatgatccacgcagcaacaaaagtacattatgaattagccaaaaaatgtctagaaaatggtatccatgtttatattgacaaaccactgagtgtccatctaaatgaagttcgtgaattgcaagaattagctgataagaaccaaataattttgatgatcggtttcaaccggcgctttgctcctatggtagaagaattgaaacgtatcccagataagcggttgatccacctgcaaaaaaatcgaatagcggcaaaagaaacgacagagttcgtcctttatgatttgtttttacatcttattgatacagctgtgtatttattagatgaacccattttgagaacaaaataccagataagagaaacaaaggaatttttggaatatgccattttacaattagaaacacaaaatcaaacggctattttaacgatggatttagcaagtggcgctaatatagaaaaatatcaagtaacaagtaaaaatggtacttatgaagtaaacgatctgacccagcttgtcattcaagatgctgatggaaaaaaagtgaaagaatttggcgactggacaaacacgctagtcaaacgcgggtttgagccaatggtagaggccttcttttctcagatccgtttaggtaaatcggaaacagaattgcttaaacaaaaagaagttgtaagaagtcatgaattatgtgaggaagtgcttaaagatcactaccgtcatcaactttga

SEQ ID NO: 2621 - DNA (genomic), 225 bp, Enterococcus faecium; double-stranded, circular
  misc_feature (B) LOCATION 1...225
  hypothetical: NO
  anti-sense: NO
attactgttggctcaccagacaattcagctgcttcttttgtgataatcactttttcgatgttttcatttgaagggatatcaaacatcacatccatcatgatttcttcaatgatggaacgaagtcctcgagcaccggtattgcgttcgattgcttttttcgcaatggctctcaacgcttcaggttcgaattcaagttcggtattatctagagaaagaagtttttga

SEQ ID NO: 2622 - DNA (genomic), 462 bp, Enterococcus faecium; double-stranded, circular
  misc_feature (B) LOCATION 1...462
  hypothetical: NO
  anti-sense: NO
attggagttggtagtgtgtcactactaagtagattaaacgatgacatgaaagcagcgatgaaagcgaaagataaggaatctttacaagtcatccgaatgatcaagtcatctatacaaaacgagcagattaaagaaggtcacgacttgacagaagaagaagaactaacggtgttgtctcgcgaaatgaaacagcgacgtgattctttgcatgagtttgaagaagcaggacgtgacgatttagctgaaaaagtaaaaagtgaaattgtaatagtcgaaaaatatatgccggaacaactttccgacgaagaaattcgacaacttgttcaagaagcaatcactcaaactggtgcttcatcaatgaaagaatttggcaaagttatgggtgcaattatgcctaaagtcaaaggaaaagcagatggaaaccaagtgaatgcgattgtgaaagaactattacaatcttaa

SEQ ID NO: 2623 - DNA (genomic), 2154 bp, Enterococcus faecium; double-stranded, circular
  misc_feature (B) LOCATION 1...2154
  hypothetical: NO
  anti-sense: NO
agctattctggtgatcatcaccaaggaacctatttagcaggtgtttggtaccctgacaaaacacgtgttggctggtggaaaaacggctatcctgaatattttggaaaagtaatcaatgcagtcgattttatcgctatggatctttttatcgatgatcagctgattgatctagctacacttactactgaagatttttattgggaattaaacatgaaaaacggtgttttgacacgtagttatacagtcactaccccatcaaacaaagttcgtctttcattcgagcgctttttaagtattgtcaaaaatgaagccgcttatattcgcttaaccattgaaatgttggaaggaaatggaactgtaaaagttatttctaagctagatggcaatgtccaaaacgaagacagcaattacgatgaacacttttggaatgacatcgatcatggcgtcaaggaagaaatagcgtacttaacgactaaaacgatcccgaataattttgagatcgaacaatttacagtgacctctgggatgcgccactacgttgatggaaaattatatacgccaagctaccaagagggcaccttagcaatcgaaggttcattcacctttgacttaaatgaaaatgaaacacttcttatcgacaaagaagtattgattttcacaagccgagatatccctgaagggcaacaagcgacacatctctttaaagaattcaacgaattgaacgttcactatccccaagcaaaagaggagcaaacagccgcttggtctaaacgatgggaattggcagatgtagtcattgaaggagacgatgaagcacaacaaggaatccgtttcaacctcttccagctattttctacttattatggcgaagatgaacgtttgaatattggaccaaaaggcttcactggcgaaaaatatggtggtgcaacttactgggatactgaagcctatgcagtgcctctgtacctcgctttagcgaaacctgaagtcactaagaatctcttgaagtaccgccataaccaattgccacaagcaatccataatgcacaacagcaagggctaaagggcgcgttatatccaatggtcactttcacaggtgtcgaatgccacaatgaatgggaaatcacctttgaagaaatccatcgaaatggcgcaattgcctacgctatttataattatactaactacactggcgacatcgactatttaaaaaatgaaggtttagaagtcttagcagaaatcgctcgcttttgggcagaccgagtccatttttctaaacgaaacaatcaatatatgatccacggggttacaggaccgaacgaatatgagaataatatcaacaacaattggtacacgaatacgattgcttgttgggtactacgttacacacgagaaaattatttgaagttcaaagaagagagcactgctaaaatcagcgacgatgaattggcacattggcaagaaattgctgaaaatatgtacttcccagtagatgaagaattagggatttttgttcaacacgatactttcttagacaaagatctcaaaccagtagcggaactatccgcaagtgaattgccattgaatcagcattggtcatgggacaagatccttcgttcttgcttcattaaacaagcagacgttttacaaggtatctacttcttcaatgattcatttacaaaagaagaaaaacaacgcaactttgatttttacgagccaatgactgtccatgagtcttccctatctcctagtatccatgctattttagctgctgaactaggcatggaagataaagccgttgaaatgtatcaacgcactgctcgtttagatttagataactataacaatgatacagaggatggcttacacatcacttcaatgaccggaagttggcttgctatcgtacaaggattcgcgcaaatgaagacagatcatgaacaattaagatttgcaccattcttgcctaaaacatggtctgcttattcattccatatcaattatcgcgaccgcttgttatttgtcgccgtttcaaatgaacaggtaacattgaacctcttatctggcgaagcattaccgctagaagtctacgaaaaagcgtatgtccttactgatcatttgactattccattacgagaaggtgaagcgaatgtttaa

SEQ ID NO: 2624 - DNA (genomic), 852 bp, Enterococcus faecium; double-stranded, circular
  misc_feature (B) LOCATION 1...852
  hypothetical: NO
  anti-sense: NO
agtggtcctggccttgaagactctgaaacggacttgtcaaacagtcaccatgcaactgagtctttatctcaggacaagaaacacgcaggaaaggttggaaaaatgaaattaaaacaattacctctggaataccaaaaggcaattccagttctgaaaaaattagagaatgcaggatatgaagcttattttgtaggtggaagtgttcgtgatatcttgctgaaccagccaatccatgatgtggatatcgcaacaagcgcatttccagaagaaatcaaacagctttttccaaaaacgatagatattgggatcgaacatggaactgtgttggtattagaaaatgatgaacaatatgagatcaccacatttcggacggaatcaacttatcaggactaccgtagaccagatcatgtcgaattcgttcgttcgttggcagaagatttgaaaagaagagattttacgatcaatgcgtttgctttgaaagaagatggagaaatcatcgatttgttcgatggtctgcaagatctagaagaacagatcttgcgagctgtaggcaatcctcatgagcggttccatgaagatgccttacgaatgatgcgcgggttgcgttttgtcagtcaactagggttcaaattagaggaagaaaccttctacgccatcaaaaaaaaacacgagctattaggtaaaatatctgtagaacgtataaatgtggaattcatcaagatgctcttgggaaatgaacgggccgcgggaatccatgcatttattgaaacagagtgctacatttgctgtctcggtttgaaaaaaaaagcgaaacacttttacgttttgctgaattaccatccgtcccattga

SEQ ID NO: 2625 - DNA (genomic), 420 bp, Enterococcus faecium; double-stranded, circular
  misc_feature (B) LOCATION 1...420
  hypothetical: NO
  anti-sense: NO
aaggagcctggtatctattccttttcttcagaaaaacgggtctatgatgtactaaagcgtgcaggtggattattagaagaagcggatagcgatcgaatccacttttctgcgaagatagaagatcagcaagtcctatatatccctgctgtaggtgaagagctgccagaacatcttgatcagttggcatcctcggaaggaaaacagcctacagcagattccgagcctcccaaaataaatatcaatacagccactccatcagaacttcagcagattcctgggatcggatcagtcaaagcgcaagaaatcattcgatttagagaagaaaacggatccttccagaaagtggaagacctgcaggagatttctggtatcggtgaaaagacagttgaaaaactaaaaaacttcgttacaattaaatag

SEQ ID NO: 2626 - DNA (genomic), 288 bp, Enterococcus faecium; double-stranded, circular
  misc_feature (B) LOCATION 1...288
  hypothetical: NO
  anti-sense: NO
gacaccattttccatagcatctttcaaaccagtttcaacagctggaatgtattcacgaggaacaaccccaccgacgatcgcattttcaaattcgaaaccagcaccttcttcatttggtgtaaattcaatccatacgtgaccgtattgacctttaccaccagactgacgtacaaacttaccttcggcttgagtgccagcacggaaagtttcacggtaagatacttgaggcgcacctacgttagcttcaactttgaattcacgacgcatacggtcaacgatgatatctaa

SEQ ID NO: 2627 - DNA (genomic), 894 bp, Enterococcus faecium; double-stranded, circular
  misc_feature (B) LOCATION 1...894
  hypothetical: NO
  anti-sense: NO
ttgaaagctggaattcatatggtcaaacgaaaaacagtaaaagaagttctttttatcattataggaacaagtatttatgcatttggtcttgtttacttgaacatcgctaatcatttagcagaagggggagtctcagggatcaccttgatcttaagagctttatttggtattgatccagcttatacgactttattaatcaacatcccattgattttactaggaggaaagatcctcggtaaacgttccttggcctatactgttctaggtacactttctttgtcattctttttatggatctggcaaagggttccactagaaatcaatttacagcatgatctactgatcgtttctctacttgcgggtttagttgcaggtgtaggaagcgggatcgtctaccgcatgggtggaacaacaggcggcagtgatattatcgctcggattttagaacaaaattacggcatcactatggggcgttccctattggcatttgatatcatcgtcttacttgcttcattaacctatatcgacttgaaacgtatgatgtatacgttgattgtttcgtatgttttcagtcgtgtgattgattcgatcttagatggcggatattctgcaaaaggtctacttgtcgtctccaacaaaagcgaagagattgcaccactactgatgaccggtctgcaaagaggtgtgactttcctttctggagaaggcgcattctctggtaattcaaaaaaaatcatctatatggtcgttagctctagtgaattaactgaagctaagaggatcgtccacgagattgacgaaaaagctttcctttcaatcatcaatgtgcatgaagtggaagggcaaggctttacttatttgaagccacagacaagattactgaaaaaactataa

SEQ ID NO: 2628 - DNA (genomic), 1545 bp, Enterococcus faecium; double-stranded, circular
  misc_feature (B) LOCATION 1...1545
  hypothetical: NO
  anti-sense: NO
ggcgattatggctggtgcaaacaaaatacctttcgtgaatggagtcaaaaatggaatgacatatctacttcctcgttcgctgaactagaaagtcaaattttcgaagtggaaaacctcaatgaaagttttcggttcttaaaaggaaaaaaagcagttgttgaagcagaagctacaatggaccaaatggagaaacaagtgacggaaatccgtgaaggtctaaaggaattgcgggaaacggaagaacgcaactcactagctgttcagcaggcacttgacgtctatgaagaactgaaagaaaaagtcagagaagacgagcatgaatacggaccagctctttttgaattgcaaaaacagatcaaagtgatcgaaaaagaatttacgcagtttgtgactttaaacacttctggagaccctgttgaagcccgcgaggttttggataaagcagaaaaacatacgtatgaagtggaagctctgatgaaaaaaattccaccgctgtatgaggagctccataccactttccctgaacaacttgaagaaatcagtgatacttacgagaaattgatggaagaacaatatgtattcccagaagaagatcttgctgaagatatcgcaaaagtaagtcgaagaattgaaaattcattagccaatcttgaaaaaacagaagttgaaacggtcgaatttgaaaaccgtgaaacagctgatttgattgattcgttatatgatatcttagaacgggaaatggaagctcagagatatgtaaaaactaaccaatcaacgattgcagagtatatcaaacatacaacaaagaataaccgtcaattattgattgagctggatcacacatctcaaagctatacattgaaccacaatgaaattggccgtgtacgaggtttccaaaccgaagtggaagaaatggaacgtcaaaatgaacagatgattccacagatccgtcaacacgaaattccttattcagaagtgcgcacgttctataaaacagtcttcaaagtcttagaagatatcgaaaagcaacaagtagagatcgacgactcattacatgaattgagaaaaggcgaaaaagaagcgcaagaaaagatcgatacattcgaattcaaattgcgcagtttgaaacgttttgtagaaaaacaacgtttgcctggcttgccgaatgattacctagaattcttttttgttgctactgaccgtattgaagaactaagtgttgtcttgaataaaattcgagtaaacatggaagaggtcaatcgtttagttgctctatgtgaagaagatctagaattattagataagaagacacatgatttagtagatgcagcagcattaacggagcaaatgctccaatatgcaaatcgttatcgtcatacacacgaagaagtgagagaagcaattgataaaagctactatttattcaataaagaatatcactatcaagaagcattagacgaaatcggtacagcattagagcgagtagaacctggtgctttcaaacgcatcgaagatttttattttaatcatccagacttagtataa

SEQ ID NO: 2629 - DNA (genomic), 1023 bp, Enterococcus faecium; double-stranded, circular
  misc_feature (B) LOCATION 1...1023
  hypothetical: NO
  anti-sense: NO
cgtagctatggatctagtgaaaggtacttcgttagcagcaacaatcacagtgccagaaatatttcaaaaagcaaagatcataggcggtcggacattcgattatttttctctctatattttagttgcactgatttattgggtcatttgtatcgggatcgaaaaagtgcaacagtatttagaaaaacgttctatccatcagtcaatctgaaaaatagaaatggtgctagcgtggctggcaccatttctattttttgtttcttgtatattctgcctagtattttaaaaccatttcatgtaaaatgtaaatcgaaaatatgttcggaggtagaaaacatgaagaccccgctaaccatcgaaatagaatcctcgttataccaatattgcatcgagcaaggcggcttggttgtagaagaagtcacgatgcctgatgaccaaggaattgtagatacgcttagctgcttgacaaaatttgatggaagccgagaatggcgatgctatgagctgaaagtgacaaaagcagattttcgctctacagccaaactgtcatttgttggacattataattattttgttttaccaagtaaactatatgaagaagtaaaaactgaaatccctacaggaataggtgttttagtgtatcgtccgtacacggttgaagaggagatgcctgcctctggtacatttctgattgcgaaaaaagcagcaaagaaagagcttgctgtaccggaagaagctttgacaaaccgcttcatggcttctttattcagggaagtaagaaaagcaaagcaaatggagcgaggcgtaaaatattttccaaaagatcaattgtacaaagaattgaaaagacgttcagaaaatcaagatccattttctaacgaacgatattatgaacggtttttagaggaaatagctagtcaggcaatcaatgagttgcaagaagaagttatcgcgcttcagcatgattatgaatatttgaggcaacaacagcagatccgtcggttgcctacagagccattggagtga

SEQ ID NO: 2630 - DNA (genomic), 1191 bp, Enterococcus faecium; double-stranded, circular
  misc_feature (B) LOCATION 1...1191
  hypothetical: NO
  anti-sense: NO
cttgttcatggtttccccagaagtaggttctggtttgccattctggcttccaaaagcgccacaatccgacgcacgatcgaacgttatatcgtagacaaagaagttagtctaggttaccaacatgtatatacaccaataatgggagatgttgagttgtacaaaacatctggacactgggatcattatcaagaagacatgttcccgccaatggatatgggagatggcgaaatgcttgttcttcgcccaatgaactgccctcatcacatgatggtctacaaaaacacgatccattcttatcgtgaattaccaattcgtatcgctgaattaggaatgatgcatcgctatgaaaaatcaggtgctttgtcaggtttacaacgtgtacgagaaatgacgttgaatgatggtcatacatttgttcgtcctgatcaaatcaaagatgaatttaaacgtacgcttgaattgatggtggcagtatatgctgacttcaatattacagattatcgtttccgcttgagctatcgcgatccaaacaatacagataaatattttgatgatgacgcaatgtgggaaaaagcccaagcaatgctgaaagccgctatggatgaattagaactagattactttgaagcagaaggcgaggcagccttttacggaccaaaactagatgttcaagtcaaaacagctcttggtacagaagaaacattatcaactatacaattagacttcttattgccagagcgctttgatttgacatatgttggagaagacggggaaaatacgcatcgtccagtagttatccaccgcggaattgtttctacaatggaacgttttgtcgcttatttaacagaagtatacaaaggcgcttttccaacatggttggcacctatacaagcaacaatcatccctgtttctgttgatgcacatggcgattatgcttatgaaatcaaagaacgtttgcaaatgaaggggttgcgtgtagaagttgatgatcgtaatgaaaaaatgggctataagatacgtgcctctcaaacacaaaagatcccttaccaattagttgttggagacaaggaattggaagatgcaacagtgaacgtacgtcgttatggaagtaaagaaacagctgtagaagatttgaatatctttattgatgctatggaagcagaagtcaaaaattacagcagagaaaactaa

SEQ ID NO: 2631 - DNA (genomic), 336 bp, Enterococcus faecium; double-stranded, circular
  misc_feature (B) LOCATION 1...336
  hypothetical: NO
  anti-sense: NO
tataatcatggggaggtgaggaatgtgaaagagatccaatcagcaaaaaatccaagaatcaaagaattaaaaaaactacataaaaaaaaatatcgggaagaaaaggaagaatatcttttggaagggttccatctgattgaagaggctgcgtcgtctgatgcagatataaaagaactttttgtgacacagcgaggcaggaaagaatggggagactggctggccgcaaacaaagggatttctacttttctagtttcggacgacgtcatggatgctgtatcggatctatccctaacccaccagggattcttatcagtgtattggcttttaccggcttaa

SEQ ID NO: 2632 - DNA (genomic), 1071 bp, Enterococcus faecium; double-stranded, circular
  misc_feature (B) LOCATION 1...1071
  hypothetical: NO
  anti-sense: NO
aaaaatcatgggaggaaagttatgaagaagctcaggaaaatatttggcagtcagaactattctaaaggattaacaagaagccagcaaaaccagtttgcacaaaccatgggagaactgcttttatctggttttagtctgcaagaatccctttatttattactcacgatccgttcgtttccacctgttattttggcaaatatccaacatcagctaaaggaagggcaagcgtttagtgaggtactttcgcaaataggatatggagcagagcaactggtacagatcgagttagctgaacgtcatgggaatctgccgacaactttgttggaaattgccaaacagtttcggcttgttgaaggatttcgcaatgatttgaaaaagctgcttgcatatccgatgctattgctcacctttttgctaggtatcttgtttagtatgcggttgttcgttttgcctcagcttattggttcaggaatggtcatgcaagagcattggggtattcagctgatacaagtctttcattggtatgttctactattcatcctagcggttactctattggctttactagtaaggtatcgtctgatgaagttgtctcctgttgatcagagtgaatggataagcagacaattattgattggaccgatatattccttgtatcaatcggcttatttgtcactagagattggaaagctttttcatgaaggtttcgaattaaggcaaatcatagtctgcttaaaggaaacgaaacaagaaagtctgattcagcatcttgcctctaagttgattcaaggattggaggcaggtatgtcattggctgagcagttccagaattatcgttttctatcagaagaattcagtaaaattgttttacagggagaggcaaagggaagtttaggtaaagaactgattttttacagcgaatggacaagaaaacagcttttcaaacgtcttcatcactggatgcattttattcagccaatcatttttttgggcgtagcggctttgattttattagtttatgccgctgttttattacctgtttacggaagcatagaggaggttttgccatga

SEQ ID NO: 2633 - DNA (genomic), 774 bp, Enterococcus faecium; double-stranded, circular
  misc_feature (B) LOCATION 1...774
  hypothetical: NO
  anti-sense: NO
aaagataatggaggggtcattatgtcagatggacgtatgttatttgagagagaacgacaggacatggcacgtatcgtaagagtgattttcgaaaggaaaaacacaaatgtcgcaggagggaatttttcctttaaaaccactgatgatcaagggaaagactacatcatcatgacgccgaccatgatgtcagaagcctatctaggagagatttctcctgcacaggttctagtagtagaaccaagaacgcgtagaatcgttgacggagtcggtcatttaactcgtgaaatcaatatgcatgaagcgatgtatgagactaatccagctatcaaagctgtcctacatgctcatgcgcctaatgcaatgttctgggcgactactgggttgcctatgcctaatttgacagaagccacagctaaagtaaaagagattcctgtcatggactttgagcctaattgctctgaagaacttgctgaattgacaagcgactatgtaaaaaaacagcatctcgaattaccgcatatgttgctgctcaactctcatggcgtattgatcaacacaggtggagaatcaggaatcgaagctatccataaagcactgcaaatccttgatacagttgaatggaatgcagaaattgcctacaagcagacgatttttcaagcattagggattactgacggtttttattcaaaaggtgagaaaatcgggggattggaagagttgaaacataaaacggctatttataataaatctgttattgcagctggtggagactaa

SEQ ID NO: 2634 - DNA (genomic), 861 bp, Enterococcus faecium; double-stranded, circular
  misc_feature (B) LOCATION 1...861
  hypothetical: NO
  anti-sense: NO
atggtcaatggaaagtcacagactttagttatttcactcgttaggaggaagaaaatgagtaagaaaaaaggagcaagacaacgtttcaaaaaacgaaaaagttatcttagatggctgggaatctttatgattatcggctttttaattcttgctagtccgatttatacgcataagaaggtagacataccagatgaggtaagcacgaacgcatttttaaacacgaaggaactgacgatggtttcaaaagaaaaaggagcgaaccagcaattagtttttgaatttgcgattgacgatgaagatcaaagcttattaaaagaactggctaatcttaattatcgcgtagaagtaaagacagctaaaggggattatcaagcaataaaagccaaagtgattaaggtgtctgatgattattttgcagtgaagctatcgcatgtaccagaagaatatattgctatgcgattaactattattcctgaaaaaattgatccaaaggtggatatgcaagaaccgcaagatctgattttttatattcacgaagataaggtcaaagatcacgtgaaagacgaagattatgaacaacatgcgatcaattacaaagtgaaaggatacaagaaagaacaaaaagcagcacaaaaacaaattgaatccttccaagcaaccattgatttgaatgaagaattagtgaagaaactaaaagatcaattgccttatcaagtcgcagaagatcaggaaaatactgaaaataagattaatagttaccagcaagaaattgaaacatcgaaaacgcaaatgaaagatcaagaagagagcattcaaaaacttcaagaaaaaattgatcgtatgacaaaagaaaatatttag

SEQ ID NO: 2635 - DNA (genomic), 777 bp, Enterococcus faecium; double-stranded, circular
  misc_feature (B) LOCATION 1...777
  hypothetical: NO
  anti-sense: NO
atgaacaatggcaaccggagagttttgatcagaagatccaacaattatttattgactaaaatgaaatgggaggttttcatgaattatcaacagcaaataaaaatgcgtgcatggttgaggcgaccgttatggacctatgtttttttagggatacagacaatagtcttcattataatggagttgtttccgcgtcttgaaattccttattatactggaatgtatggtccttatcttgttcacttcaatgaatggtggcgcttagtgacaccaatcttcatccattttggagtgatgcatttcgtcatgaactcactgatattgtattttatggggcaacaaatcgaggcaatatacggtcactggcggtttttcctgatctatatgttcagtgggataatgggaaatacagcaagttttgctttcaacgaagcgaatgttttgtctggtggtgcaagcacctcgatattcgggttgtttggtgcgttgtttattttaggatttcattttaaatataatacggcgatccaacaactagtcagacattttcttttatttattgcgatgacatttgtttttggtcttcttgacacctctgtaaatgtttggggacatgtcggcggactggtgggcggtttagtattaggaaatattttagggctaccgaaacagcagacaagctattcgatacaccagaagattctttctacactagtttttgtatttctttttgtaatatgtattttactgggtttaaaaaaatatggtttacttgtataa

SEQ ID NO: 2636 - DNA (genomic), 1617 bp, Enterococcus faecium; double-stranded, circular
  misc_feature (B) LOCATION 1...1617
  hypothetical: NO
  anti-sense: NO
accataaatgggaagaagggactcatagcaatgaaatatgattttgaaatggacctagatgaacaaagcagtgtgggaaaaattgccgcacagatcaaaccaggaagtaaagttttagagtttggtcctggaaacggccgattaacgaaacatttgatcggagcaaaacaatgtgaagtgagcattgtcgagctagataaggaattgttcgattttgtcagcgagtttgcccaagatggattttatggagatatcgaaagttttgaatgggcaaactattatgctggacaaacatttgattacgttttgtttgccgatgttttagaacatttggtagatcctggaaaaacgttgaagaaagttagagaatttttgaatgaagaaggagaaattctaattacattccctaaccttgcgcataattctgtcatgattgatttgttcaataatcaattgccatgggcttcttatggtttgctagatgaaacccataattctttttatactcatgatggcttccaaaaagtttttgaaaaagcaggattatacatcaatattgaagattatttgtacttagctgtaggtgatacagaattaaaatcaacttatgaagaattgccggaagctgtacgttatgatttcaaaatgcgaccatttggcgaagtctaccaatacttcttctcattgatgaaacatccagtagcacaaagttccattgcgcagccgcaaaattctaattatgtgaaagtattagaagtaatccagcaaacgaaacaagatgaaataattcaacaaataccattcaataatttcacaggggaaaatgagacactaagtttccatgtatcagaattagcagaacgaatggtgtttcgcttcgcgcagcaacctagctttatcgaattcagcgcagaagctgctggagaaaaactcacatttatcgattcaaatgctgtagtcaaaacagtaaatgattgttatttgtttgatggtaaagatttaccagagttctttttaacggatattgcagggaaagaagtgactatccattgtcactatcgttttatcggagaattgacaccaacaatgaaagaattgctggaaacaatccgtccaatggctgaagttacaaagcagctttctgagaaaaatgatgaattagaaagagaaaatcattatcttattgagaataatacaagattagatcagacgttgaaaacaaccataaatcgctattgcacgttgttggaaagtgatgaatggacaatcaaacatagattagggcgacgtaagaaagaaacatcgaaaaaaatccaagaaaaagagctttctctatgtattgacgaaaaaatctgggatgcagaaacaaagatattgaaaatcatcgggtggggaatcgctaattcggatcgccaaccattgtcctataagttatcagccgaccaatcaccattttttgaagcaattcctgttttacgagaagaagtcaatcaagcaaaacagctagctgaaggagcaaaagcaggatttgaactgcggatcctttgcgagaaggaacgttcattcttagttgaagcagtggctcaaaatggtcaatcatggatcattgaaatgtaa

SEQ ID NO: 2637 - DNA (genomic), 522 bp, Enterococcus faecium; double-stranded, circular
  misc_feature (B) LOCATION 1...522
  hypothetical: NO
  anti-sense: NO
aatagaaatggaggccatcagatgattggacctatagtaagagaaatgctgctggaaaatcaggaaacgtttttgattcctgcagaaaatgtggcaaatgttatgtatcatcatccattgtcccatggtttacttgtgttatcgaaggtcggttattccaaaattcctgtattaggaaaagatgatcactttgtaggactagtaagtttatcagatgtggtcaataaaatgattgacttgcaaacaatcagcatggacccgttagaaggactaacggttgctgatgtgacagaaacagatgttccgacaattgatgaaaattgggaactagaagaagtactccatttgttagtcgattcgccttttttaccggttgtcacagaagatcggattttcaaaggaatcattacaagaaaagagctgcttaaagccgtaaacttcatggtgcatgaattagaacgtcgtaatatattgtctccgaaaatcgaagaattaaaagaacaaatcgatatcgtgagctaa

SEQ ID NO: 2638 - DNA (genomic), 648 bp, Enterococcus faecium; double-stranded, circular
  misc_feature (B) LOCATION 1...648
  hypothetical: NO
  anti-sense: NO
ataacgaatggagaatccaccatgttcaataataaaaatacagcagtagttctcactgacccgcaagtcgagttcttgaaaccagcaggcggtggctttggtttgacaaaagatatcttagaaaaatacaatacgatcgaaaatatgattgaaatggtaaaacaagcaaaagaaaaaggatacaaactctttatttctcctcattatttttacccacatgaccataaatggcaatttggcggtgcaggagaacatatgatgcttgagcagcagatgtttgctagaaaaagtcaatatgaatcagtggaagaaggttcaggagccgattttatcgaagaattgaaaccttatttggatgaaaatacgatcatcagctctcctcataaaatctttggaccagaaagcaatgatttggcgctccaattgagaaaaaatggaatcgacacagtaattcttggtggaatgaacggaaacttgtgtagcgattcccatatgcgtgaattggtagagagtggattcaatgttgtggtagcgacagatgcaattggtgctcctggccaagaagcaatggatgcagcgttgacgaactttggctttattgcagatcaagtgatgacaacagaggaagtattagagcaactatcataa

SEQ ID NO: 2639 - DNA (genomic), 453 bp, Enterococcus faecium; double-stranded, circular
  misc_feature (B) LOCATION 1...453
  hypothetical: NO
  anti-sense: NO
tggaggaatggggggctttcaatgttgatgggtgaattccaacataatattgatgcaaaaggacgtttaatcgtgccctcaaaacttcgtgaagaacttggcgaaaagtttgttctgacacgcggattggatggctgtcttttcggctatccgatgagcgaatgggaaaatctggaagctaaactgaacgaaatgccgttggctaaaaaagacgcacgtacttttgtgcgattcttctattcggctgccactgaatgcgaacttgataaacaaggacgaatcaatatacccagcacgttaagaaattatgcagctttgacaaaaggttgcgtagtcatcggtgtatctaaccgaattgaaatttgggatgagacacgatggcaagatttttctgcagcagcagaagagaactttgacgaaattgctgaaagtatgattgatttcggactataa

SEQ ID NO: 2640 - DNA (genomic), 315 bp, Enterococcus faecium; double-stranded, circular
  misc_feature (B) LOCATION 1...315
  hypothetical: NO
  anti-sense: NO
tctgttgatggtgttgtaggcgcaggtgttgttgattcttctgttgttgaagattcaggcactgttgttgattcttctgttgctgaagattcaggcactgttgttgattcttctgttgctgaagattcaggcgctgttgttgattcttctgttgctgaagattcaggcgctgttgattcttctgttgaagattcaggtgttgttgattcttctgttgctgaagattgtgtagctgatgatgattcttcagtcattgaagattgtgtagctgatgattcttctgttgctgagctttgtgcagtagatgaagcttga

SEQ ID NO: 2641 - DNA (genomic), 195 bp, Enterococcus faecium; double-stranded, circular
  misc_feature (B) LOCATION 1...195
  hypothetical: NO
  anti-sense: NO
aaaaccgatgggactttgacaaaagtagtgtcaaagtccctttttttgaataaacggtgttcaaaagccattttctcggtattaagtcaaatttatgcaaaaatgtggaaagccattttcacaaaatttttcttactactcgaaactaagcgactttttcacaacctctcgataaaacggtgttcaatcagctga

SEQ ID NO: 2642 - DNA (genomic), 504 bp, Enterococcus faecium; double-stranded, circular
  misc_feature (B) LOCATION 1...504
  hypothetical: NO
  anti-sense: NO
tatctggatggttttttcattataaaaagcaaaggggtggatgttatgtatcagcaagtagaagaatatgtcaaaaagttccaagaaaaatatcctagttatcaatcagaaaaattaggtttcttttcatttggggatacagaaaaaatggcagacgagttgagcgaactagttgtaaaaaagataaagactggtacatcaagtggttacgatctgtataaacaagagaatgagcctttaccaaaagttggtcaattagacgtggtcctgaatggaaaaaatgaaccagtttgtatcatcaaaaatataaatgtgaccatcttgccttttagtgaagtcacgaaagagcatgcttggaaagaaggagaaggggatcggacattagcttattggcggaaagtccatgctgagttttttgaacatgcttataaagaagcgttgaacatagaatttacagaagagaagctggtcgtatacgaagaatttgaagtaattttcttttag

SEQ ID NO: 2643 - DNA (genomic), 693 bp, Enterococcus faecium; double-stranded, circular
  misc_feature (B) LOCATION 1...693
  hypothetical: NO
  anti-sense: NO
aaagaggatgggaaaatgaaagtattgatcgtattaacaaatgtagaaaagtacgaaaagatcgagcgtcctacaggtttgtggttaagtgaactgactcatttttatgatgtattagtaaaaaatgggatcgatgcagattttgtcagtcctaaaggcggatatgtacctttagaaccgcaaagtgttttgaatatggatgaaatcgattgggcctattatgaagatgaagatttcagaaatcgggccttgggaaataccttacgtcctgatgatgtggatgcaaatgattatgcagcggtttattatgctggtggccacggaacaatgtgggattttccagaagcaatagatcttgggaaagtcgcttcacaaatctatcgaaatgaagggctggtctcagctgtttgtcacggtgttgtaggattgttgccagttacagatgagtctggaaaatctattttagctggacgtacagtgactgggttcagtaatgaagaagaggaagcaaatggtacaacgaatgaagtaccattcttagcagaagatgctttgaaagaaaaaggagcaaactatcagtctggagcagctttttcagaagtggttcaaattgatgggcggcttcttacagggcaaaatcctcaatctgctcatcaattaggcgaagcagttgttgaagcattaaagaattaa

SEQ ID NO: 2644 - DNA (genomic), 381 bp, Enterococcus faecium; double-stranded, circular
  misc_feature (B) LOCATION 1...381
  hypothetical: NO
  anti-sense: NO
tatagggatggtgatagaatgagggttcaaagctatggtaacagtgtctttgatgttaaaagagaatttcaagattctagaagaaaaaccaaaaagctgatagcttacttcattctatcagctatcgttttctatattgtcaagtttgttttggaattaaactcaatagtattcacagatatggttcataaaatgttaaatggagaacctattaatttcaactttgattacatgcttgaaaaagcacaaagcaatcaaattgtggcttttatcgtgagtatctattattttattgaaaaatctattttttctttaaaagattttttctttgaaatgcttaccaaactaacaacgttttacaataaaatttcaaaaaattaa

SEQ ID NO: 2645 - DNA (genomic), 234 bp, Enterococcus faecium; double-stranded, circular
  misc_feature (B) LOCATION 1...234
  hypothetical: NO
  anti-sense: NO
ggtattcgtggtgaagaggcagctcaaacacgcgtgcaacaaacagaggcaccaaagagcgcagcagtgaccaattttgatatcttaaaacgcttgtcaaatcttgaacgtgaagtatttggtaaaaagcttgatcaacaagcaagtgcagtcaaaccagcacaacctaatccaaataactacacaaatgcagacacaagcttagatgataatgaaaaaacacgtcaattttaa

SEQ ID NO: 2646 - DNA (genomic), 795 bp, Enterococcus faecium; double-stranded, circular
  misc_feature (B) LOCATION 1...795
  hypothetical: NO
  anti-sense: NO
ccattccgtggtgaagagtcctttatacgattcaaagaactaaaggaagcgagaaatgtcccattttggaaagccattgtctatcttttagttttgagtataattatggctttgccaatctcttttcaagtttttcaagtcttaaacaacattcaattggatgggcaaaagattgctactcgcattcctgattttacaatccaaaacgggcagcttcaaaccgaagaaaaagaaggattcatttaccaaacaaactccattatcttcacatttgatccagagggaaaacgaacagaacaggacatctctactgatttgatggggaattttgttagtgtcgggatgttaaaaaacaaacttatcatagctcttcctaatacaggcacgacttctgctttgttgaacaataaccaattagaacttccctacaccaatgaatctttaaaaaacttaacaggtaagcagctccgttcttttttaagtgaagcatctataccactttggataaaagtcctgacatttatattttctatttatcctagttttctgaatctgctgatcactttgctatttaccaacattgctgcttttctctatgcacgctttcgactaacaaaagctacttttcttgattgtttaaaaacattgatctattcaatttcattgcctactataattgcaacaatcttgatggtctttcttccttcttttgacactagcgccttcattgcttttgcaggaatctttatttttgctcaagctgtcaaaggatgggcaaaaatatcgatcaattaa

SEQ ID NO: 2647 - DNA (genomic), 508 bp, Enterococcus faecium; double-stranded, circular
  misc_feature (B) LOCATION 1...508
  hypothetical: NO
  anti-sense: NO
attccgtggtgaagagccattaaagaaacccaactgcttgcccgctcaatcaacacgcgcatttatccttttcggagatgcacatgaaaaactttgggaaatcactgaagaagcacttcgcccattgactccagcagaagctttcccaaatacacaaaacaaattagctggtttcaaaaatggttatggtacagtattattcttcaaagatactgacgtggtaaaaggtctacaagaacaatttgaattatatgcagacaacttcccagattggtcagaacaatcaaacggaatcgcaacagctaatacttgggtagcattagttgataaaggattgggcgcaaacttgcaacattacaacccagttattgacgaagcagttgcaaaagaatggaatatcccttcaaactggaaactacgttcgcaattagtattcggttcaccagaaacaccggctggggaaaaagaatacatgaacgatgccgatcgcttccgcgtatttggataa

SEQ ID NO: 2648 - DNA (genomic), 437 bp, Enterococcus faecium; double-stranded, circular
  misc_feature (B) LOCATION 1...437
  hypothetical: NO
  anti-sense: NO
cgttccgtggtgaagagcatctttcagaatatttgaacagcacattagccatcgtagatcatgcagatgatgcttcaactgagggtggttatgtgatcggtgatgttcaaggaaagacatgtatcatggtagatgatatcttgaacacaggagcaacgcttgcacgagcagcaaatgtattaaaagaaaacggcgcaaaagaagtatatgcctgtgcgtcacatggattattgtccgatcatgcgaaaagtattttagacaatgcaccaatcaaagatatttgtatcactgattctgttttcacagaagaaaatcgtcatccagaaaacttaacaatcgttacatgttcagaattaatgggtgaagcggtcaaacgcatccatgaaaatacaccgatgagtccgttattccgtctggaagaaaaagaattcgaataa

SEQ ID NO: 2649 - DNA (genomic), 678 bp, Enterococcus faecium; double-stranded, circular
  misc_feature (B) LOCATION 1...678
  hypothetical: NO
  anti-sense: NO
acaatacgtggaggtcatttcgtgaaagatcatattattccaaaggcgacagctaaaagactgcctttgtattatcgctatttaaggattttaaataatgctggaaagaaaaaagtgtcttcaactgaattaagtgaagccgttcaagtagatagtgcaacgatccgtcgagatttttcttattttggcgaattaggaaaacgtgggtatggttatgatgtagaagatcttatgcacttttttgcaaagacattaaacgacgatcaattgacaaatgttgcgctgatcggtgtagggaacttgggaagtgctttactaaaatacaaattccatcaaagtaatagcatacgtatcagttgtgcttttgatgtgaatgaggaaatcgttgggcgcatcgtagacggtatccccgtttatccaatggaagatatgtcagaacaaatcaagatccaacaaatcgaagtagcaattttaacgatacccgctgaaagagcacaagaagtagtcaatcagttaacggaagcaggaatcaaaggaatcttgaactttaccgctgctcgattgaatgctccgtcagatgtattgatccaaaatgttgatttgacgaatgaattgcaaaccttgatctatttcttgcattctgacgcaaatgcgcattccgaaaatacagcagaataa

SEQ ID NO: 2650 - DNA (genomic), 1053 bp, Enterococcus faecium; double-stranded, circular
  misc_feature (B) LOCATION 1...1053
  hypothetical: NO
  anti-sense: NO
aaaaaacgtggcagccaaatgcctgaaccttctatttcagtgactcctatccccaacactgaattaaaaaaaatcacattgaagaacgacgaattgaccgtcgttcttctaaattatggcgctagacttcaccaaatctttgctccagataacaaaggacatttagaaaacgtcttactttcttatgatgaactttcagatgttttaaccgatgaaagtttctttggagccacagtcggtcccgtagcaggcagaatccgaaatgctacatggggaaatcatcaacttgaaaaaaacgccggcaaccaccatatccacggaggaacaaatggatggtctttccaatattgggatgtcgaagtgttcaaaaatccacagtcgatcggcgttgtcttttatttacaagacactttttccgattatcctggtcctatcacagcaacgatcacgtatcagctaactgcgaatagcctggaaatgatcacaaaaacgaacagtcccgtcgagacgatctgcaatccaaccaatcatgcctatttcaacctttctgggaatggtaaacgcgacattgatacacatgaactggctgtccaagcagaaagtctattggtattagatgaagataaactaccaacaggcgaacaaatcactcaagcggatttaccgatcaatttcaagaaaccacatacaatcgaagaaattctcaacgcttatccagaaggacttgatgacgtttttgttcttactacaccgaaacgttcaaaaaaggtgctgtgtctttcagaaaaacaatctggacgccagttgtctatagcaacaacaaatagaagtgtggtattattttctacgactggttttgaagctgattttatgatcaacgggaaacatatgcattcaaactatggtttagccatcgagccacaagaatttccggatctagtccatttacctgaactcggttcgatcgctttgtaccctggtcaagaaaaggtcaaccatacgacctatcagtttactattttaccgaatgaacagatagaaaatactgaatag

SEQ ID NO: 2651 - DNA (genomic), 564 bp, Enterococcus faecium; double-stranded, circular
  misc_feature (B) LOCATION 1...564
  hypothetical: NO
  anti-sense: NO
gaaaagcgtggtaatcttttttggactatattcctcaaaagattaccttttgcggtattttatcgaaaaaaggagacgttacacatggtagagaaagtttatccaatgactctagaaggtaaagaaaaattagaaaaagaattagaagaactaaaaacagttaaacgcggagaaatcattgaacgaatcaaaatcgctcgcggtttcggagatctttccgaaaactccgaatacgaatcagctaaagatgaacaagcatttgttgaaggaagaatcacaacaattgaaaatatgatccgttttgcacaaatcatcgataatgacggcgtagatgcagatgaggtatcgatcggtaaaacagttacgttcatcgagttgcctgatggagatgaagaagagtacacgattgtcggaagtgctgaagcagacccgttttctggaaagatttccaatgattctcctatcgcgcaagcattgattggcaaacgtaaaaatgatgaagtaaccattgctacaccaggtggcgatatgttagttaaaatcgtcaaagtagaacaagcgtag

SEQ ID NO: 2652 - DNA (genomic), 911 bp, Enterococcus faecium; double-stranded, circular
  misc_feature (B) LOCATION 1...911
  hypothetical: NO
  anti-sense: NO
aagaaaagtggcatgaccatggataatccagagatctccgtcgtaccagttccagagactgaaataaagaaaatcacattgaagaacgactacttagaagtcgttcttctcaattacggtgcccgcctgcaccaaatcttcgcaccagacaaagaaggaaaatcagaaaatgttttattgtcttacgatcgtttcgaagatgttctaacagacaaaagcttttttggagcaactgtcggacctgtagccggaaggatccgggatgcttcttggggtgagcatagattggagaaaaactgcggatcacaccatatccacggtggcacgaaaggctggtctttccaattttgggaagtagaagttttcaaaactccatcatcaataggtgtggtcttttacttaaaagatgaattttctacctatccaggaccaatcactgctacgatcacttaccgtttaacaaaaaacgaattagagatgacaacctctgctagtagccttgttgaaaccatctgcaatccgaccaaccatgcctacttcaacctttcaggaaatggaacaagagacatttatgaacatcagttaacggtctttttagatggtgtgcttgaattagatcaagaaaaactgcctactggaaattggacaaaaaaagaaaaactgccaatcgactttagaaaatccccaacactgcaagagatccttgcatgttatccagatggactagatgatgtatttcttttgcatcatcctaggctttccaaaacttccttacaattattcgagaagcattctggtcgccaaatgactatagcaacttctaataaaagtatggtattattttctacgactggattcgaagctgatttcttctgtcaantggacgtcttccaccatccgcagttctgcat

SEQ ID NO: 2653 - DNA (genomic), 402 bp, Enterococcus faecium; double-stranded, circular
  misc_feature (B) LOCATION 1...402
  hypothetical: NO
  anti-sense: NO
ggaggaagtggaatgaggaaagccctgaaacaactcatatctgagaaagaaagcgaactcaaaaatttagaagatagtttgggattggggtttccaattgttgagcaagctaaaatgactcaaatcagtcatctacgacttgaatcggaagatttaagacaaatagaaaaatcaattcaactcaacgacaaccagaaaatcgtgttggagtggttgaaaagcgagacaattttaactagagaagcaccaatattatctgttaatgctttttctgataaaaatttactaggaaaattacctgataaagtacgcaaagcttataaactattggcttgtaaacaagaatatgaagtcctagcagcattcgctcaatggggattagaacaggaggaagtgggatga

SEQ ID NO: 2654 - DNA (genomic), 1941 bp, Enterococcus faecium; double-stranded, circular
  misc_feature (B) LOCATION 1...1941
  hypothetical: NO
  anti-sense: NO
gctgagggtgggactgaatccagttccgtcctcggtttttttgcggttgagttaaggttattcaaattaatattttttgagtataattacgttgtcaggctggattgtttttttgacagacatgctataataactttaattgaatatgaaggggagtaccagatgaacgaacgaatcaaaaacaaattagctttacttcctgatcagcccggctgttacttgatgaaagataaaaatggaacgatcatttatgtcggcaaagccaaaatattaaaaaatcgtgtccgctcatattttactggcagccataatacgaaaacggaacggcttgttagtgaaatcgaagactttgaatacatcgttacagaatcgaatatcgaagcattgctcttagagatcaatctgataaagaaaaatgatcctaaatacaacattatgttaaaggatgataaaacctatcctttccttaagataacgaatgaaaaatatccccgtttggtgattactcgtaaagtactaaaagacaaagcactgtattttggaccatatcccgatgtcggtgcggcgaatgagacaaagaagatcctcgatcgattatttcctctgagaaaatgcaaacctagtcagacgaaggagccttgtctttactatcatttgggacaatgtctgtgtccttattatttcgacgtagatccgaaagtctatacgaaaatcgttgatgaagtgaaaaagtttttaaacggaggacacgaaaaaatcgagtcagagatccatcagaaaatggaaaaagctgctgaaaacatggagtttgaaaaagctgcagaataccgagaccagatccgtgccattgagacaatcatgactcgccaaaaaatgacaaatactgatttactggatcgagatgtatttggttatgcgattgacaaaggatggatgtgtgtccaagtgtttttcgtaagacaaggagagctaattgaacgagatgtttcaatgtttcctttctataacgaagcagaagaagatttcttgacttacctcggtcagttttatcaggaaaatgagcatttcattcctaaagaagtcttgattcctgatacgatcgacaagcccagtgtagaagctttgttagctacgaaagtgctgcaaccaaaacgaggagaaaagaaaaaattagttgaattggcgaataagaatgcctcagttgctttgaatgaacggtttgatctgattgccagaaaacaggaacggacgatcggagcagttgaacgtttaggaaacgcgatgaatatcccgaccccaatacgtatcgagtcttttgataactctaatatcatggggacgaatcctgtggctgcgatggtcgtattcattgatggaaaaccggcaagaaaagaatatcggaaatataaaataaaaacagtcaacggaccggatgattatgcatcaatgagagaagtcatctatcgcagatattcacgagtgattcgcgaagggttgcctttacctgatttgatcttgatcgatggaggaaaaggacaagtagatgtggcaaaagatgtcttagaaaatcaattaggaatcgatattcctattgctggcatggcaaaaaacgataaacataaaacaaatgagttgctattcggtatagatttggctgtagtaccgcttgagcgaaattcaccagagtttttcttactccagcgaatccaagatgaagtccatcgattcgcaatcactttccatcggcagctacgcagtaaaaacagttttgcttcccgattagatgaaattgaagggttaggaccaaaacgaaaaaaaatgctgcttaaagagttcaaatcgttgaaaaatatcacagcagccacgacagaagaattacaagaaatcggactgccgaaaaatgtcgcacaaaacgtatttgataaattacatcaggaatga

SEQ ID NO: 2655 - DNA (genomic), 1305 bp, Enterococcus faecium; double-stranded, circular
  misc_feature (B) LOCATION 1...1305
  hypothetical: NO
  anti-sense: NO
aaaaatatcggcgtattagaacaaactttccaaagtttcggtgtcgatgccaaggtcgtcaaagccagcttaggaccatccgtcacaaaattcgaagtccagccggctgtaggggtaaaagtaagtaaaattgtgaacttaacagatgatatcgcgcttgctttagcggcgaaagatgtccggatggaagcaccgattccaggtaaatcactgattggtattgaagtaccaaatggaaagatcagtatggtttcctttagagaaatcatcgaagcacaaccaaaccacccagataaattactagaagtacctttaggacgtgatgtttctggacgggtacaaacggctgatctttcgaagatgcctcacttactcgtggctggttcgactggtagtgggaagtcagtagcaattaatgggattatcacaagtatattaatgcgtgctaagccccatgaagtaaaactgatgatgatcgatccgaaaatggttgaattgaatatgtacaacggcatacctcatctgttgacgccggtcgtgacgaaccctagaaaagcagcgcaagccttacaaaaagtagtacaagaaatggaagaacgatatgaaaaattcgcggcaaccggagtaagaaatatttctggttacaatgaatttgttcaacagaaaaacttggaaaacggaacgaaacatccaaccttaccattcatcgtagtgatcgtagatgaattagctgatttgatgatggtagccagcaatgaagttgaagatgcgattattcgtttagcgcaaatggctcgggcagcggggattcatatgatcctagctactcaacgtccaagtgtggatgttatcacaggaatcatcaaagcaaatgtaccttccagaatggcatttgcggtatcaagcggtacagattctcggacgatcattgattctaatggggcagaaaagctcttagggcgaggagatatgctattcttgccaatgggtgagaataaaccgatccgtgtgcaaggagcattcatttctgaccacgaagtagaacgggtcgttcaatttgttacagatcagcaagaagctcattatgaagagaaaatgatgccgacagatgaagttgaaacgacaggtggtccagaacagccacaagatgagctgtttgaagaagcaaaagcactcgtcgttgaaatgcaaacggcaagtatttcctttctccaaagaagatttcggatcggttacaaccgagcagcacgtttagtagatgaactggaagctcatggagttgttggcccgtcagaggcaagcaag

SEQ ID NO: 2656 - DNA (genomic), 759 bp, Enterococcus faecium; double-stranded, circular
  misc_feature (B) LOCATION 1...759
  hypothetical: NO
  anti-sense: NO
cagataatcgggcatttcccctgtttttctcggcattttcctctacgtctattcgtcttttcgtcagaacaagtgcgtctagtggtttcagatttctatacaccctatcgcacattggtgaaagagtgttttccgaatgcccgaatcgtcgccgatcgctttcatattagccaacacattggtcgggcttttaccaaccaccgaattcaagtaatgaagacctttaaaaaaggggatcgtcggtcgaagcacttaaagaaatactggaaactacttcaaaagaatgcgtgggaattgaaaggtcagcatcgctactggcgtccgtcatttcgagatcatctgacagaagcagagatagtcgatcggctattatcttatgatgattccttaaagcgaggctacgaagtctaccaggattttctttccgttatcagaagacaagatgttcctgaattcgtcgcgctcctaaaagaagactacaaggagttgccagagcactaccaaccagtgttcacgaccttcaagaaataccaaacagaaatcaaacgagcgttgcgcgttccctattccaacggccctatagaatgtttgaataaccatatcaaagtactaaaacgaattgcctatggctatagaaactttcaaaactaccgagaacgaatctttttatatcgaggaaaatattttaagaaaactaagaatactacccaactgactaaagccagaacaacaacacggctagacaagatagctgtctag

SEQ ID NO: 2657 - DNA (genomic), 954 bp, Enterococcus faecium; double-stranded, circular
  misc_feature (B) LOCATION 1...954
  hypothetical: NO
  anti-sense: NO
cgggtaatcggcaccgccgagaatagtacgttccaccatcaaggccaggtgcatcgtcaagttgaatttcatcttggcattcagctgcagaccgaagcggcgttcacacttgtcggtggtgtcttccacctgacgaatgatcacgtcagggttgagaaattccagtttctccgaaaggccttctttggagaagaagtggatgaattcattcagcatcggtttgacgttgttgggatggatcaagtgatggaaggactgctccaattgttgttcagcattgtcatccagcacgtccaacagattcaatgttggtacagcgacgtcggtatccaagtaggaagtggtcaggatcaaggaagtctccttcaagtattccgtttcgtcggcggcgcggtcgatggcggcgctgagttcgttgtaattcagaatgatcagcttgatatccggcttcacgtattgttggcagatgccccgcagtttcttggaaacgtcccggccggaaatgctggagatgatgatgtttttctccacggagaagccttcaaaatattggacgttggtgacgaagttttcttccgctgccttggcgatggtgtggaaacggctgccgttcaacagctgttggccgatctccaaagcgaaggaggtggtgaggttgttgattaccaaaagttctcccataatctggggcttcaagctcttgtaaagctgggtcagagagcccatatccaccagcatgatcacgccgtcaccggtctcccgttccgagagccagttcttcacctgagccacgatatcatggaccgaggaggtgaggggcatattgatggcgtcgaaaaggtactcgccgcacattttgttggcgaccccttggatactggaggcggtgcgctccccgtgagccaccaagagggcgtgatagcggatctcttcattgacagaacctatgagtag

SEQ ID NO: 2658 - DNA (genomic), 228 bp, Enterococcus faecium; double-stranded, circular
  misc_feature (B) LOCATION 1...228
  hypothetical: NO
  anti-sense: NO
aggatttccggcacaaatggcacagcattcgcgaaaatagtgtgttcattttgccatactttctcaaaagttgctcgagtcctgcgttgcagtgtcggatcattcatcaataagattttttctggtacagctctaagggatggagaatctccagtgaaaaagtggtgtgtctctccagaatttgtagacttcgattctatcagaaaagccttatcggccaaatcatag

SEQ ID NO: 2659 - DNA (genomic), 210 bp, Enterococcus faecium; double-stranded, circular
  misc_feature (B) LOCATION 1...210
  hypothetical: NO
  anti-sense: NO
ttccgtcccggtcaaagccaggtttccttcttcaaaaatcccgatttgttttgcgatagcaacagctgttgttttgtggtcaccagtaatcatgattgttttgattcctgcacttcttgcttctgttaccgcctgagtcacttcagcacgtggaggatcgatcatagcaagcaaaccaacaaggatcaaatcgtcttcatcttcaaatga

SEQ ID NO: 2660 - DNA (genomic), 225 bp, Enterococcus faecium; double-stranded, circular
  misc_feature (B) LOCATION 1...225
  hypothetical: NO
  anti-sense: NO
accagtgccgggaagatgccgccaaaggccgtgacgcgccggagaaccccccgcgcggaccgaagtggaacgaataaactgtcccgaaaccctttccacacggggtgggtgtcaattgcggtgcctgtggaatttaaatctcgcggccctattattcaaattaacgggcaaaaacggcctggcgtttacatggccaaaccttccccggttctaataggttccccc

SEQ ID NO: 2661 - DNA (genomic), 429 bp, Enterococcus faecium; double-stranded, circular
  misc_feature (B) LOCATION 1...429
  hypothetical: NO
  anti-sense: NO
cccggagccggcctgcatctgtacggaacagtgcgccgccggcgaggtcaacaccgcgtgcccggtctgcacctgacccggaaagactgtaccggaaaagcccccgtgaccgacacggaaaccgaacccgacgaaaagccggaaaaaacgaaaagcggcggttccggcacactgattttagtgctgcttgtggcgctggcggctggcggcgctggctactacttcaaaatttacaagcccaaaaaggatttggacgatgcagaggactttgacgaactgaccggcggggacgaggaggaaacggtcaacgaggacgaggatgtggacgcgcaggaagaaacccggcagacgggcgatgaggaaccggcagcctatgacgagccggaggaaccggactatcctgaaaactatggcggggaggacgactga

SEQ ID NO: 2662 - DNA (genomic), 192 bp, Enterococcus faecium; double-stranded, circular
  misc_feature (B) LOCATION 1...192
  hypothetical: NO
  anti-sense: NO
agtggggccggcgctatttatcagtctgctgattatcacgttgtcgtttatcccgatcttcaccctggaagggcaggaagggcgtctgtttggcccgttggcgttcaccaaaacgtatgcgatggcgggtgcggcgctgctggcgatcgtagtgatcccgatcctgatggggcactggatccgcattcagcc

SEQ ID NO: 2663 - DNA (genomic), 658 bp, Enterococcus faecium; double-stranded, circular
  misc_feature (B) LOCATION 1...658
  hypothetical: NO
  anti-sense: NO
cgaggatacgggtgtggccatggtggtctaagattactccaatccttgggtgcttctttagaagggtacacagaaggaaatcctttattatctactaaaaaacttcattttgatcgaagaaacgttcttgtttctaaagtaaaattgattatcgctgcagatgttaccaatccatatacaggtcaacaaggagctgcttggcaatttggaagacaaaaaggaggaatagatacgacgctagctttcttagataaacaagcaggaaagattgctcagcaaataaaagatttctgggaggtggatttagatgatattccaggaagtggagcagcaggcggtattggtggagccctttttttgttgggagcgaagatggtttctggtttcgatttagtcagccaaatcactggattggaaaaaaagatcgaacaagcagatgtcatcattacaggagaagggcggatcgatcagcaaacgatccacggaaaagttccatacggtgtagcagtgcttgcaaaaaaatatcgaaaaccaataatcgctatttgcggaagtagagaccaagagctagaaggactttctgattttctcccaattgtcttaagtattcatttgggtccaataggtttagaagaagcaatggaacacaggcaaacat

SEQ ID NO: 2664 - DNA (genomic), 690 bp, Enterococcus faecium; double-stranded, circular
  misc_feature (B) LOCATION 1...690
  hypothetical: NO
  anti-sense: NO
ggaggaaacggaatgctacgtacacaatttgaagaagaattgctgaatctccataatcagttctacgaaatggggatgatggtgagcagcgccgtgcacaagtcagttcgtgcatacatcaaacacgataaaatcttagcccaagaagttatcgaaaacgatataaatatcaataacatggaaacacgcttggagaagaaaagttttgaaatgatcgcattgcaacagccagttacaactgatttgcgtatgatcattacggtcatgaaagctagctcggatttagaacgtatggccgatcatgcggtgtctgttgctaaatccacgattcgcgtaaaagggcagacgagaataccggaaatcgaaaaagagatctccgatatgtccgattatgtgaaaaaaatggtggacaacgtcctagttgcttatgtcaaaacagacgaaaaagacgcacgtacgatcgccaatatggatcaaagagtcaatgactatttcaatcgaatctataatgcaacaatcaaaaatatgcaggaaaatcctgagacagtcatcagtggaacagactacttgaatgttgccagttatctagaacggatcggagactatgtgacaaacatctgtgaatggatcgtctacttggctacagggaaaatcactgagttaaatacgaaccacaatgagattttctaa

SEQ ID NO: 2665 - DNA (genomic), 1464 bp, Enterococcus faecium; double-stranded, circular
  misc_feature (B) LOCATION 1...1464
  hypothetical: NO
  anti-sense: NO
aaaatgaacggactatcaagttggatggagaaatacatcctgccggttgccgcaaaaatcggagcgcaaaaacatttagttgctttgcgtgatgcttttatcggcacactgcccgcaacaatggcgggatcagtcgctgtaatgatcaatgcaattattcgtgatttaccgcaacagtttaacagtacctatgctgacagtttagcagcagacaaaggaatctttgccgtattgaatgtcatcatcggaatcaatggttttgtctggaacggtacactagcaatcgccggattgatctttgccttttcttgggggtataatcttgcccgagcttatggagtaaatgatctagctggggggatcgttggtttagctaccttgattcaaggtatttcctttggtccagcattatcagcagcattagatgtgaatgttccttcaaatgtcgcagatgcaatcaatagttctgagattggtgcaacgattgcagatggcacactgtcagttggattatggggttggctaaaactagatcatttgaatggaaacgcttattttacagttatgatcatgggagctatttcagtcattattttttgtaaattgatgcttgccaacattacgatcaaaatgcctgattcagtaccaccagcagtatctaaagcatttgcagccattttaccagcgacgatcgctttatacgtcattgctattatcaattatatcgtaggtcgtgtagctgatgggcaactgatcattgatttggtgcaaaaatatattgcagaaccattcctaggattatctcaagggttgggagcagtattgatcgtcacagtatttgttcaagtattctggttctttggtattcatggaccaaatgtattggcaccagtgctagagggaatctggggacaagcacaactaatcaatattgatattttccaaaaaggttataacggaaaaactggtacaccagccgtgttagatgcaatcgaagatggaaaagcttatatgtgggtccgcggatcgttcgatgcttttgcatggtttggcggatcaggcggaacgatcgtcttactgatagctatcttgattttctctaaacgtgcagattatctaacagtagctaaattatccattgggcctggtatcttcaatatcaacgaaccagtgatgtttggtctgccaatcgtattgaatgcaatcatgtttatcccattcttgattgctccagtagtagcaacagcaattggatggacagctacttatcttggcctagtcgctccggtatcgcagcaagtcacatgggtagtaccgccgttcttattgtcattcttagcaacaggagcggattggcgggcaccgatcgtaacattagtatgtatggtcgtgactttcttgatttgggcaccatttgtcatctctgcaaacaaaatggaccctgccgcaggcgaacaacaataa

SEQ ID NO: 2666 - DNA (genomic), 849 bp, Enterococcus faecium; double-stranded, circular
  misc_feature (B) LOCATION 1...849
  hypothetical: NO
  anti-sense: NO
ataacagacgggaacgcacggtttgtgcgctccctttttttaagcaaaacaagaaaaaccagtcttagagtgtcgaaatcatctaagtatggtaaaatggcaatagaaaatattggaggaatgaacatggtcacaccgaaatatcagcgtgtagtcttaaaattgagtggagaagctttagctggggacgcaggatttggaatcaaaccaccagtaatcaaagaaatcatccaagaaatcaaagaagttcacgagctgggcgttgaaatggcaatcgttgtgggcggcggaaatatctggcgcggacaaatcggagcacaaatgggcatggaacgtgctcaagctgattacatgggtattttagntacagttatgaatgccttagctttacaggatacgttggaaaacgtgggtgtaccgacacgcgtgcaaacttcgattgaaatgcgtcaaatcgcagagccatatattcgccgtaaagcagaacgtcatttagaaaaaggacggatcgttatctttgcaggcggtaccggcaacccgtacttctcgacagacacaacagcagcattacgcgcggcagaaatcggcgcagatgttatcctgatggctaaaaacaatgtagacggtgtttattctgctgatccgaaagtagatgcaaatgcagtaaaatttgaagaactgactcatctggaagttattgccaaaggattacaagtcatggattcaactgcaagttcactaagcatggataatgatattccactgcttgtcttcaatttaaatgaacacggaaatattcgccgtgcaatcttaggcgaaaatatcggaacaactgtaagggggaaataa

SEQ ID NO: 2667 - DNA (genomic), 711 bp, Enterococcus faecium; double-stranded, circular
  misc_feature (B) LOCATION 1...711
  hypothetical: NO
  anti-sense: NO
cgaaaagacggggatgcggaccgaaacaactctatcggtttcatttttcaaagttacaacttgattggtcatctaggcattattgaaaacgttgaacttgggatgacattaagtggtgtttctaaagacgaaaaacgaaaacgggcagaagatgcattgcaccgagtcggcttgacaaatcatatgcataaaaagccaaatcagttatctggtggacaaatgcagcgagtggccatcgctcgagcactagccaatgacccagatatccttttgtgcgatgaaccaaccggagcgttagatacagaaacaagtatccagatcatggaattgatccaagagttatcgaaagaaaaattagtgatcatggtcacacataatcctgaactggcccatcaatacgcagatcgaatcattgaattttctgatggtaagatcttaacagattcccatcctcacatcgaacgaccaaaagatgatcaatttaacttacgcagaacaaagatgagtttttggacagcgttaaagctttccttcaacaatatccgaacaaaaaaaggacgtactttcttgacctcctttgcttccagtattgggatcatcggaatcgcgatcgttctgtccctttcttctggattccaaaaacaaatcgataacacgcaagctgaaacgatggcgaaatttccgattactatttctaaggtaacgaactaa

SEQ ID NO: 2668 - DNA (genomic), 393 bp, Enterococcus faecium; double-stranded, circular
  misc_feature (B) LOCATION 1...393
  hypothetical: NO
  anti-sense: NO
aaactggacggatccggtattaaatatactaaaaaaagagaagcattgttaacttatttagtgaagcgtaaccgctacgtatctgctaaagaagtttttgactatatgaatcaggaattcaaaggggtaagttatgatacgatttaccggaatctccatgattttgcagagatcgatttactggaagaaaccgatttaaatggtgaaatgaagtttcgttttcattgctgtcagggggaaatcggccatcaccatcattttatctgtacagtgtgcggaacaacgaaagaaatccatatgtgtccaatgaattatttcgaagaacagctaggtggatgcacgatcgaagggcatagattcgagattttcggaagatgtgaaaattgtcaataa

SEQ ID NO: 2669 - DNA (genomic), 825 bp, Enterococcus faecium; double-stranded, circular
  misc_feature (B) LOCATION 1...825
  hypothetical: NO
  anti-sense: NO
agcttttgcggtatgatagtagaaaaaaggaggctccctatgcagtattatgatcagcatctccacacgtatttttcctttgattcagaggaaaaatttgaaaactatttagcctatcagccggagtttttcgtttctacggatcactttgatttaaacaatccatctaccggaaaagatgacattccggattatccagcctatataaacaaactggactctttaaaagaaacctattccaccaaatttctgcgaggtatcgagattggcgttgttccaggacaagaagagcggatcgtggattacctcgctcagcatccttatgatttaaagctggtaagtattcatcaaaatggccgctttgattatatggacgatgtggttttaaccaaagatcccattcaaactaccaaggaatattttgatcagatgttgcaggtcttgacggattttccagaaggagatattttgactcactttgattatggattacgccgcttcaccttcacagcggaagaattcgcggagcattttgaggctcagctgctaacgattttcaaaaaggttgttgaacgagaattggcgatggagttaaatgccaagagcttcttgaaatacggcaacgaagacctttaccgttatgccgttcctttgtatcaaagtgtcggcggaaagctctttaccttaggctcggatgctcatgttgccgaagattatcagctgggctttaaaaaaatgagtcagctgttggcagactgtcaggtagaaaagttgctagtcattcaaggaaaagaacgccgcctgacgccgctgccgattttgtga

SEQ ID NO: 2670 - DNA (genomic), 761 bp, Enterococcus faecium; double-stranded, circular
  misc_feature (B) LOCATION 1...761
  hypothetical: NO
  anti-sense: NO
ggcaggcgcggtgcggtcgaaacactcaatatagcgggatttctcatacactttcccatcatggccgttggcgcagacatagacggtgcagttctccgaaaggtcgatttccccataccagcggttttcgttttgcttcaagctgtccgtcacatcccgccattgcccgtttttctcgattttcacctgcaccagcgcaaagccgttcccggcttcatcggtaatgcgaaactcggcggcagcactgccggttgcccagccggagggcggtgtaattttgatggagagattggatgcagggattggcgcgggggctttgccggtgcatccggccaggtcggttctgcagatcgggcagtcggcgttgaccgcaccaagttcacagcggttttcgcagacgcagaccgggacgggcgtgggggcttccacaatacagtctgccaggttcaacaggcaggcggggcagtcggcgttgaccgcgccgggttcacagtgggcggcgcagatacagaccagtttggcaggcggttccggctctttgccggtacagccggttacatcctgcgtacagatgggacaatccgtgtcaggtgcgtctgccgcacaccgcgtttcacaagtacagacgggttccggctccgcgccaatgcaggcggctgcctcctgcacacagatggggcagtctgcgttgagggtgtccgccgtgcagcgaatatcgcagaaacaggcaattccgatctggcctcttcacaacgagttgc

SEQ ID NO: 2671 - DNA (genomic), 354 bp, Enterococcus faecium; double-stranded, circular
  misc_feature (B) LOCATION 1...354
  hypothetical: NO
  anti-sense: NO
ctttttagcgggttaaagctgccttccatgataaattccggtaacggaatatgtggtatagaaatattcaaattatcaaaaatgccactgattttgtctctaatccaatcaattggagcgctaacagtctttttgatgccttcccatatgttagcaattgtacttttaacattattgaatatgtcggaaacaatacctgttagattggaccaaccgcttgaaattgcattttttccatcgtttactttagagctaatagtgcttgtaattccattccaaagattcaaagcagtatttttgataccgttccaaattccggtaatccacgaagatatactattccaaacactttga

SEQ ID NO: 2672 - DNA (genomic), 186 bp, Enterococcus faecium; double-stranded, circular
  misc_feature (B) LOCATION 1...186
  hypothetical: NO
  anti-sense: NO
aaacacagcggaggaaggtcttttaatttactttccaaaagggaacttggtgaacaaacggcggaattcaaacgtgggggcaatatgcgggataaccaaaaaaagttcgcaaagcgatggtaccatggactgaagattcaaaaggaatcccattattcgaagctgctgaataagcattatagataa

SEQ ID NO: 2673 - DNA (genomic), 357 bp, Enterococcus faecium; double-stranded, circular
  misc_feature (B) LOCATION 1...357
  hypothetical: NO
  anti-sense: NO
agcaacagcggatgctgcagcattgttggtgaatggaacagtggaagaggtggtagaaagatgaaactaaaagacggattttacgctagcagtcacggtatcggcggtttaatgctagatatgccgacaaagaaccctaaaacacgcaagaaatcaaaattcaaagtcggtgacatggtccgctgtgaagcagaagagttcgtttatccgttcagaggatacgttaaaaagatactgtcaaactcagcaatcattcgtattgaaaatacaatgaagtgtgatcgttcgactgcaaaacacaagcattatttagctgtagcgagattagttgacatggaagtaatcaagagcaaataa

SEQ ID NO: 2674 - DNA (genomic), 1137 bp, Enterococcus faecium; double-stranded, circular
  misc_feature (B) LOCATION 1...1137
  hypothetical: NO
  anti-sense: NO
aagaatggcgggatatccatgaatgaacagacgaaggaatggtcaagaaaaattttgaatgtagcttctgaaaagatagatgcggaattagacagaatggggaataaaattccatatatttcttacaacggaaaatatacagacgtaataaaggacagaggaatcgactggtggaccaatggtttttggagtggtattttatggcagctctttcacaagacaaaacgagaaaagttcaaagaggcagcaatacaacaagaacaattattagaatctgccctgtaccatttttcagacgttcatcatgatgtaggttttttattcttaccatcggctattgcacattatcaacagtctcaaaacaaacatagtcgacaactagggttacatgcagctacggtacttgctggacgctataatatttcagggaactatttagtagcatggaatgaccataaacctggttggatgattattgatagtatgatgaatttaccattactgtattgggcttcgagggaaactggtgatccgaggttctctaaaattgctcggcagcatgcagatacaacagctaagtatctagtgaggaaagatggatcaaccgggcatatcgcagaatttgatgcagaatcagggaaatatattcggttacttggcgggcaaggatacaatgagaattcttgttggagcagaggaaatgcatgggctttatatggattcgcgttaagttatcgttacacaaaaaatccgtactatctagctatagcagaaaagatagcagtaaattttattcagaaaatcgaaaaaactggttatattcctctcattgattttgctgtaaaagattcgaatattgataccagtgctggagtatgcgctgcatgcggtcttctggaattagcaggatatgtttcctctgtacgatcaaaaatgtatcatgaagctgctatcaatatactccaaaagacagaaaagcactatgcaaattggaatatggatgaagatgggatcattggaggcggagcagaagcataccatagagaactgacttataatgtgccactgatctattctgattatttttttattgaaggcttacttcgattagaacagtcggaattagctatttggtag

SEQ ID NO: 2675 - DNA (genomic), 1239 bp, Enterococcus faecium; double-stranded, circular
  misc_feature (B) LOCATION 1...1239
  hypothetical: NO
  anti-sense: NO
tgtcggggcggcatcttggttatnacgctatggcaatatncaanaaaaggacgatgccccatgaatgaaattactactgaaattgtgcaaactctattcactaaaggcgatttaaatgaattattccgttcgcacttagaaaaagcgataaacacactcctacggactgaattaacggcttttttagattacgaaaaatatgatcgcactggttttaattcaggtaattcgagaaacggttcttactttcgatcaatcaaaaccgaatatggtgaattaacattggaaatacctagagatcgtaatggtgagtttaaacaacaaactttaccagcctacaaaagaacaaacgatacattggaaaccactattatccatttattcgaaaaaggtgttacgatgtctgaaattgctgatttgatcgaaaaaatgtacggtcatcactatactccacaaaccatgtccaacatgactaaagttctgactgaagaagtaaatgcctttaaatccagagccttaaatgataagtatgtcgctatttttatggacgctacttacattccactaaaacgtcaaaccgtatccaaagaagcgatttatattgccattggtatacgagaagacggcactaaagaagtactgagttatgcgattgctccaactgaatcaacatacgtttggaatgagctgctacaggatattaactccagaggagttcaagaagtcttgctttttattacggacggcttaaaaggcatgaaagatactatccatcaaatttatcctaaagcaaaatatcagcattgttgtatccatgtatctcgtaacatcgctcataaagtacgtgtcaaagaccgaaaagaaatctgtgatgactttaaggctgtttatcaagctaactcaaaagaagaagcgaataccttcttatccggcatgattgagaaatggaagaaaaactatcctaaagtgacgcagtcactcatagaaaaccaagacttattaactttttatgattttccacctagcattcgtagaaccatttactcaaccaatctaatcgagtctttcaataagcaaattaaaagatacagccgtagaaaagagcagtttcaaaatgaagaatcactagaacgctttctagtcagcatttttgatacatacaatcaaaaatttctaaacagaagccataaaggttttcaacaggtaaccgatacattagtttcaatgtttactgagtaa

SEQ ID NO: 2676 - DNA (genomic), 198 bp, Enterococcus faecium; double-stranded, circular
  misc_feature (B) LOCATION 1...198
  hypothetical: NO
  anti-sense: NO
tcttttttaggagatgattttataaaattgagagtctacttgaataaaaaacaaacctgtgagtttctaggaattgataataatactttagataagtggattcgtatatataattttccagtaatcagaattgacggtatagttcgctttgacatagaggatatcaaagattttatgaatacatttaaaacaatttga

SEQ ID NO: 2677 - DNA (genomic), 309 bp, Enterococcus faecium; double-stranded, circular
  misc_feature (B) LOCATION 1...309
  hypothetical: NO
  anti-sense: NO
tcgtttttaggattcatcaataactgctctggtgtgtcacattggataatttctccatccttcataaatgcaatacgatcacctagcttgattgcttcttccatattgtgcgtaacgaaaacgatggtcgtgcccaattcttcgtgtaaggacaaaaccaattcttgtaatgagtttcttgaaatcggatctaatgcgctaaatggctcgtccatcaaaatcacatctgggcttgcagcaatagctcggatgatcccgatccgttgctgttctcctccagacaactctctaggcatacgatctcgataa

SEQ ID NO: 2678 - DNA (genomic), 183 bp, Enterococcus faecium; double-stranded, circular
  misc_feature (B) LOCATION 1...183
  hypothetical: NO
  anti-sense: NO
aggtttttaggggtttttagtcgtttttttgtgattagggaaatgttcttacggttcttttggcataaaaatcgctgctttcttattgaactacgagaaatgttagaggtgtcattgaaacaaggacatgatgcaagaaagagagcgaaagtcatgcgtcgctctctttttttgggtggatag

SEQ ID NO: 2679 - DNA (genomic), 507 bp, Enterococcus faecium; double-stranded, circular
  misc_feature (B) LOCATION 1...507
  hypothetical: NO
  anti-sense: NO
tctattttaggaggagctatcatgcataaagggatttacgcaggcttgttgggaactgtaatacttttttctgcctgtggatataaaacaaagaattctgttaaagaatcttcagcagccatttcaacaactgaggttggttcaactaaaagtacttctactacttccattactaatacttctactggtaatgtagattcgcaacatagccaatcaagtattcagtcgtttagcatttcttcaacatctgaaatgcaagaaagcactgtaccttctcttccattagaaaactctgacaaagcacttctatttcttattgcccaccgttccgaattacaaagtgacgatattgttattagcttttatcaaaaaattgatcgagattatttgttcacagcttccagcaaacaaatccgttcccaaggaggatctggaagcgttggtttttatcgagtgtcacccgaaggatcgattacgatgacagatgcaaatggaacaccattttga

SEQ ID NO: 2680 - DNA (genomic), 387 bp, Enterococcus faecium; double-stranded, circular
  misc_feature (B) LOCATION 1...387
  hypothetical: NO
  anti-sense: NO
atgattttaggaggagaagacatgtattgtagaaaatgtggtaaagaaataacaaatgaaagtaagtattgccagttttgcggagcattacaagaaacagatgagacaaccggaacagacacagtaaagaaaagtactgagcagacaattaatgaaatgaaggaacaaatcgtacatggacaagagacagggaagctgtatttgattattggttggatttctatggtagtatcattagcatttattcctgtggtatttggtgctgttgctgttattatgggttacttatatcgagagaaagatgaacaaatgggtacgattttgatgatagcaggggtagctggagccatctttggtgtactattggggatgtcaatgagttactga

SEQ ID NO: 2681 - DNA (genomic), 741 bp, Enterococcus faecium; double-stranded, circular
  misc_feature (B) LOCATION 1...741
  hypothetical: NO
  anti-sense: NO
tctactttagggggaataaaaatgaaaccaatcatcggcattgccgggaatcaactgattcgagcgacagatactttccaaggaaatcaagtaagctatacaccgcacggatttgtggatgcagttttagatgctcaaggattacctcttattctgccagtcatgtctccagattcagcgcctcaactaattgagaaaatcgacaaactcattcttgcaggcggtcaggatgttagtccgcaactttacatggaagaccctcatccaaaactgacggaaacaaatattcaacgagaccaattcgaacaggcattgatcttggaagcattgaaacaaagaaaaccgatttttgcagtctgccgaggacttcaactattgaatgtcgtgttggagggaacactttatcaagatctttcattatatccaaaatggtccgtaaaacacgaacaacagcccactgccccgcagtttgcaactcacgaagtcaaaatcgtttcggacagtttattaagtgaccttctccctgattcatactttgtgaattcctatcatcatcaggcagtcaaagatctttctcctttgttaaaagccatcgccttttccaacgatggactcattgaagcagtccaaagtaaagataatatgcacaaaatccttggtgtccaatggcatccggaactttctcatcgtgtagattcatctgaacagcgtttattcgatttctttgtgaatgaattttaa

SEQ ID NO: 2682 - DNA (genomic), 1005 bp, Enterococcus faecium; double-stranded, circular
  misc_feature (B) LOCATION 1...1005
  hypothetical: NO
  anti-sense: NO
gaaaacattttctctttcgcgtatttcataatagagtcaaggaggtcattggttatgtctatctacacatgcacgatgaatttggcaattgatctatttattgaaacagaggagatgcatccttttatggtaaaccgtacaaaggaggatggcattcaggcaaacggaaaaggggtgaatgtatcactagtattaaagatgctagatttcccaagtacggcattaggtttttctgctggtttcacaggaaaatatatagaagactatttacagaagaaacaaatccaaacagagtttattgaagtgcctggtatgacgcgtatcaatgtatttacacaagtcaatcaaacgagagaagaatacaaattagtgaatcaaggacctgaaataccgcaggcagctgtccataattttttaaatcaaataagagcattacaagcagaggattatctttgtgtttctgggagtttaccaagaggaatgtctccaaaggttttagtagaaatcagtcggatttgtcaggaaaaggggattcatttgattattgatagtagtgatcaagaggtcatggattgtttgccctatcgaccatttttgctgaaaccgaatgaggaagaactttcttcttggttcggacgaaaaatggttacagatgaagattactttgtttatggacaacgactagtagagtcaggtgcagaaaatgttttgttatccctcggtgagaaaggagcgattctttttacgaaagacagggtgattcggggaaactcgccaaaaggaaaagtcgtcaatacagcatgtgcaggtgatgccatgttaggcacttttttagcaggatacatgaatcgacgaccgcttgatgaaacgttacgtaaaagcatagcagcaggcagctctactgattttcgtaaaggactgactgattttttagatgtggaggaattaagtaaacaaatcaaaatcaaggaagagaggttcgaaagatgggaaaatatcaactaa

SEQ ID NO: 2683 - DNA (genomic), 222 bp, Enterococcus faecium; double-stranded, circular
  misc_feature (B) LOCATION 1...222
  hypothetical: NO
  anti-sense: NO
gcagatttagggttagatgaatatcttgaaggtgatgggctttccgttgttgaatggggaaatctattagaagaagcactgccggaggattatttggaactgattttagaaaaaagtgatacagatttagaaaagcggtatgtgaaactaatctcatacggggagcaaagtgaaaccttcaaacagcgaattctagaaaaatgggctgaaaatcatgagtga

SEQ ID NO: 2684 - DNA (genomic), 291 bp, Enterococcus faecium; double-stranded, circular
  misc_feature (B) LOCATION 1...291
  hypothetical: NO
  anti-sense: NO
gatcaattaggagaaaatattacttcttatatgaatcgccgtgggcacattttacgagatgcttctgtcgactgggcaattggtgtcatgaatgacggtcatgtgatcgctgactttgactcagatttagcaggagaaggtgcacacgcagaagtcaaaatcgtggcaatcagctcgggcagacaaatccaaggaatcgatacacgagtaaccaataaagcccctcatacgatcgggcatattttgcaacacggagtgatccgagaaaaaggaacattgacctttaatggt

SEQ ID NO: 2685 - DNA (genomic), 486 bp, Enterococcus faecium; double-stranded, circular
  misc_feature (B) LOCATION 1...486
  hypothetical: NO
  anti-sense: NO
catctgttaggaggggtcaagatgaatcaagaatataagaatattttagtaggtatcgacggtagtgaacaagcacttgctgctttcaaaaaagcggtagaagtggctcgccgtaataatgggaaagtatatgtagcaaacgtaatcgatcagcaattttataactttatgggctatgcacctattgatcaaaatctagtcgatcagcaaactgaaacagccaaggaaatgatcgaagaatgtaaagaatatgggaaatctgttgattacacaaatatagaaggaattattgcatatggttctgttcgtgaatccatggcagtcaaattgccaaaaaaatatgagatcgatctaatcatggttgggcagtcaggtctaaatgcagtcgaacgctttatgacaggaagtgtagccagctacgtgatacgtcattcaccttgtgatgtcttgatcgtttctgacgaagaagaacagccaagtaattaa

SEQ ID NO: 2686 - DNA (genomic), 1587 bp, Enterococcus faecium; double-stranded, circular
  misc_feature (B) LOCATION 1...1587
  hypothetical: NO
  anti-sense: NO
aaatcgttaggatgtgaaaaaaaggtggttcaagaaaatattgtcatagaaatgcagaatattaccaaagaatttggaacattcaaggcaaatgacaacatcaatttacaagtaaaggcaggagaaattcatgcgttgcttggagaaaacggtgctggcaaatctacattgatgaacgtgctttccggattattagagccgacatcagggaaaattttgatgcgtgggaaagaagtaaagatcacaagtccgaccaaagccaaccaattagggattgggatggtccatcagcactttatgcttgttgatgcctttactgtaacagaaaacatcgtgttgggaagcgagcctagtcgcgcagggatgcttgaccataaaaaagcacgaaaagagatccaaaaagtttctgaacagtatggattgtcagtcaacccagatgcttacgttcgtgatatttcagttggaatggaacaacgggtagaaattttaaaaacactttaccgaggagcagatgtactgatttttgatgagccgacagctgtattgacccctcaagaaattgatgaattaatcgtgatcatgaaggaattagtcaaagaaggcaagtcgatcattttgattacgcataagttagatgaaatcaaagcagtagctgaccgctgtacagttatccgccgtggaaaaggaatcggtacagtcaacgttaaagacgtaacctcacaacaattagccgatatgatggttggaagaacggtttcattcaaaacgatgaaaaaagaagcgaagcctcaagaagtcgttttgtctattgaaaatctagtggtgaaagaaaatcgtggattagaagccgtgaaaaacttgaacttagaggttcgtgctggcgaagtacttggtatcgctggaatcgatggaaacgggcagtcggagttgatccaagctttgactggtttgcgaaaggcagaaagcggacatatcaagctaaaaggggaagacatcactaataaaaaaccccgaaaaatcactgaacatggtgtaggacacgtgccagaagaccgtcataaatacgggttagtcctagatatgacattatctgaaaatatcgcactacaaacctatcatcaaaaaccttacagtaaaaacggcatgctgaattattcagtaatgaatgaacatgccagagaattgatcgaagaatatgatgttcgaacaacgaatgaacttgttcccgcaaaagctttatcaggcggaaatcagcaaaaagcaattatcgctcgtgaagtcgaccgagatcctgatctgttgattgttgcaaatccaactcgtggactggatgtaggtgcgatcgaatttattcataaacgtctgatcgaacaaagggacaaatacaaagcagtgttactgatcagtttcgaattagaagaaattttaaatgtttcggatcgtattgctgttatccatgaaggagaaattgtcggtatcgttgatccgaaagaaacatctgaaaatgaattaggtctattgatggcgggctataccttagaagaagcacgaaaagagttagaaaagggggctggcgcacatgaatga

SEQ ID NO: 2687 - DNA (genomic), 1275 bp, Enterococcus faecium; double-stranded, circular
  misc_feature (B) LOCATION 1...1275
  hypothetical: NO
  anti-sense: NO
atgaacattttggtgatcggtgcaggtggtcgtgaacatgcaataagtaaaaaacttttagccagtccgaaggtggatacggtgtattgtgcgccaggaaatccggggatgacaaaagatggtatcaattgtgtcgctatcagtgagcgagatcattcagcgttaatccattttgttaagaaagaggctattgattggagtatcgttggtcctgaagttcctttgttaaatgggatcgtcgatgattttatggcggaaggattgaaaatcttcggtccgacaaaagcagcagctctgatcgaaggttcgaaaagttttgctaaacaattaatggatacttatcaaatcccgacagctaaatccagaagttttgaatgttacgaaaaagcagcagcgtatatcaaagaaaatggtgcgccaatcgtagtgaaagcggacggcttagcagctgggaaaggtgtagtcgtggctaccacagtgaaggaagcgctggatgcggcagaacaaatgttgaaccagcatcgatttggggatagtagcaaaaaaatcgtcgtagaagagtttttggcaggagaagaattctcccttttggcgtttgtccgtaataccaaggtgtatccgatggtcatttcgcaagatcataagcgggcatttgataacgataaagggccaaatacaggcggaatgggtgcttattcaccagtaccgcaaatttcaaaaaagatgattgaaaaagctgtggaagaagttttaaaaccagcggctttgggaatgaaagaactaggacgctctttcacgggtgttttatatgcgggtttgattgctacgaaggaaggaccaaaagtgatcgaattcaatgcgcgtttcggtgatcctgaaacgcaagtcgttctttctcggttgaagagtgactttgcgcaagtaatcgatgatttattagagaatcgtacagtagagttaaagtggcagcaagaaggatacaatgtaggcgttgtggttgcagctgccggttaccccgaagaatatgagacaggaatggttctaccagattttctggaagaagagctttctgtttactatgctggagtttcctcaaataacggcaaactagttggagcaggaggacgtctttatttagtagaagcatacggtgagacgatcaaagaagcacagaaaaaaatttacaccgcgttaatggataaaacgacagatggaacattttatcgtacagatattggagaaaaagctgccaatagcgaactgatcgtgaagtaa

SEQ ID NO: 2688 - DNA (genomic), 225 bp, Enterococcus faecium; double-stranded, circular
  misc_feature (B) LOCATION 1...225
  hypothetical: NO
  anti-sense: NO
caatcactaggtctggacatgcgtgtattggatatcgaagatacagagatcgaacttcgtgacatggacgatgaagacgacgatttgatcactgttgatgatttgacaaaatttgccgaacagcaaactgccaaagaattagcaaagaaagctgctgaacaagtggaagatgaaaaagacgatgtcatccaaaactttgaaaccgcagaagataatttagactaa

SEQ ID NO: 2689 - DNA (genomic), 2472 bp, Enterococcus faecium; double-stranded, circular
  misc_feature (B) LOCATION 1...2472
  hypothetical: NO
  anti-sense: NO
agtagaataggaggtcacctgatggaaaatcgacaagaagtacaagaattaactttagaagaagtgatgggtgaccgcttcggacgttattccaaatatattatccaagaacgtgcactgcctgatatccgtgatggattgaagccagtgcaacgccggatattatttgccatgaacaaagatggcaatacgtatgacaaaggattccgtaaatcagcaaaatctgtcggaaatatcatggggaattatcatcctcatggtgacagcagtatttatgaagcgatggtccgcatgagccaagactggaagttgcgggaagtactgatcgaaatgcacgggaataacgggagtatggacggtgatccacctgctgcgatgcgttatactgaagccagattatccaagttaagtggagagatgctagcagatatcgagaaagaaacagtcgatctcgtgtggaattttgatgatacagaaaaagaaccaacagtccttccagctcgatacccaaaccttctcgtcaatggatcgacaggtatatctgctggatatgcaacagaaatcccgactcataacttagctgaagtgatcgatggcacaatctatatgatcgatcatccacaagcgagccttgaaaaattgatggaatatattcctggacctgactttccaacaggagggatcttgcaaggaaaagatgaaatcaaaaaagcttatgaaacaggacgaggaaaagttattcttcgttcgaaaacaaagatagaggcaatgaagggtaataaacagcaaatcgtgatcacagaaatcccatatgaagtaaataaagcgaccttggtgaaaaaaatggatgagatccgtttgaataagaaaatcgatggaatagctgaagtacgagatgaaagtgatagaacaggtctgcaaattgtcgtcgaattgaaaaaagacgccaatgctcaaggaattttgaattatttgttcaaaaacactgagctacagatcaattacaatttcaatatggtcgctatcgaccatatgactccgcatcaagttggactgaaagacattttaagaagttatatcgagcatcgaaagcaagtcataacaaaacgtagtcaattcgatttagccaaagctcaaaaaagacagcatatcgtagaaggattgatgaaagctttatcgattctggatgaagtaatcgcaacgattcgtgaaagtaaagacaaaaaagacgccaaaaagaatttagtcgacgtctttcaatttacagaagaacaagcagaagcaattgtcacattgcaattataccgtttgacgaacacggatatcacagagcttcaaaaagaatccgaaagcttgattgcgcaaatcacagagttgaataaaatcctgtcaaatgacaaagagcttttctctgttatgaaaaaagaattgcgagaagtgaaaaaaaattattcttccgctcgtctaacgacaatcgaagacgaaatcgaagaaatcaaaattgatacgcaagtcttagtggcacaagaagacgtaattgtcagtgtgacgcgagaaggctatgtgaagcgaacaagccttcgttcttatagtgcttccaaaccagaagaaatcgggatgcgagaaggcgactacttgctatactcaggtgaattgagtacattggaccatgttcttctgatcacaaataaagcaaatgtgatctaccgccctgtccatgaactacccgatttgaaatggaaagatgctggtgagcacatttctcaaacaatctccaatctgtctgtagacgaatcgattttagctgttttcccatatcaaaaaattcaagcagagaaaacatttgtattcatcagcaagaatggattgatcaagcaaacacgaatgacagagttcgaaccatggcgcacctataagagccgtccgctcagctgtatgaagctaaaggcggaagaagatgaactgattgctgtgtatctgaaagaagatcagccaggcttagatgttttcttagtaacgcatcaaggaatgggtttgcgctatcctttaacagatgttcccgttgttggagcaaaggcagctggagtgaagtctatgaatttgaaagatggagataggattatcaacgggctgcttgtgttagcagaaggtgatacgccgatcgtaatcgttactcagcgaggagctgttaaacgcatgcttgctcaagaaatcagccaaacttcacgtgcgaagcggggagtgacggtcatgcgtgagctgaaaaaaaatccgcaccgtattatctatatgtcggaaggaagatcaaaagaaataaccttgatgaatcaaaaagggcagcagttaacgattgacccaactgatttccctataggtgatcgaacatcgaatggatcatttgcgatggatgagaaaaaaggtggagaagtcatcgaagttatcgatgctcctgagattttcatcgagtcgtaa

SEQ ID NO: 2690 - DNA (genomic), 189 bp, Enterococcus faecium; double-stranded, circular
  misc_feature (B) LOCATION 1...189
  hypothetical: NO
  anti-sense: NO
aataatgtagggaggtcctttccaatgaatgataagccaaaagaaaaagtatacgcagaacgcttagattcatctaaaaaaaatcgggaaaagattacgaaagaagcaatccaagaccacaaaaaagaaaaccctaaaacaaaagaaaacaaaaaattcaaatttacgaaaaaagaggatttactttaa

SEQ ID NO: 2691 - DNA (genomic), 198 bp, Enterococcus faecium; double-stranded, circular
  misc_feature (B) LOCATION 1...198
  hypothetical: NO
  anti-sense: NO
ggtatagtaggaaagatttggaggttcaattacatgactgagaaagaacaagtaacgaaaattgtaaagaaatacaataagagcattgcggatttatcggaaaatgctactgcaaaagagttcaaaacggtgattaaatatgtagccgatcaggccaatgaaaaacaacggaaattagttggattaaataaaaaatag

SEQ ID NO: 2692 - DNA (genomic), 426 bp, Enterococcus faecium; double-stranded, circular
  misc_feature (B) LOCATION 1...426
  hypothetical: NO
  anti-sense: NO
ttgaaagtagggaaaatgatgtttggattttttaagaaaaaagaaaaagaaccgaaaaaagttctggcaaaagaagaaaaagccctatcgccagaagcgaccgaaaagattcaatcagagattacacaattgaaacaagagatttccactacccaagataagcataaattagcgaaactttatgaacaagttggacttaaattttctgaattgtatgtgaacgatcaagccatccaatatttagaaaagagtttggaaaataaacagacgatcggagatgggtataaaaaactgatgagcctctataaccagaagcgtgcagatgctgctcgtgctggtgatgatcaagggatcgattactacatgggcaaaatggatgagatgcgacaaattgcaaaacaagtaacgatcaaaggaaacaaataa

SEQ ID NO: 2693 - DNA (genomic), 312 bp, Enterococcus faecium; double-stranded, circular
  misc_feature (B) LOCATION 1...312
  hypothetical: NO
  anti-sense: NO
aagaaagtaggcttacgcaccatgtctatcaatacatttgtttactcgcacccgatcaatgtttacattatcaagaatttaggaatcactgtagaacaattttgtgagttatatgcctacccacaaggaacggttgcaagctggataacccgacaacgtagaataaaatcattacctgcttcattcgtttatgatttaagcctggcctctagtttaaacatgtctgatgtttatgaaaagctcctgtctttagaaaaagaatatgattccttcaagattaaacatgataaaaaaataaaaaaacatatataa

SEQ ID NO: 2694 - DNA (genomic), 2415 bp, Enterococcus faecium; double-stranded, circular
  misc_feature (B) LOCATION 1...2415
  hypothetical: NO
  anti-sense: NO
gttttttcaggtaatcttagagagaaagaggtggtggaaatgatcaaacagtcaaaaatatctgtgcggcacttagtagaatttattttgcgacgtggaagtatcgacaattgtaaaaaaagtaaccatactgcattagaaggagcgagaatccaccgcaagctccaaaaagatgcgggagaaaactatgaaaaagaagtctttttaaaaacaacagttcaattagatgaatattacctgatcgttgaaggccgtgcagacggtattttcaaaagagacggtatttattatatagatgaaatcaaaacctccgaaccacgatttgaagatttagaaccagaacaagtggaacttttctttcatcaagcaagggtgtatgcctatatctatagtcaagaacatgatttacaagaaataaatctgcaattgacttacttccagacggcagaagaagtgatcacgagaaaggttgaacatcagacaagagagcagttagaaactttttttaaaaagctgactgaagattataaagaatggcttgtttttcaagaaaactggcgcactgtacgcaatgcctctttgatggctttgaaattcccccatgatgagtataggaaaggtcagcgtgaactagcggtagctgcttataaaacgatccgtacgaaacagaaattgtttgtagaagcacctaccggaacaggaaaaacaatctctacgttattccccgctttgaaagctgtaggggaagaagagggagaaaagatcttttatctaacggctaaaacaataactagacaagtagctgaagatgctatgacagcattaaaagatacaggagctgaagtaaaaagtgtcactttgacggcgaaagacaagatctgctttttagatgagacgacctgtaatccagatcagtgcccatatgccaatggttattacaatcggattaatgaaggtttatgggatcttttgaatcatgagaatcagatcactcgtgaagtcatcgaaacttatgcaagaaagcatacactttgtcctttcgaactatcattagatgtcagtatctggtgtgacgtaatcattggggattacaattatttatttgatccaactgtttatttaagacgtttttttgaagatgaaaaaaacgaggactatctgtttttgattgacgaagcacataatttggtgaatcgttcccgagagatgtattcggcagaactatcttatgaaaaaacgaaacgaagtaaggaagctataccaaaggaattcaaaaaacttcatcgccgtttcaacaaactattaaaagaatttgattcgatccgagaaatagcaaaagaagatcattgggattatcatcatcaaaaagcaccggctgaatctttagtaaaggcaggttatcaattaagcgaaaaaattaaagaatggctggcagaatttcctgagcacccatcacaagaacaattgcttccttattattttgatttgcttcattttttgaaggtcagtgaattttatgatgatcactacgaaacaacagtcgaaaaaacgtatcgcgatctgatagtaaaagagttttgtattgatccaagcttgtttcttgagcagtcgttggataaaggaaaaagcagtattcttttttctgctagtttttcaccactctcttattatcaggaaacactggggggacaaaaaagtctggcttacaaactgccgagtcctttcccagaaggaaaccagcaagttttcatcgcaaattacctagagacgacttatcgaaaaagggaacacagtctggcaaaattagtagagacgattcatgcttttgctgatggaaaggtcgggaattatttcgttttctttccttcttatcaatatttagatcttgcggtggaagcattcagacagcaatatcccgacagcaatgtgctaatccaagaaacggacatgaatgaggaagaacgcgaacgatttttaacaaaatttcaaacaaatcccgctgaaacattgattggattttgcgtacttggcgggattttttcagaaggaatcgatttgagaggggaccgattgatcggcagtatgatcgtaggtgtaggtttgccgcagatgaatcatgagcaggaactgatcaaatcatattatgatgagaaggaacaccttggatttgcttacgcttatcagcttcctggaatgaacaaagtcttgcaagctggtggtcgagtgattcgtggcatggcggatcaaggaatcgttgtattggcagatcaacgattttctagtttttcttatcgacgtttattcccacaacattggcaaacagcaagagaagtacgaagtgttggggaattggaagaaggaatacagcgtttttggttatcaaaagaagcagtaaatcaaaaaaacgaggaatga

SEQ ID NO: 2695 - DNA (genomic), 639 bp, Enterococcus faecium; double-stranded, circular
  misc_feature (B) LOCATION 1...639
  hypothetical: NO
  anti-sense: NO
gtttattcaggaggaaataaaatggctaagaaaacagtgaaagatatcgatttaaaagacaaaaaagttcttgtccgtgttgacttcaacgttcctttgaaagacggcgtgatcactgacgacactcgtatcaaagcagcattgccaacaatcaactacgttctagaacaaggcggaaaagcaatccttttctctcaccttggacgtgtaaaaacagaagaagataaagaaggaaaatctttagctccagttgcaaaacgtctaggcgaattattaggtaaagaagtaacattcgtacctgaaactcgcggagaacaattagaagaagcaatccgcaacatgaatgacggcgacgttgtcgtattcgaaaatacacgatttgaagatattgacggtaaaaaagaaagcaaaaatgatacagaactaggtaaatactgggcttcattaggcgatgtatttgttaacgatgctttcggtacagctcaccgtgcacatgcttctaacgtaggtatcgcttcaactggtatcccaacagttgctggattcttgatggaaaaagaaatcaagttcatcggtgaagcagtagaagaaccaaaacgaccaatgattgcaatcctttggtggcgcaaaagtttctga

SEQ ID NO: 2696 - DNA (genomic), 2154 bp, Enterococcus faecium; double-stranded, circular
  misc_feature (B) LOCATION 1...2154
  hypothetical: NO
  anti-sense: NO
acttactcaggggaccaccatcaaggtacttatttggcgggtgtctggtatcccgataagacacgtgtcggctggtggaaaaatggttatccagaatactttggaaaagtgatcaacgccttgaactttatcgcgatagatatttcgatcaacgatcagctgatcgacttggcttctttggaaccagaagacttttactgggaattagatatgaaaaatggtgtattatctcgtacattcacaatcactacttctactaataaagtacgcatttccttcgaacgttttctgagcattgtcaaaaaagaatcagcttatatctatttaactatagaaatgcttgaaggtagcggaacagtcaaactcgtatcaaaattggatggaaatgttcaaaacgaagacagcaactatgatgaacatttttggaatgagattgatcgtggaactatagaagaaatcggctatttgacgactaaaactattccaaacaactttgggattgaacaatttactgttactgcagcaatgcgccatttcgttaatggaaaatcagtcatccctgactatcacgaagatactttagcattacatggttgcttgtctgcagaattatctcaaggtgagacatggtcagtggaaaaagaaattatcgttcttactagtagagatattccagaagcgcagcaagcagaaaaagctgtctcagaattaacgaaccagacaaacaattatatccaagcaaaagaagagcaaacagcggcttgggcagaacgatggaagcttgccgatgtggtcatcgaaggagacgaagaagcacaacaaggtattcgattcaatttgttccaactattctctacttactacggcgaagatgaacgattgaatatcggccccaaaggattcacaggagaaaaatacggcggagccacttactgggatacagaagcgtatgctgtccctctttatcttgctttagccaaacctgaagtaactaagaatctgctgaaatatcggcataatcaactgccgcaagcaatccacaacgctcagcaacaaggattaaaaggcgcgctttatcctatggtcaccttcactggtgtcgaatgccataacgagtgggaaatcacattcgaggagattcaccgaaatggcgcgattgcctatgcaatctacaattatacgaattacaccggcgatacggaatatttgaaaaatgaaggactggaagttttagcagaaatcgcacgcttctgggcagaccgtgtccatttttcaaaacgagcaaataaatacatgatccacggtgtgaccggcccaaacgaatatgagaacaatatcaataacaattggtatacaaatacgatcgcagcttgggtcttgcgttacacgcgagaaaattatttaacttatcaaaaagaagctgctatcactatcagcgaagaagaactagccaaatggaaagatatcgcagagaacatgtacttcccagttgacgaagaattaggaatctttgtccagcatgacacattcttagataaagatctcatgcctgtatccgatattcccacaagcgatcttcctctgaatcagcattggtcttgggacaaaatccttagatcttgcttcatcaagcaggcagatgtactacaggggatttatttcttcaatgatacttttacaaaagaagaaaagcaaaaaaactttgatttctatgaaccaatgactgtccatgagtcttccctttcgccaagtatccattcgattttagcagcagaattaggaatggaaagcaaagctgtagaaatgtaccagcgaacagctcgcttggatttggataattacaataacgacacagaagacggcttgcacatcacttccatgactggtagctggttgtcgattgtccaaggatttgctcaaatgaaaactgcccatgatcagttgagattcgcaccatttctgccaaaaacttggaaagcttattctttccatatcaattatcgcggacgtttattgttcatctcagtcacagatgaacaagttactttcgagttattagaaggttctcctctagaaatttacgtctatgaacagtcttattctttagcggatcgtctagaaataacgctaagaaaggaggaagcaaatgtttaa

SEQ ID NO: 2697 - DNA (genomic), 804 bp, Enterococcus faecium; double-stranded, circular
  misc_feature (B) LOCATION 1...804
  hypothetical: NO
  anti-sense: NO
aagaaatcaggaaatgatcgtgaatgggaaaaggtttggcattcaaacaagaaagtgggtgacccgatttttgactcatgcatcgacaaaaaatttcagttgacaaatgacgggctttcacaacagttccaagaattggcacaagcgattcctcttgagtacttagaaatttcttgtgaaatcattgaatatacaaaagaggctctacaagtccagttgaatgattctgtgtatattgcattgacggatcatttgtatacggctatcgaacgtcacaaaatgggaatatttgtaccaaatgtattgctgtatgatatcaaacaactatttcctaaagagtatgccatcgggaaaaaaacagtgaagaaaatctcggataaataccacatcaagttatcagaagatgaagccggatttatcgcattgcatttagtcaatgcacaaggcattcaaagccagcaagacaatacctacctgtttactataacaatacaggatattctaaatatcgtccgctattactataagattacatttgatgaagattcagtccatttttttcgattcgtcacacacttacgtttttttctgacacgcgtcctagatggagaaaaatcagaagtgggagaagtttctgaggaattgtttcaggttattcaaaaaaaatataaggatacgtttggttgcgttgagaaaatagcagactttttagccgagacgttcaactaccagatgtccacggacgaaaaaatgtatttaacgatccatactgcgcgtttagtgcatgagaatcgttgtaaataa

SEQ ID NO: 2698 - DNA (genomic), 975 bp, Enterococcus faecium; double-stranded, circular
  misc_feature (B) LOCATION 1...975
  hypothetical: NO
  anti-sense: NO
aaaagatcagggaggatcatcatgaaaaaagtattggtgacaggatgtttaggacaaattggttcagagttgatcacacggctacgtcaagaactaggcagtgaaaatgtcattgcgacagatatacgcatgcctgaagtcattgagaaaaacgatatctttgagatcctagatgtaatggattacgaaaaaatgcgcagcatagcagaacaatatcaagtggacacattgattcatttggctgctcttttgtcagctgttgcagaagcaaaaccacaattagcctggaatttgaacgtgactgggctggtcaatgcattggaagtcgctagagaattccagctgaaattttttacgccaagttcaatcggcgcgtttggtccaaatactccaaaagatcataccccacaagatactcttcagcgtcctacaaccatgtatggggtaacgaaggtagctggagaactactatgtgattattattatgtgaaatatggcgtagatactcgtggtgtccgtttccctggattgatttcttatgcaaccttgccaggaggcggtacgacagactacgcagtcgatatttattattcagcaatcaaagaaggaaagtacactagtttcattgatcaaggtacatcaatggatatgatgtatatgccagatgcgatcgatgccattataaaactcatgaatgcagatcctgatcgattggttcatcgaaatgccttcaatatatcggcgatgtcttttgacccggaagagatcaaagcatctattcaaaaaatcataccagattttgaaatggattatgatgtggatcctgtacgtcagtcaatagcagaatcttggccaaattcactagatgtttcttgtgcgcaagaggaatggggcttttcgccgaaatacgacttagatgtgatgacaaaggatatgttggaaaaactgaaagaaaaattggtagagacggtataa

SEQ ID NO: 2699 - DNA (genomic), 2733 bp, Enterococcus faecium; double-stranded, circular
  misc_feature (B) LOCATION 1...2733
  hypothetical: NO
  anti-sense: NO
ggaggatcaggaatgaagattttaaggatcgagattgctgcttttggaaaatggcgtcaaaaaagttttgacttttattcaggcaatcagctgatctatgggggaaacgaagcaggaaaatcaacgatttatcaatttattcaagcaatattatttggtttcccttcaaaaggccgtaaaaaaaaggattatacaccaaaagacggctcagcctatggcggcaaaatatggcttaaacatcctgtatatggtgaatttgctgtcgagcgctacaagcagcaaaatcgcggaaaatcgaaggtgtggctgggggatcaagtgggaagtgatgagttactagaaaaactgatcgcacctttgacgaaagagttattccagcaggtatttactttccagcaagagcagttgatggaactagatcatttgagagaaaaagagctacatgatgcgctgatttctttaggcatcacgggcagttctcaagtattccaaaagcggcaagaatattatcagaaagcacaacaattattcaagaaaaaaggccaaaaattactaatcaatcaaaaattaaatgaatggaaagagctgcaagaaaaaattcatcaaaaacaagaacaggaagcttattttggcaagttgatccaacaagaacaggaatacgagtcgcaacagcagcagttattggcacaattaaaagaggcgaacaaacaattttcattagccagacagcaagaacttaatttttctttatatgaagaatggcaatctctcaaaaaaaacagcactacaggtcttcctgatgagcaacttcttttagatctggagtctttctccaaacggtatcagcaaacaaatgagcgtttggaagaattagaagcaacactggaaaagcatagcgggatggatcagcagtcagccagatattatttttatttagagcaggagcaggaactaaaagatctccagcaacttcaatttacagcggaacaattaaacgaagaatggcaaagattacaaattgagactagagaaacaaattcagaattgaagattttggaacaaaggtggcattggcagaaaaatccgttaccggaagaatttttatatgaagaagaatggaagcatcttctggctgaagaaagaaggattgctgatctagaaagccagatttctgtgcgtctccaaatagctaaagaacagcaagagatgattgaagcagaagtgaatgacttggaagagacctatccagcattattacaaaatcagtcagagatagcaccagtctcttcatctaaaccgtatatgctgatggctggcggagcaataatcattgcaggtatatttgtaccaatgcccttgaaagtgatccttttactaattggtgcaggcatgattggctatttcttctacaaaaggcaaccaaaaattaaaactaaaaatgatttctctgagataaaaggaatgtggcaagaaaaactaggacaacttgatctagccttagctcaattagctgaagcagaagaaaaacaaaagagaactggagaagaaaaacagattcttcagcaagaagtatatcgttttgcggatcatcggcacttaggaaagatggatacgctcaaactcatgaaagaatatggacaggaagtcatagattatcagaaattatatggcgtatttgagcggaaacataaaagagaacaggaaatacaagaaaaactacgacaaatcgaccaaaaatttgagtttgttaaagaatggttaccgatacaagataagacaatttcagaaaaaatggtattgctttcccgttttatacaagagatggaacagatgaaatttgccagaagctatcagcaaaatactttattgaagcaagaaatcaatcaattgaaaaagaaacaaaaagtatggatacaagaatacagcgaacaattgactcaagcaggcttatcttatccttcggaagtacctgtctttttacaaaaagccaaacaagccgaacagcagatgaaaagatacaatgaattatcggaaatgcttactccactatttcctgaagagctgacaaaagagaaattatctgtaagactgcgccaactgaaagaaaagcaatcccaactccagcaagaagaaaaagaagcaagtgaaaatcggcaacgactccaacttcaagtagaagagttgcaaagagacggcacattggacgaactttatcaacaagctagccggcaaaaagcaaaattacaggaattactggaggaatggggagcacttgaaatcgccgggacattcttaggtgatctttcaacagagatgagtgaaagacaattaccccagttgttaagagcagcaggtgattatttaggtattttaacaaaaggaaattatcagaagatattactgaaaaatgatacactgactttaacagacggatatacagaatttcccatctatgagttatctacaggtacgaaagatcagctgattatggcgatgagatttgcttacctctcattagaagctaaccgttcgatatgcccgatcatcattgatgatggctggcttcattatgatcatcagcgaaagtatcaattagctgaacttttagctaaatttggagaaaagtatcaaataatttgtttttcttctgataaagaaatggtaagctattaccatgagatgaaccaaatcgtaaaacaattagaaggagcaaataatgaaaaaaattcgtga

SEQ ID NO: 2700 - DNA (genomic), 411 bp, Enterococcus faecium; double-stranded, circular
  misc_feature (B) LOCATION 1...411
  hypothetical: NO
  anti-sense: NO
tggtttacaggtatttcaaggctattgtgggattggaggaatacaatgaacaatttagaatttgcacttgaaatgaaaaacaaacgtcttgctagcggtctttcacaaggagaacttgcaagtcttacccatgtatcaagatatagtatcaaccgctttgagaacggaaaagccaacgccagcaaggaaacacaaaatattatcctgcgttgtctgaattactatatctgcgataagcctttttatctgctcgttgattatctgtctgtccgttttccaacgactgacgcattggaaattatccgaaaggtgcttggcatgaaagcagattattttatccattatgactatggatattatggctataaggagcattacgcctacggggaaaatcaaggtcatggcttctga

SEQ ID NO: 2701 - DNA (genomic), 1035 bp, Enterococcus faecium; double-stranded, circular
  misc_feature (B) LOCATION 1...1035
  hypothetical: NO
  anti-sense: NO
ctaattacaggagtgcaaattttaatgaaaaaaaaatcaattattttggcagctactagtgcgttggctgttttaactctagcagcttgttcaggcgatactaataaagatatcgcaacgatgaaaggcggaacgatcactgtatctgatttctatgatgaagcaaaacttgaatcatcgaaccaatccttagtacaacggatgatcatttataaagtattcaataacaaatatggcgataaagtaaccgataagcaagtggatgcagaatacgacaaacaagcgaaatcattaggtgatacttttgaatcacaattagaagctgctggatatacgaaagatacttataaagaatatattcgtaacaatttagcttttgaagctggcttgaaagctcacgtagatattacagatgacgatttgaaaactgcttggaaatctttccatccagaagtagaagcacaaatcatcaaattatcaagtgaagatgaagcaaaagatgtgaaaaaatcagcggatgatggagatgatttctctaaattagccaaagacaaatcaactgatacagagacaaaagaagatggcggtaaagttaaattcgactcaacgacaacaactattcctgcagaagtaaaagaagcagctttcaaattgaaagacggtgagatctccgatgttattactacaacaaatcctacttcttatgcgacagaatactacgttgtcaaaatggtgaaaaaccaaaataaaggcaatgacatggataaatacaaagatcaactaaaagatatcgctactgaaactaaactaagtgacaatgcattcacaactaaagtaatcggtgaagaattaaaagatgcaaatgtaaaaatcaaagatgatgcctttgaaaatgtgttgagtgcattcacaacaacttcatcaagtacgaaagactcaagtgaaactacagcttcaacaaagagttctgacacaaaatcaactgattcaacaaaagaatcttcaactgaagaaacaactgattcatcaaaataa

SEQ ID NO: 2702 - DNA (genomic), 891 bp, Enterococcus faecium; double-stranded, circular
  misc_feature (B) LOCATION 1...891
  hypothetical: NO
  anti-sense: NO
aggagcgcaggaagtagcatgagagaaaaaagagcattttatatcaatggttatgcagggattgtcggattggtcgtattagctttagttggattgtttttcttctatttaggtatgtggcaagcgaaagtttgggcactttttttaagtatttttctttggttgatcacgttattgttgttaagttcggcaactgtagtcagtcctaatcaagcaaaagtaattttgttttttggacaatatttaggtacgattcgagaaaatggctttttccttacgatacctttggcacaaaaaatgactgtttcgttgaaagttcggaatttcaatagttctgttttaaaagtcaatgatttggatggaaaccccatcgaaatctcagcagtagtagtctttaaagtcgttgatacagcaaaggcattattcgatgtagcgtattatcaagattttgtagaaatccaaagtgagacagccattcggcatatcgctagccaatacccgtatgatacattcaatgagaatgatttgacgcttcgaggaaacacgacggcagtgtctgacgagttgcaaaaagagctgcaagagcgtttagcagtagcaggtgtcgaagtaatcgaaacacgcttgaaccatttagcctatgcaacagaaatcgctagtgccatgctccaacgtcaacaagcaaaagccattttgtctgctcgacaaaccattgttgaaggagctgtcacaatcactcaaatggccttagagcaaatcgaagatggacaagaaatcaatttcaccgatgatcggaaagtccaattgatcaataatttacttgtctcaatcattacagacaaaggaacgcaacctgttatcaatacaggcgacatgaaagaccgtaagtga

SEQ ID NO: 2703 - DNA (genomic), 216 bp, Enterococcus faecium; double-stranded, circular
  misc_feature (B) LOCATION 1...216
  hypothetical: NO
  anti-sense: NO
agaaaagcaggatctagtcacacttatcacttgtacaccttacaccgtgaacactcaccgattactagtgacaggaagacgagttccctttacagaagaagtctcttcaaagatagaacagacaaaaaaataccatctttatcgattacttatactccttctaggtatattgctagtgctaacgcttttcggttattggtgttatcgaaaatttaa

SEQ ID NO: 2704 - DNA (genomic), 213 bp, Enterococcus faecium; double-stranded, circular
  misc_feature (B) LOCATION 1...213
  hypothetical: NO
  anti-sense: NO
agatggcaaggggcaccttttattcgaaatttgggaatatcacacgattattgtcacgatctcttttacgtaaattttataagtcagatttgttgttttgatcgtttaaaaaaagcaacaaatccgaagcctgcggaggcaagaagggacaaaaagccgagtggtaagcaaaagaatgctggttccactaatattccgttgttattgatataa

SEQ ID NO: 2705 - DNA (genomic), 2469 bp, Enterococcus faecium; double-stranded, circular
  misc_feature (B) LOCATION 1...2469
  hypothetical: NO
  anti-sense: NO
aataggcaaggaactttttgtcgcttgataagaaaagacaaaaaaaggaggaaacgaaccatgacattaacagctgaagtcattgtggacgtacctactatgcagaccgatcagccattcacttatttggttccctctgaaatggaaacagctttgcaagtcgggatgcgagtagaagtcccttttggtaatggcaatcgtcatgtccaaggatttgttatggctatccaaaaatcagaagaatcagctaatccatctttgaaggcagttattcgtttgctagaccttgctccggtggtcaatgaagaattactttcattagctgattatatgaaaaaaattacttacgcattcaaaatcacttgtctacaaacgatgcttccgagtgtgatgaaagcagaatatgataaattgatctatcctttggcagacacaccagaagttcaggtattgtttgatcagcgagaagtgatttcctggaaggaagcagaagaagaaggcagcctttctcaattgattcgctggcgccaagagcaattagtagatatcaaatatgaagtccatacacgaaataaagtaaaaacgattcgtttggtccgttctttgttaactgaaaagcaaatcgaagaagaatgggcaaaattacggcaaaatgccaagaaacaaaaagaacttcttttgtgtttatctgaactgagccaagaagaaccaattgcttatttcaaaaataaaggaatcagtactgctgtcttgaatcaaggaaaagaaaagggctggctggagtttatagaatcagaacgttatcgcgacccttataaagaccgagtatttgaccaaacgacggcattggaactgaatgcagaacaaaaaaatgctgtcgaacaaatcatcacagcaggtcagcagcaaaaagatcaggtctttttgctggagggaatcactggcagcgggaaaacagaagtatatcttcaggcaatcgctgatgttttgtcagaaaataaaacggctattatgttagtgcctgaaatcgcattgactccgcaaatggtcgagcgattcaaaggacgcttcggagaatcagttgcggtcttacatagcggactttcccaaggtgaaaaatatgatgaatggcgcaagattgagcgggaagaagcgcaagtagtagtaggcgcacgatctgctatttttgccccgctgaaaaatatcgggctgatcattatcgatgaagaacatgaatcaagttacaaacaagatgagacaccgcgttatcatgcgagagatctagcaatttggcgcagtaaatatcatcattgcccaatagttctaggaagcgcgacgccctctttagaatcaagagcacgagctcaaaaaggcgtttatcagttattgcagttaaaccaccgagccaaagcagctgcacagcttccagctattgagatcgtagatatgcgtgaagagtttcagaatcatcggacctctactttttctgctaatttgcaggaaaaaatacaaaatcgattagacaaaaaagaacaaactgtcctactgctcaatcgtcgaggatattcgtcttttgtgatgtgtagggactgtggatttgttcttccatgtcctaattgcgatatctctcttacactgcatatggatacacgttcaatgcgctgccattattgcggacatgaagaacctattcccaatcgctgtcctaattgtggcggcaataaaatccgctactatggaacaggtactcaaaaagtagaagaggaactccgagaactttatccgcaagctaggattttgcgtatggatgtagataccactcgaagaaaaggggcacacgaacagattttacaaaaattcggtgcaaaagaagcagatatattattagggacacaaatgattgctaaaggtttggactttccagaagtgacattagttggggtgttgaatgctgatacctccctgaatttaccggattttcgttctagtgagcatacattccaattgcttacccaagtttcaggacgagcagggcgagcggaaaaagcaggcgaagtcgtgatccaaacattcaatcctcaacattacgccatagaattggctaaaaaacaaaattatgagcagttttatcagcaggaaatgcatgtacggcatcgtggaggctatcctccttattactttactgtgaaaataaccgccagccatcctgaagaacaagtagcggcaaagaaaatctttcagattgccaatcagctaaaagaagtgttaagccctcaaagcttgctattagggccaacgcccagcatgattttgagagtgaaaaaccgatattattatcaactaatcatcaaatataaacatgaaccgaatcttcctcatgttttggatgaaattttgaatggaagccagaaagaacagcgacaaggtctttttgtggcaattgacaacgaaccattaaactttatttaa

SEQ ID NO: 2706 - DNA (genomic), 852 bp, Enterococcus faecium; double-stranded, circular
  misc_feature (B) LOCATION 1...852
  hypothetical: NO
  anti-sense: NO
ttttttaaagggaaggaaattgttttgattaaagtagatggagcattactaaaagaataccgaaagaaaaaggggttaacacaagtacaattagcagaaggcatttgtgaacaagcaactgtcagcaatatcgaaaacaagaatatgtcgccaggcatcaatatcttaagtgcgctttgcaaaaagctgaatgtcgagatctccgatatattagtagaaacagaagaagacaaaatcaggaaaaaaataaatgagattcaatcattgaattctgtatcaaaataccaagaatcttataaaattttacaaacgatcgatcaggaaaaagtaagtaattctgatcttttaaatcaaattttattttatcaaggactgcttgatcatctttatgcgaaaaaaccagatgcagcattattttattttaatcaagtgttggaacaaacgaccgaaacagatatccatcacttacaagcagctgcaaacgtggcaatgatctacttgtcaaaaggagaattagattttgcgaaagtttatgtggagcgtacacttaaaatattgagtgagactgattttgataatctgatggtctgcattgtatattatgatatcgccacctattaccgtaaaatcgaggattatgataaagcaatccaattatgtgagaagggtattgagtataataagaaacataaatcgacttatgcattggaatacttgctttatgaaattgcttcttgccataagcaattaggagaagatgattatttagaaagatatatggacgcaaaaaaaatagcgcgtttcaacggaaatgattacgcggtaaaggtgattgaaaacgacctgaaataa

SEQ ID NO: 2707 - DNA (genomic), 201 bp, Enterococcus faecium; double-stranded, circular
  misc_feature (B) LOCATION 1...201
  hypothetical: NO
  anti-sense: NO
aaaaataaagggagcagttatcgctgctctctttattttttatattctttttatccagtctatcctaataatcaaactgacgatagtagcggcgtatctctaatggatggcagttcaactgctccacatgagcatcgatgcgttgtgtcactacatgcatcaataagaaagacaaaacacgtccgcgatatttttcactga

SEQ ID NO: 2708 - DNA (genomic), 1731 bp, Enterococcus faecium; double-stranded, circular
  misc_feature (B) LOCATION 1...1731
  hypothetical: NO
  anti-sense: NO
ggaaataaaggagtatatagaatgagacaatcaaaaatgttgattccaacattacgcgaagttccaaatgatgcagaagtattaagccatcaaatcttgctaagagctggatatatccgccaagtatcagcgggtatttattcatatctgccattagcaaatcgtgtattggaaaaactgaaacgcattatgcgggaagaatttgaaaaaatcggagcggtagaaatgctgatgcctgccatcttgccagcagaactttgggaagaatccgggcgttacgaaacatatggaccaaacttgtatcgtttcaaagaccgcaatgatcgaaaaatgatccttggaccaactcacgaagaaacttttactgatttgatgcgtaatgaaatcaattcatataagaaattacctttaaatctttatcaaatccaacctaaatatcgtgacgaaaaacgacctcgcttcggtttgcttcgcggaagagagtttatcatgaaagatgcgtattctttccatgcaacggaagaaagtttggacgagacatataaagattacgaaaaagcctacaccgaagtattcaagcgttgtggcttagaatttcgctcgattatcggagacggtggcgcaatgggcgggaaagactcaaaagaattcatggcgatctcagaaatcggggaggatacgatctgttattcgactgaaagtgattatgctgcaaacttggagatggctacaagctactatgtatcaaaaaaatcgcatgaaacacagcttgaattggagaaagtagctacacctaacgtaaaatcaattgacgaagtagcagatttcttttctgttgaacctcaaaaaatcatcaagtctgtattgttcattgcggatgaacaacctgtccttgttttggtacgcggagaccatgaagtcaatgacgtaaaactgaaaaactttttatctgctgactttttagaagaagcaacagaagaagaagcacaaaaatatctaggtgctgagtttggttctgtcggaccagtcggtgtttcagatgacgtaaaagtatatgcagaccgttatgtccaagatttagcgaatgccattactggagcgaacgaaacaggattccactataaaaatgtgaatccagaacgcgatttcactgtactttcttatgaagatcttcgttttgtacaagaaggagatccttcaccagacaacaatggtgttcttgcctttactcgaggaatcgaaatcggacatatcttcaaaatcggcactcgttacagtgaatctatgggagcaactgtactagacgaaaatggacgagaaaaatttgtgattatgggctgttatggtatcggtgtaagtcgtttattatcagcaatcgtagaacaacattcagatgaacaaggaatcaactggccaaaaggaattgcgccatttgatttgcatatcgtccaaatgaatctaaaagacgaataccaaacaaacctgacgaatgaactagaagaagcgatgacaaaagctggctatgaagtactggttgatgacagaaatgaacgcgcaggagtgaaattcgcggattctgatttgattggctgtccaatcagaatcactgtcggtaaaaaagcagtggatggaatcgtagaagtgaaaatcaagaaaactggcgaaatggttgaagtacgtaaagaagaattggtgaatactttaccaatcctcttgaaccaaggcgaataa

SEQ ID NO: 2709 - DNA (genomic), 327 bp, Enterococcus faecium; double-stranded, circular
  misc_feature (B) LOCATION 1...327
  hypothetical: NO
  anti-sense: NO
acactaaaaggagcgaacaattttatgtttgaatcaattacaatgaattttttaacacaaccgaaagtagtagctgcggttgatatttttagagcattacaaactgccgcaactagtttaaaaaacaatctgatgatttttgctgctgctgcggccgttgcttccattgttattgggggtcttttcttcctatttggacgaagaggagctgaaaatgggaagatgcacgtaggctatgtattgatgggggtaggagttattttagcagcagcttctattgtggtttcgttatttggattgtttggacaaacacctcaaggattataa

SEQ ID NO: 2710 - DNA (genomic), 504 bp, Enterococcus faecium; double-stranded, circular
  misc_feature (B) LOCATION 1...504
  hypothetical: NO
  anti-sense: NO
tcgctaaaaggagatggggaaatgacaaaaattttatttgtttgtttgggaaatatttgccgttcaccgatggcagaaggcttgctgagaaaacgaatagcattagaaggaagggaagcagaattttttgtggattctgctgctacaagcacgtatgaagttggaaagacaccgcaccctggaacgaaaaaaatattaaaccaagaaaaagtagatatgacgaatatggttgctcggcaaatcacaccccacgattttgaaacttttgattggatcattggcatggatcaagaaaatgtagaagaactgaaacgaagagcaccacgctcagcgcaggggaaaatccatttgtttttaagtagcattcctggaaaagaaaaagaaaatgttcccgacccatactataccaataactttgatgagacatatcacttgatcacagaaggcctgaatcattggtggaatatttggattgatgaaaataaaataacaaacaatttgtaa

SEQ ID NO: 2711 - DNA (genomic), 891 bp, Enterococcus faecium; double-stranded, circular
  misc_feature (B) LOCATION 1...891
  hypothetical: NO
  anti-sense: NO
aatcaaaaaggagagcagatatccatgaagggaatcattcttgctgggggcagcggaacacgtctgtaccctttaacaaaggcaacatcgaaacaattgatgccgatttatgacaaaccaatgatttattatccaatgtctactctgatgttggcgggaatcaaagaaattctgattatttcaacgccacaagatacaccacgtttcaaggaattatttggaaacggaaatgatttaggactgcagatcgaatatgcagtacaagaaagtccagatggattggcacaagcgtttatcattggagaagaatttattggagatgatagtgtctgcttggtattaggggacaatatttactatggtggcggtctgtctaaaatgttgcaacgagcagcttcaaaagatacaggcgcgacagtatttggctatcatgtcaatgatccagaacgctttggtgtagtagaatttgatgagaatatgcaagctttgtcgattgaagaaaagcctgctcagccaaaatcaaattacgctgtaactggcctttatttttatgacaatgaggtaatttctatcgctaaaggtatcaaaccttcagaacgtggagaactagagattacggatgtcaataaagcatatttggataaaggaaaactatccgtagaacttatgggacgcggatttgcttggcttgatacaggaacacatgaatcattgcttgaagcatctacctttatcgaaacaattgaaaaacgtcagaacttaaaagtggcttgtttggaagaaattgcttaccgtatgggctacatcgataaggaacaattgctggcccttgcacagccattgaaaaaaaatcaatacggtcaatatttattgaatttggccgctgaataa

SEQ ID NO: 2712 - DNA (genomic), 510 bp, Enterococcus faecium; double-stranded, circular
  misc_feature (B) LOCATION 1...510
  hypothetical: NO
  anti-sense: NO
tgtaaaaaaggacgtgggtgtatggaaaaaataaaagtaacagaaaatgaactggatgagctgatggcagtcatacaagaagtatggccggaagcttttgtgccgatcattggtcaaaaacaagtggattacatgctgaaaacttatcagtcaaaaaaacagattcaaaaagaactgacagaaggtgtgtcctactttttattaaaaagcgaagaaaagactgtcggttacactgcttatgaagagataaatggaaaaatttatttaagtaaattatatttgctaaataaagtacgtggtcaaggattgacttcttcagtttttcgctggtatgaagaacttgctgcgcaaacaaaggaaagagagatctttttgcgagtgaatcaggggaatcatcaagcaatcgaggtttataagcatgaaggatttgagattacagaagaacttatttcagatatcggtcaaggatttcaaatggtcgattataaaatgaaaaaagctctcgcataa

SEQ ID NO: 2713 - DNA (genomic), 396 bp, Enterococcus faecium; double-stranded, circular
  misc_feature (B) LOCATION 1...396
  hypothetical: NO
  anti-sense: NO
aagaaaaaaggcagaaagaaggaaacaactatgattaaattaaagcgtgtttaccttgatgctgaagaagaggatggctttcggatactcgtggataggctctggccgcgagggctttcaaaagaaaaagcacacttggatctatggttgaaagaaattgcgcctagtaatgaggcacgcaaagcttttgaccatgtaccagaacgttttgcttcatttgcaaagaaatatcagcaagaattgtcttttgaagaagaaaagacgcgagctgtttccgaactcacccaacttatgaaagaacatccagtcattacttttgtttatggtgcaaaaaacgagcaccagaaccatgccgttgtgttaaaagaatttatcgaaaaggaggtgtacaaatga

SEQ ID NO: 2714 - DNA (genomic), 582 bp, Enterococcus faecium; double-stranded, circular
  misc_feature (B) LOCATION 1...582
  hypothetical: NO
  anti-sense: NO
tcagaaaaaggggttatgacaagctttgtcaacccctttttttcttggtttcagattgggttttcctacaaaatatttttatctttgttgaataggaaacaaaaaaacaatataatgaaagaaaaagaaggtgtagaaatggataaaagacaactgctaatagaagaatatctggatttagctaatgagattattcatcgtaataaaccagaaatggaaaaagaatttgcaggatttactctaaatgaactagaagtgattgaacatatcgggaaaatccctgatcctaacgtgacaaaattagcgaatgctagttacatgactagaggagccatcagtaagctaacaaaaaaactgatagctagagggatcataaacacttatcaaagcgaagagaataaaaaagaaatctattttcaattgacgccaatcggacaaaaaataaggaatagacacgagcaactccatcaaaaatgggtacagcgagatgctactgtatttgaaaatatgtcaaaagaagaatttgacacagtatttcgttttatcggtcgatacagagaatttatacgaagtagcaaatga

SEQ ID NO: 2715 - DNA (genomic), 939 bp, Enterococcus faecium; double-stranded, circular
  misc_feature (B) LOCATION 1...939
  hypothetical: NO
  anti-sense: NO
aaattgaaaggggcaaaacagatgagtaaaaaattgaccgtccaagatatgattttaacattacaaaaattttggtcatcaaacggctgcatgctgatgcaagcttatgacacagaaaaaggagcaggtacgatgagcccatatacattcttacgggcaatcggaccggaaccatggaatgctgcttatgtagagccatcccgccgaccagctgacgggcgttatggagaaaacccaaaccgtttgtatcagcatcatcaatttcaagtcgtaatgaaaccttcacctgaaaatatccaagagctttatttagaaagcttgcgtcttttaggaattgatccattagaacacgatattcgttttgttgaagacaactgggagaacccatcgatggggtgtgccggtgtgggttgggaagtatggcttgatgggatggagatcacacaattcacgtacttccagcaagtcggaggactaccttgtaaaccagttacttctgagatcacttatggactagaacgtcttgcttcatatattcaagaagttgaaagtgtctatgatctggaatgggctgatggtgtgaaatatggcgagatcttcaaacaaccagaatatgaacattccaaatattcttttgaagtaagtgaccaagacttgctactaagcaactttgaccgttttgaaaaagaagctaaacgctgtatcgatgaaaatcttgttcatccagcgtatgattatattttgaaatgcagccatacattcaatttattagatgctcgcggtgcagtatccgtaacagaacgagcaggttatctttcccgtatccgcaacatggctcgtgctgtagccaaaatctttgtggcagaacgcgaaaaattaggattccctttattgaataaaaacacagcaaatccagaaaacatgaaggaggctgaataa

SEQ ID NO: 2716 - DNA (genomic), 282 bp, Enterococcus faecium; double-stranded, circular
  misc_feature (B) LOCATION 1...282
  hypothetical: NO
  anti-sense: NO
ggggtgaaaggaatggaagcagtagcttattcaaatttccgccaaaatttacgtagttatatgaaacaagttaatgaggatgctgaaacacttattgtaacaagtaaagatgtagaagatacagttgttgtattatcaaaaagagattatgattctatgcaagaaacgttgagaacactttctaataattacgtcatggaaaaaattcgtcgaggagatgaacaattctccaaaggtgcatttaaaacacatgacttaatcgaggttgaatctgatgattaa

SEQ ID NO: 2717 - DNA (genomic), 1245 bp, Enterococcus faecium; double-stranded, circular
  misc_feature (B) LOCATION 1...1245
  hypothetical: NO
  anti-sense: NO
aatacgaaaggattggttttaatggcttccattaaaaagtactatttaaaaaaatcaaaagaatatcgttatgaagtctatatatcaaatggaattgatcctggtactaagctacagaaaaagattcataaaaaagggtttaaaagtcatgaagaagcagaaagattcgcaaaaattgtcgaaggcgaaatagcttcggaagaatatacacaaaaaaaccctaaaaatttgactatagaaaagtttatggacgattggattaataactataaaatgaatgttaaagaaggaacaagaattgttcacagagcaaatataaaaatgtacatcaatccatatattggaaaatataaactagataaatatactagagctgatcatcaaagattcatcaatcagttacttactaaaaagggtttggggagaactaaggaaggtctctcagtaacaacagccaaaagtattaacgccactcttagcaatgctttcaaaaaagctattcagttaggatatataaagaataaccctactagttttgttgagtttccaagaaatccatctgataaaaagaaagttaaatattatacttttgatcaatctgaactatttctcgaatttgccaaaaaagaaaaatcatttatatggtatcccttttttcttattatatttgatcaaggattgcgaaaatcagaagctttagggcttcaatgggctgatattgatttttctcagaatacacttaatattaatcgtgaacgacttggggctgctgaaaaaggacctaacaaaggtttgattattacagatgacacaaaaaccccatctggtacacgatcattgcctatgacaaaacgagtaaagaaagccttattgactttaagaaatcaagtcataaaagaatttggttttttacctgaaacagatgaccacgaagcatttatttttataaatacttacggtaaaaataaaggtattccaataagagatcgaaccgttaacggtgcttctcatagaattgaaaaacgtgccagtctcccccacataactgtgcatgatggtagacatacttttgcagctagaacgagacaagcaggaatacctttagaagatatcaaagattttttaggtcataaagatgtttctactacacaagtctatgcccatatttctcccgaagtgaaaaaaagatcaatgaatcaactagaaaactatatagaagagcaaataaaaaagcactcaaattga

SEQ ID NO: 2718 - DNA (genomic), 957 bp, Enterococcus faecium; double-stranded, circular
  misc_feature (B) LOCATION 1...957
  hypothetical: NO
  anti-sense: NO
gaaaagaaaggaaaatcctcagtgaataaagaagaaatagttgaaagcttagccacgattactatattgtttgatgaaccattgatgaactatacgtttacgaaaacaggtggaccagctgatgtccttgcattcccgaaaaaacaagaagaagtaaagcaaatcatcgattattgccgaatccatgatataccttggatggtattaggaaatgcaagcaatctgatcgttcaagatggcgggattcgcggtgtagtcatcatgctgactgaaatgaaacagattcatgtcaaaggaacgatggtcattgcggaagcaggtgcctcactgattgatacgacttatgcagctttggcagaatcattgactggatttgaatttgcttgcggcatcccgggaagtgtcggtggagcggtttatatgaatgcaggtgcgtatggcggagagatcaaagatgtttttgctgaagtggatcttttgcttgaagatggaacattgaaaactttgacaaaagacgaaatggtattttcttatcgtcacagtaaagtccaagaattacgtgctatcgtattggaagctcgattcagtttgcaaacaggggattatgaagcaatcaaagcaagaatggatgagttgaccgaattgcgtcaatcaaaacagccattagaatacccttcatgcggaagtgtctttaagcgcccagtaggacactatacaggtcagctgatccaacaagcaggattgcaaggcctgaaatggggcggtgcacaagtctctgaaaaacatgctggattcatcgtcaatatcgatcatgcgacagcgacagattatattgaattgattgcgcacatccaagaagtaatcaaagaaaaatttgatgtgtctttagaaacagaagtgcggatcattggagaaaaacaagcaatatcagaaacaagcagaagtttagccaattaa

SEQ ID NO: 2719 - DNA (genomic), 1041 bp, Enterococcus faecium; double-stranded, circular
  misc_feature (B) LOCATION 1...1041
  hypothetical: NO
  anti-sense: NO
caagagaaaggtgtttttatcatggctattaccgtaaaagatgtggcgaaaaaagccggtgttgccacctcgaccgtctctcgtgtcatcaacgatcatcctagtatttccgagacaacaaagaagaaagtccgaaaaattatggatgaactaggttatgttcctaacatgactgcccgcaatctaggaaaacgcatttccagtgccatcggcgtaatcttaccccctcttgattcaaaagagcggatcggtaacccattttatcttgagatcatggaagcaatcaacgaagaagcgcggaattatgatatgactacagcaatcgctactgctaaaaattttgaattgctgttagagaacgtccagcgtatgcatttacaaaaacaagtagatggttttattctagtgtattcagatagtcaagatactgtcattgattatttataccaaaaccacatccctttcactttgatcggacagccttatcatcatgagaacgaaatcgtttatgtagataatgataaccagcttctaggtaaacaagcaacagaatttttgatccagaatggacataagaatatcctgtttgtgacaaacacgactcatgaaagtttgtatttcgaacgatatttcggttatcaaaaagcaatgatgatggctggtcttcctgcgttatccagtgtagtactagagcatccggaggattatctgtcctttgagaaaacgttgaaagaaaacgaagccacagcattggtggtcattgacgatatcttcgcccttcgcacgatgcagttggcgcaaatgtatggctatgtcattccagagacactctccgtcattagcttcaacaactcgatcttctcaacattaacacacccttaccttacaagtatcgatatcgatatctccgaattaggacgtgtcgctatgcaaaagctgcgcgaattgatccatgaagaattgagcagtggcgtacgtttggtcatccctcatcgcttgatcaaaagagagacagtcgttcctttagaaaacccatactaa

SEQ ID NO: 2720 - DNA (genomic), 459 bp, Enterococcus faecium; double-stranded, circular
  misc_feature (B) LOCATION 1...459
  hypothetical: NO
  anti-sense: NO
agaaatgaaggtgaaaagatgatacagctaccagcagaaaaaatattgctcgatcaatcctatcaaaattggaaagaagcgttgaccgagatcggccagtggatgacccaacaagggggaatcaaaccggcatatatccaatcaatgatcgaaagacaagaaaaagcgagtgtctatatcgggaatttcgtagccttgccacatgggactgacaaagatgaagaagtagtagaagaaggaatctatttagtccaagtgcctgatggtgtggactttggaacaaaagaggaaccaaaaatcgcgacactcttatttgtagtggctttaaaaaaagaacatcagttagcggtgctccaagatttagcctttttctgttcagacatcgaccaagtaatggcgctcagtgatgcggaaaccattgaagaagtccaaatgatttttgaacatggacatatataa

SEQ ID NO: 2721 - DNA (genomic), 198 bp, Enterococcus faecium; double-stranded, circular
  misc_feature (B) LOCATION 1...198
  hypothetical: NO
  anti-sense: NO
ttcagtgaaggccttttggttgacgctgccgccgaagagatcggtgaagataaagccttgttcctccggttggacggaagcgatgaattcatcgatggcgggggtgtaatcttcgtcgatgatgtaggcgttgatgacttggaagtcattgcctttgtccgccagaatgttcaaggagctttggaagcctttggctaa

SEQ ID NO: 2722 - DNA (genomic), 858 bp, Enterococcus faecium; double-stranded, circular
  misc_feature (B) LOCATION 1...858
  hypothetical: NO
  anti-sense: NO
gatgaagaaggagtaatcatggagccaattattgaattagaaaagataaattataaataccagccagatgatcttcgccccgcattgaaagatgtctcctttacaattgataaaggtgagtggatcgctattattggacacaatggttcaggaaaatcgacacttgccaaaacgatcaatggattgcttctgccagaatcagggatcgtgaaagtgggaaatcaaatattggatgaagaaaatatttggacgatccgacagatggttggaatggtttttcaaaatccagacaatcagtttgttggttcgacagtagaagatgacgttgcttttggtcttgaaaatcaagggattcccagagaagaaatgctagtgcgtgtgaaagatgcacttgagaaagttagaatggctgagtttgcttcacgcgagcctgctcgtttatcaggagggcaaaaacaacgtgttgccattgccggcgtggttgccttacgacctgatatcattattttagatgaagcaaccagtatgctagatccagaaggtcgtgaagaagtgatctctacgatcaagaagatcaaagaagaaagtcaattgaccgttatatctatcactcatgatattgatgaagcagctaatgccaatcggatactagtgatgagacaaggcgaacttgtccgtgaaggtacaccaaaagaaattttttctgctggtcctgaactgatcgacttaggtctagatctaccatttcctgaaaaactgaagagcgcactgaaagaacgtggggttgatgtgcccagtgaatatatgacagaagaaaggatggtggattggttatggacatccgttttgaacaagtag

SEQ ID NO: 2723 - DNA (genomic), 282 bp, Enterococcus faecium; double-stranded, circular
  misc_feature (B) LOCATION 1...282
  hypothetical: NO
  anti-sense: NO
aaactggaaggaactgctcgatcaaccttgagaactgtttttcttacttctggtcaagattctcgtggttggtggataaggatggttgataagttcattggattagctagtcgaaaacaaccaggtgtaattaatgtagaagttttaacaaggggatggagtgatttattcagtgataatcataagttcataaatagtaattgggatgtatggttggtatacgttatacctgaacttgaactatcaagatttggtttagaatttgagaatcgatgtttataa

SEQ ID NO: 2724 - DNA (genomic), 627 bp, Enterococcus faecium; double-stranded, circular
  misc_feature (B) LOCATION 1...627
  hypothetical: NO
  anti-sense: NO
ttaattcgaggtgtctttgtgaagaagttcaatcctaataaaaatattattattaccttggttattgttatcatcgtggtgacgatactaagtgtgaccgctgcgcagcgagcgaatgaaggaaagcccaatttcttccaatccatcgttaatgacagtgttgcaatggttgataaaacaatctctgccccagtacggtgggtacgaaatggagtagcttctgtccataatcttttttcaacttatgccgaaaatgagcggctaaaagaaaaaatcgatagctatgatgacgtttcacagcaaaacaagaattacgagagagaaatcgaagcgttgaaaaaagaacttgagttgaatcagacgctgactagttacgaaaaagtaacggcaaatgtcattactcgttcgcctgacagttggcaggacatgctgatcgtagacaagggttctaaagacggtatcgaagcaaatatggcagtcatgtcgcaaaaaggattgattggccgagtgatcgaggtcaatacggcttcgtctaaaatcgaattactgtcatcctctaatgaaagctccaatcattttccagtacgggtatcttcggctaatggcgaagcgttgtggtttgcttaa

SEQ ID NO: 2725 - DNA (genomic), 441 bp, Enterococcus faecium; double-stranded, circular
  misc_feature (B) LOCATION 1...441
  hypothetical: NO
  anti-sense: NO
aaaatacgaggaggacagcgaatgataccgaagtttagagcgtgggataaacgaaagaacgtaatgagagatgtagccgtcttgcattttactaaaaacggcaaaacaaactttattgaatattggataaatcctaccgaattgaaatcatatcacgtgcgaaacatcgacctcatgcaatccacaggaatgaaagataagaatggtgtggatatatttgaaggggatatagtattagtcagcgtgcgaaatggcttcgattacttagataataaagtctgtattgtcaaaaattcaatagattattccggattagtttgtgccactgttgatgaagacttagagtatcaaatttttaacacagagctgtttgaagaatacacgtacgaagtcaccggaaatatatacgagaatagcgagttattggaggaacagcgatga

SEQ ID NO: 2726 - DNA (genomic), 1476 bp, Enterococcus faecium; double-stranded, circular
  misc_feature (B) LOCATION 1...1476
  hypothetical: NO
  anti-sense: NO
cattttagaggggtgaagagcttggctggacacgtactaaaatacggaaaacatcgcgaacgtagaagtttcgcaagaatcagtgaagtgttggaattaccaaatttgatcgaaattcaaacagactcttaccaatggttcttagatgagggacttagagaaatgtctgaagacattttgccaatcgatgacttcaatggcaatctatctttggaatttgtagattatgaattgaaagaaccaaagtatacagtagcagaagctcgtgcgcatgatgcaaactactctgcaccattacatgtaacattgcgtttgacaaaccgcgagactggcgaaatcaaagcacaagaagtattcttcggtgatttcccattaatgacagaacaaggaacattcatcatcaacggggcagagcgagtaatcgtttctcagttagtccgttcaccaggtgtctatttccatggaaaagtcgacaaaaacggaaaagaaggattcggttctactgttatccctaaccgtggagcttggctagaaatggaaactgatgcaaaagacatctcttatgtacgtatcgaccgtacacgtaagattcctttaaccgtattagttcgtgcgttaggatttggttccgatgatacgatctttgaaatcttcggcgacagcgaaacattacgcaatacagtcgaaaaagacttgcataaaaacgcaagcgactcaagaacagaagaaggtttgaaagacgtttacgaacgtttgcgtccaggcgaaccaaaaacagcagacagctcacgtaacttgctgaatgctcgtttcttcgatccaaaacgttacgacttagcaaacgttggtcgttacaaagtaaacaaaaaattagatttgaaaacacgtctattgaatctgacattagctgaaacattagttgatccagaaacaggcgagatcatcgttgaaaaaggaacagttctgactcaccaagtcatggaaacactagctcctttcattgataatggcctaaattcagtgacttactatccatcagaagacggtgtggtcacagatccaatgactgtccaagtcatcaaagtattttcaccaagagaccctgaacgtgaagtaaacgtgatcggaaacggctatccagaagcagctgtaaaaacggttcgtccagccgacatcattgcttcaatgagctatttcttgaacttgatggaaggtatcggcaatgtcgatgatatcgaccacttaggaaatcgtcgtatccgttcagtcggtgaacttttacaaaaccaattccgtatcgggctagcacgtatggaacgtgtggttcgtgaaagaatgtcgatccaagatactgaaacattgacacctcaacaattgatcaatatccgtccagttgtggcaagtatcaaagaattctttgggttctccccagttgttcacagttcatggattaaacaaaccctcttggcgaattga

SEQ ID NO: 2727 - DNA (genomic), 1167 bp, Enterococcus faecium; double-stranded, circular
  misc_feature (B) LOCATION 1...1167
  hypothetical: NO
  anti-sense: NO
gagactagaggaggggaaataatgttttggcatttttataaatatcgcacaaaaatactgctgcgaaataaatccatgttgttttggacattggcctttccaattcttttaggattgatgtttatggcggcctttggcgagattgatcaaggtggcaatcttgaaacgattaatactggaattgtaatcaaagcggatcaaacagcgctttcggaaaattttaccacagtcttagaacaagtcgaagtcaatgataaaccattatttgaagtacaggaactatcggaagtagaagcgaatgaaaagctaaatgcagatgatttggctggtttttatctcattgatggttcatctgtttcgctccatgtgggtcaagcaggaatgagtcagacgttgatgaaaaacgtcatggatcaatttttacagcgtattggtataatttcgagtaaagtggcagaagtggagaacgttgatctcgcgcccatcatgactgtttttgaacaagaagtatcttttcaagaagttcatgcaggtcgtaatatgagtttcaaaagtttttatttcttcactctgattggaatggcgattctctacgggacgatgtggggggtccgcaatgtacaggatcagcaagcaaatcaatcgtcaaatggtattcgcttgtccttgattcctagaaagcaatcgttagtttcaatcgctaatttggcagcaagctttacgattgttttgacagagatttatattatgttagctgtctttcgttttatctatcaagtagactttggtgaacgttggcaatggttgatgattgttaccgctctggggtcgttgtgtgcgattttgttaggtacattggttggtaatttgataccaaaaatgaatctggtgcaaaaggatagcatcttgatttcagtgacgattgcgatgagcttttttgctggtatgatggggtcggaacaagtgaagtattggattgatcttcatattccgattgttggtcaattaaatctcgtcaacttgatcagcgaaagtttgtataaactttatttctacactgatttggctagtttttataccaatcttctatggttgatcggatttattttcctttttgcgttaggaaatgcttggatggaaagaggggtgcgttatgacgctttataa

SEQ ID NO: 2728 - DNA (genomic), 1653 bp, Enterococcus faecium; double-stranded, circular
  misc_feature (B) LOCATION 1...1653
  hypothetical: NO
  anti-sense: NO
gattgtagaggtgatacagtggaacagaatattcagcttctagggcaacaacgattcgatgaagaagctaaccttgtctataaggtgccagttagtcagttgccgaaaatcgacatgttagatcaacagacaggagaggttagcgagtttatcaacttcaagcatgaagatatgtggaaaatgattgttggctttatcaagcatcatcgtgaaagacaagtacctagattaaaagagctaaagcgatatctgaatgcagacaataacattaagcgacgtccaaacaagccagacgggagagcagacaaccgcatagcgagcgattttgctaactttattgtgtcgttcaaacaaggtgtcttgttaggtaatccgattagttataacggcgataaggttattgttgaacgaattaatcggtttgctagcgaatctaatgaggactaccataatcagttgatgagccgtgatgcatttggcttaggtcgtgcttatgagtgggttggacgtgacgaatatggcaaagaaacaatagctaagtttgatgcggagcaaacatttgtgatttatgacaacacaaaagatagaaactcgatttgcggcgtacattacttcgttgagaaatttttggataagtcattcactcggatcgagttatacacaaactgtggatacaactattacttcacagctaaagatgatgatttggaaaatgccgtactggatgaagatggagaagttcaaagctattttgacactgttcagatcaatgaatggatcaacaacgaagagcgcacaagtgattttgagcatgtaatggattccattgatgcatacgacctttcacgatcggaaatggctaacttccaacaagattcgtcggaagcctacttggtgattaaagggaaccctgacacagcagacgaccaagaaggcgacaacagcaagttagcagtattccaagctatgatgcaagcaagaatgcttgtattaggcgataaaaagatatacgacaacaatgttgcaggtgcagaacctgatgcgtattaccttaagaaagagtatgacgttgcaggaatggaagctaacgacagccggacagttgctgatatcttacgcttcacatctcttattgattttactgacgagaacatcgggtccaaccagtcaggcatcggattccgtttcaaaggttggggttcagacaacgatcgtaagaacaaggaacgaatggttaagaaagctattatgcgccgtctgcggttgcttacacactcttggagcattaaagacggactggataaaccacgaggcttgattgatacagtcaaagccttttttgtttctgatgaaaagcaacaagagcagctatacaacaaagtaaacgagatacaaattcaatttacgccaaacgtaccgcaatctgacgaagaaatcatgagcgtaatcgctggaatggtcggcatcgtatcagatcaaacgttgtgcgaaatggccgagcggttaactggcgttccgtttgaagaagaacttaagcgattgaagaaacaagccgtttctggtgtgtttgacagtgacaaagaaactgatacggaggttgaagaagatgaatctcaaagaacagatgatgaaccagtatcagaagaaggatag

SEQ ID NO: 2729 - DNA (genomic), 582 bp, Enterococcus faecium; double-stranded, circular
  misc_feature (B) LOCATION 1...582
  hypothetical: NO
  anti-sense: NO
gaatgtagaggtgatgtgcgaataatgagaaatttatcaaatagaaacaaaatattaatcattattgttgttatagctgtgtttcatctgggaacgaatgcggttttaagtagaataatattgggtcctaagccaccaagaccagaaattacccgaggggagtttgattttagattagaatatgaagtagatggggaaaggattgtgatagaagatacaattgttgcattatttgatggattttctgcagatgcaggtagcatggcatggtatcgcacgtggcgtctacatttagcaagtgatagacgatcacgaaatatcttattagatgaattagaggatggtcgaagaatatattatgtcccagaaagtgctaactattctatgggagatgtacagaaaaaaagagagcctaatcctaattggtatccatttaatggcgtaacaatagaatatccacgcaataaaacacctgaaataggtgcaaaatttataagtggtttagaagatctgtacgataggtttggaatccgtcttattagttgggaacacgatccaccaatagaaaatcgctttgaataa

SEQ ID NO: 2730 - DNA (genomic), 309 bp, Enterococcus faecium; double-stranded, circular
  misc_feature (B) LOCATION 1...309
  hypothetical: NO
  anti-sense: NO
tctgtaagaggaggaactacgatttatactattgcactattacttcatttacttcaacgggcagcctatttctatagcattatcttgatggtatatgcattgctctcttggtttccaggcgggtatcaatcagggctaggacgattattagctaagatctgcgaaccgtatatcagtttgttcgatcgtctgcctttgaggattggacccttggatttcacaattttaggggcaatcctgatcttgaacttagccgtacaaggtttagcacagatcgttatatggataactgtccatttagtttattga

SEQ ID NO: 2731 - DNA (genomic), 1479 bp, Enterococcus faecium; double-stranded, circular
  misc_feature (B) LOCATION 1...1479
  hypothetical: NO
  anti-sense: NO
agtaaaagaggtggagaaatgaatccaacatttgttgccatcgatatcggtgcatcaagcggacgactaatgaaaagtacgagggatgcaaaaggttctttgatcttggaagaagtacaccggttcaaaaacggctttcggaacaaagacggtcacgatcgctggaagatcgattatcttatcaaagagattttgattggatttgaaaaattaaagcagacagggattgatcgcctttttgcggggatcgatacatgggcagtcgattactgtctgattgatgaacaaggggatcggataaatgatccgattgcttatcgggacaagcgtaccaatggagcagtagaacagttttctgaaatctattctctagataagttgtatgagcagacagggattcagatccagcctttcaataccttgttccaattgtttgctgaagaaaaagaaaatttggcaaaagcacataaattgttactgatacctgattatttagggtatgtctttactggtaacatggtgacggagaaaactaatgcatctactatgcagctgctgaatgcagggacaaaagaatgggaaatagaacttcttgaaaaaatcggtgtctcgaaggaattatttccaccattgacagagccgggaacgatactaggagatctgcaaaaagaacaattttcaaaatatgatttgccagatgtgacctttatcacagtagcaagtcatgatacggcgtcagctgtattaggaacgccaggtcaaggagaacgttggggttatatcagcagtgggacatggtcgcttttagggattgaaacaaagatcgccaatgtttctcgcaatgctttttctgaaaattatacgaatgaatggggtgcccataacacggtgcgttttttgaaaaacatcatggggatgtggttgatccaggaagttgcccgaatgcaagagtacgagtacagttatgcggaattggcagagcttgctgcaaaagaaaaaccgctgcagcaagtgatggaaatcaatgaccctcgatttttgaatcccccaaatatgatagaagagattcagcaatactgttttgaaacagagcagccagtccctgtctcatcgggagctatcgctcgttgtgtgtatgataatcttgctctttgttacgcacaagagctgatcaaagtagaacacttaactggaacgaaattggaaaagctgcacatcgtagggggcggatcgaataatcgtctactgaatcaattgacagcagattatgccggaatcattgtagaagcaggacctagtgaagccacagcaatcgggaatgttgccatgcaaatgctcagtacaggtcagttttcgaatatagaacaagcaagaaatgtaatcaaacagtcgtttccatgtgaaactttttacccagatgaaaataagcaaaacacgatggaatggtacgtgaataaaatcaaaggagtaatcgtatga

SEQ ID NO: 2732 - DNA (genomic), 645 bp, Enterococcus faecium; double-stranded, circular
  misc_feature (B) LOCATION 1...645
  hypothetical: NO
  anti-sense: NO
ttcaaaagaggtgatttaatggacaaagcagagtttacaaatttttattggaagtattatctacatttagaaaatgagtttattaataccacagattttgtgatgctcgatgagaataatttcaaaacattctctattgaatatcaaaaactactactagcgattggttcggagtgtgagattattttcaaagaactttgcggatttgatagcagtagcaataaaagcataactgattttaaagctgttattaaatctagcgaattaatgtgtttggataatggtgttagggttatgaattctttaacattgacttcactaaaaccttttggagatgggtggcctgaagatacaccagattggtggaaaatatataacagagtaaaacatggtcgttcttcaaattataaggaagcaaatttggaaaatgtgttgtatgctttagcaagtctatatttattagaggaatatttgcataagaaagtaatactagaaggtgaagtagactttataagtccagagtcaaatctatttacgttatcttgggaaagaaaacattcgtcgatgcaaaaagtgacgtttgaaaaagtggattcaaattatgtagctccactcattgattttaaagaacaagaagaaatttaa

SEQ ID NO: 2733 - DNA (genomic), 522 bp, Enterococcus faecium; double-stranded, circular
  misc_feature (B) LOCATION 1...522
  hypothetical: NO
  anti-sense: NO
gaaaaaagaggaaagaaaatgcaaaaaacgaaaagcaaacaacggttatccgtaatcgttgtaaatggcatcatcatggctctttatctagcgttaactattttagttgcgcctgtatcctcagggccaatccagtttcgtatttcaaaaagtttgaatcatttagttgtctttaaccgtaaattgctttggggatttttaggcggggtcatcgtctataatgccttctttggttttggtatcatggatgtggtttttggtggcggccaaacattgctttctttaggcctgacagctttattgcaaaacaaagtgaaaaatgtaaagatgcgtttagtattgaacacgatcttctttaccatcagcatgggactgattgcttatatgttagttccaacaggtggccaagcattttggacaacctatggcacgcttgcattaagtgagtttatcgtcatggctgtttcatcaccattgatgtattatttagatcgcgcgcttgattttgaaaagcgtgtctaa

SEQ ID NO: 2734 - DNA (genomic), 441 bp, Enterococcus faecium; double-stranded, circular
  misc_feature (B) LOCATION 1...441
  hypothetical: NO
  anti-sense: NO
gtgaaaagaggagatgaaaaagtggatagagaaattatcttagcttcccatggaaaatttgcttcagggatattagattcattagagctgatctatgggaaaaatcattctattactgtattcgattgctatactgatgagaattttgatttagcggaaacagtaaggcagctttttatgaggtacaaagataaagaaatcattgttctgacggatctttttggcggaagtgtcaacaacgaattcttacaatatatcaatcgggatcatgtctatctcgttgccggattgaatttgccactattgattgagctagtatctcggttggacgctgaagtagagacaactgttttgatccagcaggtgctaactgattcaaaaaaaatgatccagttttgtaacgagcggctcaatcagaaaatagaagaagacgaattttag

SEQ ID NO: 2735 - DNA (genomic), 2040 bp, Enterococcus faecium; double-stranded, circular
  misc_feature (B) LOCATION 1...2040
  hypothetical: NO
  anti-sense: NO
cagaaaagaggcattttaatgacggaaaatttgaaccagacgatcattcagcttgtacaaaaagaactttcagactatcgtcctaagcagttgactactgtacttaatttgttaaatgaaggaaacactgttccttttatcgcgcgttaccgaaaagaaatgactggaagtcttgatgaagtccagattcgtgaaatcgaagagcggtatgcctatcttgaaaacttagaaaaacgtaaaactgaagtgattcggctaatcgatgaacaagggaaactgactcccgagttagaagcagaaatcacccaagccgtgaaaatgcaacaagtggaagatttgtatcgtccatacaaacaaaaacgacggacaaaagcaacgattgctaaagaaaaaggacttgaaccactcgcgaagtggctgatgcagcttacagatggagaggtgcaatctgaagcagaaaaatatattgacaaagaaaaagaagtctcttctgccgaagaagcgttgcacggtgctcatgagattattgctgaacaagtcagcgataatgcaaaatttcggacttggattcggtcttatacgtataacaaaggtatgtatgtcagcaatgtcaaggatgagcaagcagatgaaaaaggcgtatatgaaatgtattatgactttgcagaacccgtccataaaatggtttctcatcgaatattagctactaatcgtggagaaaaagaagatattctgaaagtattctttcaagtagatgaagcagcaattttagcttacttggatcgccaaatagtcaaaaatcctgcctctccttcttcttcattcgtcagagaagcctatcaggatagttataaacgctttattcagccagcaatcgagcgagaactgcgcaatgaattgactgaaaaggcagatgagcaagcaatcgctattttcggcgaaaacctccgtaatcttttgttgcaaccgccactaaaaggtaaagttgtcctgggatttgatccggcttatcgtactggatgtaaactagcagtcgtagatgcgacagggaaagttttagcaatcgaagttatttatcctcataaacctgcagcgcaagcaaaaagagaagctgctggaccagcttttatccaattaattaataaatatcaagtagatatggtagctatcggaaatggtacagccagtcgggaatctgaactttttgtggctgagcagttgaaatccgccgaccataaaacctattacgctatcgtcaacgaagcaggcgcttctgtttactccgctagcgaaattgcacgaaaagaatttccgcatctacaagttgaagaaagaagtgctgtttctattgcccgtcgcctgcaagatcctttagctgaattagtcaaaatcgatcctaaagctgtcggagtaggccagtaccaacatgacgtttctcaaaaacgtttggctgaacaattggattttgttgtggaaacagcggttaaccaagtaggtgtggatgtgaatacagcaagcccgcagctcttgcagcatatatcaggattgaataaaacaactgcccaaaacattgtcatttatcgtgaagaaaacggagaattcaccgcacgaactcaattgaaaaaagtgccacgcttaggaccaaaagcatatgaacaagcaatcggattcttgcgagtccctggtgggaaaaacattttggacaacacaggtatccatcccgaaagttattctattgcaaaagaaatattaacttcagtccaactttcagaaaaagagcttggtacagaagaagcagtagaaaaattgacacgattatccgtagagaaactggctgaaagcctatcagtcggagaagaaacgttagccgatattttagctgggctgacacaacctggacgagatatgcgtgatgagatgccagcgcccttattacgtacagatgtattgagtatggaagacttgaaaccagggatggaattgactggaacggtccgtaatgtggttctgttgcaaagttttaaatctactatcaaataa

SEQ ID NO: 2736 - DNA (genomic), 876 bp, Enterococcus faecium; double-stranded, circular
  misc_feature (B) LOCATION 1...876
  hypothetical: NO
  anti-sense: NO
aagaaaagaggtaggaacgtggtagcgaagaaatatgtaatcggtaattttaaaggtggcgtaggtaaaagtacgtgcgcgcaaatgttagggtttgaatcagcagttaatgaaggaaaaagaaccttgataattgacttggatatgcaaggaaatacttctgatgtgatgaacttaacgcatatgaacttcactaacgaagaaggaggcggagaaggtgaaccgattgtttacgaaaatactgtgactgacgtgttgataaacaatcttccacctaaagaggctgtctataaagtaatcaataacctctatatacttccagcagacatgtcctttgaaatgtatgatgattggatcaaagaccaatataatgattcattatcccaattcaaatatatgaaagaaaagctagaaccattatttgatgagtttgacgtcatctatttagatgtcccaccttctatttctgtatatagtaaatccgcgatgtacattgcggactgggcaatcgtcgtcttacagacccaagtaaaatcgatgagaaatgcgatgcaatatcttgagtatatggacttttttgtgaaagaatttgatacaaatttatatgttgctggtgttattcctttcatgttggaaagcggtgacgcagtagatcaggaaatgtataaacaagcccaagagatttatggggaacatttgattaaaaatgttgtactcaaaaatgcgcgcttaaaacgatacgacggatcaggtattacgatggagaagacaaagaaaggtctcttaaaacaatgggatcgcaaaagccacgaattatttatcagtattttgaaagaattggaagaacacgagaattggtatgcggaggtggagtaa

SEQ ID NO: 2737 - DNA (genomic), 930 bp, Enterococcus faecium; double-stranded, circular
  misc_feature (B) LOCATION 1...930
  hypothetical: NO
  anti-sense: NO
gagaaaagaggaaaaagaatgaagataaaaattgaacggaatcaaaaggaaaagagcccaaaaaagaaaaaagaacgagttgtatccgtgggtaagcatcgaaaaatggtgcttgccctttggcttttattgtcttgtagtcttgcttttggcgtttataaaaatttcaccgccattgatcaacatacaactcatgaaaaagtggttataaaagagaaggtagtgaatacttctggcgttgaaagttttacagaggattttgcgaaagaatatttttcatggaaaaataacaaagaagcaattgaaaagagaatgagtaatctcgaacagtaccttacagaaaacggtctcgctttaatccaagatatggttcgagcagatattcccacgagttccgaagttcaatctgtaaaaattctagatgttgaaaaacactcggaagaatttgtcgtttcatttttagtggagcaacatattacagagggaaaaaagacgcaatcaatttcttctgcatatcgagtgacaatctttgaagatgaaaacaggaatcatttagtaactagtttgccaacaatgattggaaagccagacaaggcaaaatatgaagcaaaacaagtagaaaacgattcagaaattgatgccaaaacaacggaagaaatcaccgattttttagaaacattttttaaactttatccatcagcttctgaaaaagaattggagtattatgttgaaaatggtgcgatgcgaccaatcaatattgacttaaagttttcggagttagagaatccagtttatctacaaaacggaaaaaattttctagtgagtacaaagataaaataccttgataatgtatcaaaaaccactagctactttcagtacaaattagtattacaaaaaaatggaaactggaaaatcgttgatgttaaataa

SEQ ID NO: 2738 - DNA (genomic), 306 bp, Enterococcus faecium; double-stranded, circular
  misc_feature (B) LOCATION 1...306
  hypothetical: NO
  anti-sense: NO
gatgaaagaggcagctggaaatttattactaacctctctaagtcacataaaagaggagaaaaaacaatgacacatttcaaaaaatttttacttactttgcttattggtgggatagctttattaagtgaatttgtttttcaccagccggcccttgcatttgcgattgtcgcatttactggagggattctcgccttcttgatgtttttggaaatgatcaagacgttacgttcaggaagatatggcgtagatgtattagcgattaccgcaatccttgcaacattagccgtcaaaagaataatgggctag

SEQ ID NO: 2739 - DNA (genomic), 846 bp, Enterococcus faecium; double-stranded, circular
  misc_feature (B) LOCATION 1...846
  hypothetical: NO
  anti-sense: NO
ccaagaagaggaggatttctttcaatgaaattagctgatggaatttctaaagatgagaaaaaattggttcggaagatgttttggcgctcgatgactatgtatgcttcggtgaatccggtgacgatgggcggcggtggtttcgcctattctatgatgcccttcattaatcatttctacaaaagtgaagaagatcgagctgcggcgctggaacgtcatacacagtatttttcgacgaccattccttgcgcgtcctttgtcatggggattgcggcatcgatggagaaggaaaattctgaaaaagctggttttgacgtggaaagtatcaacgcgatcaaaacgagtttgatgggaccattggctggaattggcgattcattgttctggggagtttggcgtgtcgttaccgcgggactagcgatcaacttagccaatgccggaaatattttggcaccaattatctttttagttatgttcaatatacctaattacttgatgcgatactatggcggcgttttaggctattcattaggctctaaatatattgaaaagctgtatgcgaacgggttaattgaaattctgacaaaagctgctagtatcttgggtctgatcatggtaggtgcaatgacgatcagtatggtcaaattcaataccgttttgagcttttcaatgaagggcgaagaactaatgaatgtccaagaaatcctcgatagtatttttaaaggaattgtaccgttattggtaacattgagctgtttcaaattactagataaaaaagtcggcgtcatcaaaattatttttggaatggtcgtcttgggaattttattgtcattacttggaatcgcatag

SEQ ID NO: 2740 - DNA (genomic), 951 bp, Enterococcus faecium; double-stranded, circular
  misc_feature (B) LOCATION 1...951
  hypothetical: NO
  anti-sense: NO
aataggagaggtaattatatgaatgagaatcctttagcggtcaaacttcctggcctagaattaaaaaatcctatcatgccggcaagcggctgtttcggttttggcaaagaatacggaaaatactatgatttgaatcagcttggatcgatcatggtcaaggcaacgactccaaatgcccgctttggcaatcccacgccaagagtggcggaaacaccatctggcatgttgaatgcaattggtttgcaaaatcctggtctagacgttgttatgcataaacttcttccagaattagaggagtacaatgagttacccatcatcgcaaatgttgctggtgcttgtgaagaagactatgtagaagtttgtagcaaaattggcgaagcaccaaatgtgaaagcaatcgagctgaacatttcttgcccaaatgtcaaacatggcggaattgcttttggaacagattctgatgttgcttttcaattaacacaagcagtaaagaaagtttcttctgttcctgtctatgtcaaattgtccccaaatgtaacagacatcgttccaatcgctcaggcaatcgaagctggaggggcagatgggtttacgatgatcaatactcttcttggtatgcggattgaccttaagacaagaaaaccgattttagccaatcaaacaggtggactctccggaccagcaatcaagcctgtcgctattcgtttgattcaccaagtagcaagtatatccagccttccaatcattgggatgggcggcgtgcagacagtggatgatgttcttgagatgtttatggctggagcaagtgctgtagctatagggaccgcgaatttcaccgatccgtatatctgtcctaaactaattaaagagctccctgtgcgaatgagcgaactaggcatcgaatcgctggaaagattaatcaaagaagtgagagaggaacgtgaacgatga

SEQ ID NO: 2741 - DNA (genomic), 237 bp, Enterococcus faecium; double-stranded, circular
  misc_feature (B) LOCATION 1...237
  hypothetical: NO
  anti-sense: NO
tttattggaggtagaataattatgcatatggaaagtattagatacttcgatggtgagaaacacattgagtattcaaacactcaagaagatgtagactttattagttttgaggaagataaaatcactaaagttaattttaaagacggaacgtgcttgaagatagtttcgccttatattgaatacaaatcaaaatgggaacaagatgattctgacgaacgagatcgctttggttggtaa

SEQ ID NO: 2742 - DNA (genomic), 309 bp, Enterococcus faecium; double-stranded, circular
  misc_feature (B) LOCATION 1...309
  hypothetical: NO
  anti-sense: NO
gtatgtggaggagaaaaaatgctagatatgaaaatcgaagattatcgaattaccagtgattctagaaatattgtcttatcgaaggtaagacgagatgaggaaggaaacattcgctacaccgaagcaaaagaagaatcacgagcagatattggatacttccaaactgtctcatcgtgtttaaaggcgatacaacgcgattacgtgttaagtgaagaaagaacgataaaaagtattatcgagtacaaaaaagcgttagaaaacatcactaggcagtttgaacaggcatgtgagatcgaggaggagaagtaa

SEQ ID NO: 2743 - DNA (genomic), 375 bp, Enterococcus faecium; double-stranded, circular
  misc_feature (B) LOCATION 1...375
  hypothetical: NO
  anti-sense: NO
gtatgtggaggagagataatggatctcattacacaatacagtgacatcatcctcaagaaaatcatgatgaagattcagaaagataaaaaatcaaaagaacgagctgaattagttaagttagaaatggctgaaacaggagcaggagtgcgaagtagcaggcattggaaagcagcagcaaacattgaattttattacaacgaaattcaaaaagggttcgatcagatgcgtgagctggatcggcaaacaaattggagcaagaaacttcatcaagatcgtttcaaatttgtagagaagtataaagaaatattagaagagtatttgaggaggacagcaaatgataaaaaaactcgttcaattcagcatggatttatatga

SEQ ID NO: 2744 - DNA (genomic), 1200 bp, Enterococcus faecium; double-stranded, circular
  misc_feature (B) LOCATION 1...1200
  hypothetical: NO
  anti-sense: NO
agcgccggaggccgcacggtgagccgggaacggtttcaggcacgggagaaaaaggttcagaagatgggccgggacggtctggtggaacagaaccgcgccaccggcgaagaaaagcgcgtcagccagcgcacggcagacaccgcctttgaccgcgcccgccctacggaacgggaggacatccgccgcccggcagcacggggcgcagacaccggcaaaaagcggaaacagccccgcactgcgccggagatggcggcagaacagacggaaccgctgcttacgccggaatatctggcagacagtactgccgaaccgccgcccgatgccccggcatccatgcgcggcgcggtggatatgccgttactggatgcgcccatagccgaagaacccactcccgcgccggtgaggaaacagccccaaaagcgggggaaaaagggcaagaagaagcaaagcacgaaattcacggaagacgctgcccgaccgggtagtgaggaaaaaacggctatgcgcggtgtggagggcgctcctgccccaaagcggcgcacttctgagggcggctcccgcctgcaatttgacaaggaagaagaaccggcagaccccgcagccgaccgcgcagcaatcagaaagcggcagacagcaaagctggccgaacacgccgccaaaccggaggataagctaaaatccgatggcaatccaaaggccggggaaacacgcctgaaatttgaggacactcccaaagatacggacatttccggcgatactgcgcccgatatgcccacccgccaacaaaagaaatataacaaggccgcctgccgcacggaacgcgcagaccgccgcgtggagcaagcacaaatgaagctgcctgccaaacgccgcctgcacatggatcaccagcctgacgaagccagcgggaagataaagcggcggctccgttttgaggatgaaatcctgccggagtaccaaaagccctccctgtcctcccgtgccggaaatgcggcaaaaacggcggcagtcttaaagctgcatggcaaactccgtgaatatgagcgtgacaacgtggctctggaatctgcccacaaaatcgaaatggttgccgaacagggcgcggggcgcgtcctgcgccggggaacggaaccgccgccgctccaaaccctaccgcactttgcggaaagcccagcagaaagcggcgcgggcgcacactga

SEQ ID NO: 2745 - DNA (genomic), 459 bp, Enterococcus faecium; double-stranded, circular
  misc_feature (B) LOCATION 1...459
  hypothetical: NO
  anti-sense: NO
aacagcggaggtggaaaaatggaagatctatatttagttaatcaagtatgttttcctttatatgccgcctctaaggaaatcattagacactacacttccctcctcaagccgctgaatcttacctatacccagtatcttgtgatgttagttttatgggaaaagaaaaagacttcagtgaaagagctaggaaatgatttgtgtctggattctggtacgctgactcccttactaaaaaagttagcagaaaaaaattatattaatcgtcagcgtgaaacgggtgatgaaagaatcgtaaatgttacgctgactcctcaaggtgctgcgttgcaaaaacaagcagaaggtattccacaaaagatcaagtcttatcttccacttgaacaggaagaattggatacactgcaacatctgacccgaaaaatgctagataattttcatcaagaccagaaaaagggctga

SEQ ID NO: 2746 - DNA (genomic), 654 bp, Enterococcus faecium; double-stranded, circular
  misc_feature (B) LOCATION 1...654
  hypothetical: NO
  anti-sense: NO
agtttaggaggtaaaacagtgagcagaaaagatagacatcaatctacagaaaataacgaaacacaagaaccatgggaacaaccaatctacgatacagatgatgaagtttcatcaagaagttctcagagacaacaaaagaaaggaaatacattatttctttcgctatttttgattttactggtcttatgtatcgctattccagcaggtgcttatttctggatcagaaatggatcaagcaacaatgcaacagcagcaacttcttctgaaacttcgacatcagtagtagaaagttctacaagtacaacaaaagaggagtcaactgagacttcaacagtagaatctagtacaatcgcggaagaatctactgtgtctcaagatacaggtgtaacgtcagaaagcagtattgcagcagagacaacaccgacttcctcaagtgaggcaacttatcaagcaggggattcaagcagcaatgcagcagaaacaacaccttcttcatcagctgcagccggttcaacaacgactgttcaagcaggcgaaggtccaaaacaagtggctgagcgtgcagggatcaccactgatcaattgtttgaattgaatggcttagatccaaacaactttatgctttaccctggtcaagaattaagaattaaataa

SEQ ID NO: 2747 - DNA (genomic), 654 bp, Enterococcus faecium; double-stranded, circular
  misc_feature (B) LOCATION 1...654
  hypothetical: NO
  anti-sense: NO
ctgataggaggaagaaatatgattgaattgaagaaagtgaacaaagcatttggtgaaaaaaaaataatcaaagatttgaatctaatcattccagatgggaaaacattagctatcgtaggtccttccggtggcggtaaaaccacgcttttacgtatcttggctggcttagaaagttctgacagcggagaattttatttagacggtgtaccgttcaacccattcgagcttaaaatgaaagaacaagttgtaggagtcgtattccaagacttccagctatttccacatctgaatatttttgaaaacattaccttagcaccaaaaatggtattgaaacagacaaaagaagaatacaccaaaaaagcagaagaattagcggcttcattagggattagtgatttattgaatatctatccttatcagctttctggcggacaaaaacagcgggtagcgattgccagagcattggctatgaatccacgggtattggcttatgatgaaccaacaagtgctttagatcctgaattacgccagcaagtcgagcgtttgatcctatcattgaaagaagatggggtaacccaaattattgtcacccatgatttagtatttgcagaaaatgtcggtgatcaattactaaaagtttccccaattcattaa

SEQ ID NO: 2748 - DNA (genomic), 240 bp, Enterococcus faecium; double-stranded, circular
  misc_feature (B) LOCATION 1...240
  hypothetical: NO
  anti-sense: NO
aatgtaggaggtatagatttggaagcaattcaagaaaatcgtaaggataatcaagaaacaagtgaaaaaaacaaaaaaaaaagaaaaaagaaagtagataaatttacggaaatgaccgataaaatcattgaaaagaaaggacttaaacctaaagactttgaccgtcaagcaatcaaagaagcacgacaaaaactgtatgatgattttgttaaagaaaacatatcacagcttttagactaa

SEQ ID NO: 2749 - DNA (genomic), 2049 bp, Enterococcus faecium; double-stranded, circular
  misc_feature (B) LOCATION 1...2049
  hypothetical: NO
  anti-sense: NO
cgatcaggaggaaaagatatattgaaaaagaggaggatcgtgctcattttaagcagtctcttagtgactaatatctttccgatcatagggtactctttggaattgaatcagttggagcatggaaatagaagagacgaagaaagcaaactcacttcgacattcgacagtttaatagaatccaaccagacacaagaaagcagtgaggatttaagtatttcgagtagtggagagaccactgacaacgtagaagctgagggttcggacaaacaaggactagaagatgcaccaatttctgcggttgagctgcctgacgatcccaatattatttctatcgataaaatttttcaaacacctatcggtactagcacgtccatattggaaaatgggaagttactgcagttgaacccagcagaaaggtctcaaagaggagctatttggtcaaataagaagattagtttactctcggattttacatttaaatcttatttatacttaggaaatcaacgagatagagcgggagatggcatgacctttacattgactggcgatcctagaatggctagtaatcccagtcaagttattggatcgccaggtatgggaattggctcatattctactcgttctggccaaccttacattgcgaatgcgctctcgattgagtttgatacgtataaaaatagtggttcttctgatcgaatggatcgagagataactgctgataatagagggcatggacatgtcgcttttgtcacgcctaaaccaaataataataattattctggagagcatactggcgtgacggtagctcctacatttctttctaatggcacatggcgcttgttaataattaaatgggacgcggagcaaagaagtcttacttatgatttggaaggtgtcggtcgctcttctcggattatacctgatctcattaggcagtttggttctacagaagtaaattgggggtttacttcttcaacaggtactttttttcaagaaaatgctgtcgctgtcacgcgacttccatcgaatgtcacatcaacagctgatgtaaaagtcaacgatagtgattatggggccatcgctgaagctggaggaaacgataagataactatcagaaatacattgaaggtcgagggggattttcttgaatataagaaaatgcagactagtatcgacctcccacaagaattaactattcccgagcatatcttgatcaatggaaatcaaattgatgccaaagatatcttgataaccggaaatcgagtcacgctaaatctgacagattattttattgctggagatacgttaataatcgaattggagacaactttgcaggaagtaattcctgaaaaagtactcactatgcattttgaataccttgaaaacgggaatttgattgagcaatcgaatgaaataaacctaaagatcgcaaagctgaaggagatagatatccatgtttattataaagataaagacagtcagattgatattgctgaaatgaaaacaatcactgggaaaataggagagaagtataaagaaactcctattgatattgaagggtatgtttttgactcggattcagcgaatacagaaggcatcttctccgaaaatacagaggatatctatttttattacagaaaaggcaaactttatctctcaactgctcctcaatatgtcaattttggaaaacataaaatatccagtagaccattaagtgaattcggacagttttcaggtgggttgaaaattatagatgaacgggcttttggaagttggaaattacaattgaaacaagagaaagttcttacaaatggagattttgagcttccagaagctctttcctttgttacctctgaaaatacaacggttatagggacatccgctgttacgattttcgaaagtgatcaaaagggtgaaagcgatttgtcctctcttttagattctacagctcatcgtggaatcagaataaatattcctgtagaaaaccaaagaatcggaacctttgaggggaaactatcttggatacttgcagatgtcccaggaaattaa

SEQ ID NO: 2750 - DNA (genomic), 1182 bp, Enterococcus faecium; double-stranded, circular
  misc_feature (B) LOCATION 1...1182
  hypothetical: NO
  anti-sense: NO
ctaacaggaggaattatggaaggaaaaaataagaagaacagaccggtatcgtggttttggcgctggtttttaaataatcaagtagtcacagccttacttgttgtattgttaatattgctgatcgtctttttatttacaaaagtttcatatttgtttgcaccaatctggcaatttttagcaatcgtaggtctgcctatcattttagcaggaatcttgtattacttgatgaatccggtagttgattactttgaaaagcgaaaagtaccaaggctttacagtatcattgggctgtttgttttggttgttgcactaatcgcatgggggagcgtagtgatcatccctaagattcaggaacaaacagtgagcttcatcagtaacttccctcaatatgtagatacgattgataataaattaaccgagattttgcgggacccgctgttcaaccaatttcgcgaacagttggaaacagcaggtgataagttcatgaattcggcaggcgatatgatccaagatatatctaagagtacagttcagagtcttggaagttttgtcggcgcggtagcgactattttagtggctctgctgacgatgccgtttatcttattttatctattgaaagacggtaaacaattagcaccttattttgtcaaatttttaccgacacgcatgcaaaaaccgacgttgaatgtgctgagtgaaatgaatagtcaagtttcttcttatataagaggacaactaactgtggcttttgctgtggcaatcatgtttatgattggttttgcggtcattggtttagagtatgctgtcacgttggggattattgcgggttttttaaacctgatcccttacttaggatcatttttagcgatgattccggctatctttttagccattgtagcaggtccattcatgatcatcaaagtactgatcgtttttgcagtagagcagacaatagaaggacgcttgatctctccattagtactagggaatcagttagcaatccatccagtaacgattttattagttctgctgacttctgggaaattgttcggaatcatcggtgtgatcttggggattcctgtttatgcagcagctaaagtagtgattactcatgtttttgaatggtacacaacaatctcttctctttatgaagaaaatccgttgaaaaagcagaaagaataa

SEQ ID NO: 2751 - DNA (genomic), 1764 bp, Enterococcus faecium; double-stranded, circular
  misc_feature (B) LOCATION 1...1764
  hypothetical: NO
  anti-sense: NO
agaaaaggagggatgatgatggcgcaaacaaatccacgcagccgcttggcagaaatcattcgagtgttcatcaattacaatgtagtgccaaactttgtacagcaaaaaaatcccgaacaggtaaaaaaagcctttgaagaactaggccccaccttcatcaagataggacagatgctttctgttcgagaagatttgctttcttctgccttcactcaaacattcaaaacattacaagatagtgtacctagcgacacattttcaacggtcaaaaagacgatcgaaacagaactttctctttcattatcagatatattcgatgatttttcaaaatcgccttttgcctctgcttctatggggcaggctcatcgtgccaagctgaagaacggtgacgcggtagtcgttaagatccaacaccctaacatcgccgaagagatccgacttgatcttcaactatttgaacgagcgatccctttgatcaaatacattcctgaaactagcgtagttgatctaaaaggggtactccaagaagtaaaacgttccttgatcaatgaaatggacttcttaaaagaaagtcaaaatggcgaacaattctatcaaaagaacaatggctggaaagagatccgcagccccaagatttatgacgctttttgttcgaaaaaagtgatcgtgatggaagaaatgtctggtaaaaacttgaatcatttaatgaacgccgaaaacaaaactgaaacttttatcactggaattcaaaacaagcagctgaaacaagaagttgcaaagcttttagttgagaactttatgaaacaggtgtttgatgatggttttttccatgctgatcctcatccagggaatctgctattccatgtactaacaaaagaagaacagacacaagctagccgaaaaactgaaacagtccatgaaaaagagttcggttcctttgcttttcgagcctccacttctgcagaagaccctgttgcgccatataccatcaactacatcgattttggtatgatggggcatctttctgcaggacttaggcaaaaactcacacaagccgttttagcgctgtatacgaaagatgcttatcgaatcgaaaaagcggtccttcgactttgtcagcaagaaggctcgtttgatgaaagtcggttccaccaagaactgacaagttttcttgaacagtattatgattctcctattgatgaaatcaacttgcaagaagtattcacacatgtcgtgacgatttgtcatcaaaataatctgcagttcgatcgtgatatcacgcttttgctgaaagcatttgggacattagaaggggtgatccgcgtcctcgatcctgaagtttccctcatggaagtcgcttcgccttttgctcaacattattttctcactcatctggatgtagaagatacattgaaacaaagcggattagacttattggaagggatgaaggctgcgcctaagatccctcaacagctccaccatctattagaaatgtggacttcgggacaaggaaaagtcaatttggaattgaaaaagcaagacaaattattgagcaggatcgaaagtatgatcaatcggcttgttttcggtatgattttagctgcattgatcgtagggtcctccctgcttgtccaagcagcacctgtagaaaacgcagaggtcgtttccttattagggatatttacgtatgctattgccgcattcgtcattatttttttggcaatcgatgcattgatccaaatgtataagaagaggaaaaagtag

SEQ ID NO: 2752 - DNA (genomic), 330 bp, Enterococcus faecium; double-stranded, circular
  misc_feature (B) LOCATION 1...330
  hypothetical: NO
  anti-sense: NO
gatcgaggaggagaagtaatggacgaactaatcacaaaagtagagcagtgggcaaaagataagagattggatcaagcagatccaaaagcacagtttttgaaagtagctgaggaattcggagaaattgcttcggcaatggcaagaagtaatgatgagctatttaaagatagcgtaggagacgtaatcgtcacactgattatcctttccatgcaaaaagggacaaacgtacaagagtgtttagaaatggcatacaacgaaatcaaaggacgcacagggaaaatggtagatggtgtattcgtgaagtcgagtgatttggagaacagcgaatga

SEQ ID NO: 2753 - DNA (genomic), 480 bp, Enterococcus faecium; double-stranded, circular
  misc_feature (B) LOCATION 1...480
  hypothetical: NO
  anti-sense: NO
aagaagggagggtcattcatgatcaaagaattcaaagagttcatcatgcgtggagatgtcttggatcttgctgtcggcgttgttattggtagtgcgtttacaagcatcgtaaaccaagtggtgcaaggcttgatcacaccactaataggttggtttgtcgcaatgatcacaggtacttctgatttagaaggagcactttcaattcttgactggtcgccgacaaaaggcgtcacatttgcgtttggtaacgttattagtgctatcattacatttctgatcactggttttgtcttattcttagttgtcaaagcggcaaaccgtgcgaagaatttacgctccaaagaagagcaagtggaagtggaagaaactcctactgcagaagattatcttagtgacatacgcgatcttcttgccaaacaagtggcagaagacaatacacatccagtagagcaaacaaatctttccgatacttctaaataa

SEQ ID NO: 2754 - DNA (genomic), 246 bp, Enterococcus faecium; double-stranded, circular
  misc_feature (B) LOCATION 1...246
  hypothetical: NO
  anti-sense: NO
cgatgcatttttctcaagcaggaagcaatgtggaaatggatattgatttgccgtttgcctattcgaaccaatttcctgctcaagtatacgcctatgatgacggtacgagagaaacgatccttttaccaagtgagattagacaatattaaggtgatagataaacgtggatgtcccttattttacagaccaggccaagttgttgattctttgactcaattcttggcttctttttatggagtttcataa

SEQ ID NO: 2755 - DNA (genomic), 285 bp, Enterococcus faecium; double-stranded, circular
  misc_feature (B) LOCATION 1...285
  hypothetical: NO
  anti-sense: NO
gtttgcctgggatgccatctggaaaaccgggctttccagcaaggatttcatcgcgccggacagcttcaccttcaagtccggccagtatttccagattggcaggacttacggcgcggtgtcctttctgcaaatcctcgccccggaactgaccgaccggatgctggcggatttcctcgatctggaaaacagcatggtggtgacactgcatatccagtccatcgaccagagcgcggcaatcaagaacatcaagcgcaagattaccgacctcgaccgcatgaaaattga

SEQ ID NO: 2756 - DNA (genomic), 960 bp, Enterococcus faecium; double-stranded, circular
  misc_feature (B) LOCATION 1...960
  hypothetical: NO
  anti-sense: NO
ctgcttatgggaaaagtagtgacactcggagaaatcatgttgcgattgtccacagagcagggaacccgtatcgattcaagtgaacgattcgctgcccattatggcggaggggaagcaaacgtagcaatttctttagctaattacggacatgaagcgatttttgctacaaaagtacctgataacgcattgggaaaagcagtcaaaaagcacttgcaatgttatggagtagatacgaaacaggtattatctggtggatcaagactaggtacttattatatggaaactggtagtggcgaacgcgccgcctcagtgatctatgatcgtgccggatcaagttttgctgaaatggatcatttggaatggtcgctagaggagttattccaaggaatagatatatttcatgtttcaggaatcaccccagctttgtctaaaaaatggcaaaaaatgacgaaacaggtgatagaagctgcaaaaaaagctggctgcctgatcagcttcgatatcaactatcgtggaaaattatggacacagcaagaagccagcgaagtaatccatcagcttttacctttagtagatatctgctcagctggaaaaatggatgctctttatttgttaggtatcgagaaagcgccagaagcagaagaacaacctctaatttattattatcaaaaaatgcaggaaaagttcccgaatattcaggtgttttattcgaccaagcgtaccgttcattcagcaagtgaaaatgaattgaaggggacattgtggatgaaccatgaatatgtggaatcccaagtccatagaatcaccccaatcgtggatcgagtatgtggcggagatgcttttgcaggtggcgtgctccatgggattttatccaatatgtctccgcaagaaatcattgattttgctacgggcagcttctgccttgaagcatacgatccatggggactgcaaccaatttag

SEQ ID NO: 2757 - DNA (genomic), 471 bp, Enterococcus faecium; double-stranded, circular
  misc_feature (B) LOCATION 1...471
  hypothetical: NO
  anti-sense: NO
aaacagatgggagattattatgatcttctgttacaaaaaagtgattcttatcacgaaaaggagtggtgcacgttgttaacattatatacttccccaagttgtacttcctgcagaaaggctcgtgcgtggttgcaagaacatcagattccatttgttgaacgtaatattttttcagaaccattgaacagttctgaattaaaagcgattttacaaatgacagaagacggaacagaagaaatcatctcgacacgttccaaagtattccaaaaactgaacatggatttagatgatctgccgttacaagaattattggaacttgtgcaaaacaatcctggattgcttcgccgtccaatcatgattgatgataaacgtctgcaagttggttttaatgaagatgaaattcgtcggttcctaccgcgcgatgtacgacaattagaattacgtcaagcacaattgatggctggattatag

SEQ ID NO: 2758 - DNA (genomic), 1028 bp, Enterococcus faecium; double-stranded, circular
  misc_feature (B) LOCATION 1...1028
  hypothetical: NO
  anti-sense: NO
cggctgtggggatcgaccccgtgacgaatacattggccgtgcgcccgctgtcctctgtgttacagagcagcctcacccccggcgaacagaccgaccgctacggcgtgtatatgcagacctacggcaaccggcaggcgtttggaaatccctttggtttttcctggcttggatatgtgagcagcggctacggctggcgggtacaccctgtaaacggcgaaaagagcctgcaccggggcattgacctcgctgtggcgcaggggactccgattctggcggcgcaggacgggcgtgtggtatcggccggcgatgcaggcagctatgggctgtgcgtggtgatcgaggacgataaaggctaccagtcccggtatgcccactgttccagcttaaacgtcagcgccggccaggaagtaaaacgcggggatgtgattgctgctgtcggcagcaccggcaacagcacggggccgcatctccatctggaagtcatgttaaacggcgaatacttgaacccttatttcttcgtggacaatggcgacgatggaaccggcgcaatccccggcaccccgggcgggccggctatcccggactattccggcgaaccgatgggcgatggcagctttgaagccatgctgcgggaagcggagaaatacctgggctatccctatgtgtggggcggctcccatccatccacttcctttgactgttccggttatgtttcgtgggtcattaaccactcccggcgtgggcagcgtcgggcggcaaacggcacagggcctttacaacctgtgtacgccggtatctgcggtgaacgcacagcccggcgacctgattttctttaccgggacatacagctcgccggggccggtcagccacgttgggatttatgtgggaggcgggcggtttattcactgcggcgacccgatttcctacgccaatacgggaagcccctattggtctgcccatctgtacgggtatggcagaataccctgaaacacttttttcaggcatttttgccagaaacggaggtatga

SEQ ID NO: 2759 - DNA (genomic), 378 bp, Enterococcus faecium; double-stranded, circular
  misc_feature (B) LOCATION 1...378
  hypothetical: NO
  anti-sense: NO
acaaatgtgggagaaacagcaattagaagcgaagatagaaggaggcgaggcctgatggatgaaaattatcaatcggaatggacaaaatcgattccacttaaagaacagaaaaagatcatcaaacgactgatgaagttcgccaaaccttttagaagaacgttcatcgttgctatcttatctgcgtttgctttgtctgtgatcaatggtctatcgccaacgatcatccaaacttttatggatgatcctctggctaaacagtcggctacgacacaagttattttgtttttttgccggtatgttcttatttggagtcatactaaaaagtttcatttggtttttcccatggtatttgtattccatggcccctttgagaactaa

SEQ ID NO: 2760 - DNA (genomic), 1218 bp, Enterococcus faecium; double-stranded, circular
  misc_feature (B) LOCATION 1...1218
  hypothetical: NO
  anti-sense: NO
agtggtgtggggaagatgaagatattatatattaatacagtatggggctatggaagtactggtaaattatgtgtttatcttcaaaactatctagaaaaaagaaatgttaattctattgttgcgtacggccgaagatttgaaattccttatgcaaaaagaaataatatatattactttagtagtaaactagataattatacacatgctttttattcttttttctttgatttacatgggcatgcatctaaaaaaagtacaaagaaattgattgattttatcaaaagagagaatccaactgttattcatctacacaaccttcatgggtactatttaaattttcctatgctttttgagtatcttaaaactacagagattcctgttgtgtggacacttcatgatatgtggcctatgacaggtcatagtgcatttatggatgaagaattaatttatacaaaaaaagactactatatttttgattcaaaaaaaaattatccacaatcattaagtggacgctttcaaaaaaattttttattaaaagaaaaaagtttcggaaacctaaaaaatataacaatagttactccttctaaatggttgcaaaacattgtacagaatacttatttaaataaatatgaaacagctgttatatataatggggttgatttaactccttttaaaagagataggaatatcaaaaaatatactaaaaaaacgattttaggtgttgcaaatatatgggaagaaaggaaaggtctgaagtatttcttagaactatctaaaaatttagatcaagatacgcaaataataattgttggcaaaataccagaaaaagttaaattacctcctaattgtttaaatatcacaagaacggacaatgtaactgaattagccgaaatttatcaaaaatctcatgttttttttaatcctactttaaacgataactttcccacaactaatattgaagctctagcttccggaattcctgtagttacttttgatactggaggaagtggtgaaatagttctaaacgatagaataggatttgttgttaaacatagaaatattgatgctattaaaaatagcttaaaaaaatttttgtacactgaacaatcagtggaagatgattgccgaaaagcagcggaaaatttttcagctgaaaatatggggaaatcctattaccaattatacgaaaggattattaaatttaaagctgatgaatag

SEQ ID NO: 2761 - DNA (genomic), 471 bp, Enterococcus faecium; double-stranded, circular
  misc_feature (B) LOCATION 1...471
  hypothetical: NO
  anti-sense: NO
ggaaacgtgggaacactttttaaaaaaagtgttccaataggctgtgcctattacgtttctctaaaacaaaagtgggtacaaaatattcgatttatggatagtgtatggatagtaaaacagctatacatggatagcatatggatagactccatagactatccatacttttttcggagggtgaaaatggaaattaaagagattaaagtaagaggtattaataaaaaatatgttcaagaaattgatcatagatgcgtagaattaacagaacaaactggtcaaaaatggagtcgaaatgattatctaaaactattgattgaaaacgactttgaacgtcctttaatggactacaagaaagatcaatttgatcgtttattggaaaaatttacagatgttcagctgcataatacaaaagttttggaagcatacacgaacgaggtcaagaacttaattgaaatattaatcgcacattag

SEQ ID NO: 2762 - DNA (genomic), 183 bp, Enterococcus faecium; double-stranded, circular
  misc_feature (B) LOCATION 1...183
  hypothetical: NO
  anti-sense: NO
tctagggtgggaactgctatcgatgttgccaagaaccgaattaaaacgaatcaaagacgacatgctggacaaatatctgccagaagggaagtgagttctgatggcacgattgaatgtgaatccgacccgcatggaattgactcgattgaaaaaacagttgacaactgccacaagagggcataa

SEQ ID NO: 2763 - DNA (genomic), 1011 bp, Enterococcus faecium; double-stranded, circular
  misc_feature (B) LOCATION 1...1011
  hypothetical: NO
  anti-sense: NO
tttgttacgggaggaatacacttgttaaaaagacgtataaaatacagtgcgctaatgatgaatctccttatgctcagtaccccggttttaatttctgtcgttgaagttgctgctaacgaacaacagtctgtgaacgaagaaaatgcacacgtgaacattgaagggatgtcaacaatggaggaaataccaagaactagtgaagatatggatacggaagaaggaaatgatcctatgatgaaagaatcagaaaatgaaaagacaaaaaagcaatctgaagaagcaaatgaagagtggaaaggggttgttttcggagaaagcacaagtgctagtaggtatgccattgaaccattagaagacggcgtgcggctctcttccacgaataacggcggaaaattccagtcaagcggatcagatggaatgacctattattatcaagcaatccccaaagacatcaactttaggatgcgggcgacgatcgaaatagaatcttggacctatacgaatgcccaagaaggatttgctttaatggtaagagacgcagtaccaaaaaatcatttgtttgggcaggcattttattcaaattcatttgccatactaggcagtcggatcgaatatgtctgggactcggatagacaagaagtggtcaacacgagcggcagcaaatatacgatgcgacttggattggggacacgggcaatcacaggaatatcatctgaagatccgcaagctgcgccagctcctgggagtgtctcagtggaaacaacacctttagagacttcagcagggttcttggaaaaagaaacaggttcttataatatattcggaaacggtcatgggaatctgtttccggccacgaactcgattactaaactggacgtagagatgaaaaaaacgaatactggtttagaggcatattattacgatcctgaaacaggagaagaaatggcttctgacatcatgtatgactgggaaaaattatacgcttcagatgaatcggttatttatgcatga

SEQ ID NO: 2764 - DNA (genomic), 1197 bp, Enterococcus faecium; double-stranded, circular
  misc_feature (B) LOCATION 1...1197
  hypothetical: NO
  anti-sense: NO
gtcgatcagggttcagataaaacagtcatgatccatggcggatttcgagggaattggaataacgggatcgttacagaagaatacaatgatttttataaggccgggtataatttattatttgttgattccagagcgactggtaatagcggaggcgattatgtgacctatggacaatatgagtcagatgacgtcctttactggataaatcaagaagttcgagagcggccatctcaaaagattttactttatggtggttcgatgggagcagctacgatgatgtctgtattagcgaaagatattcctgtcaatgtcaaaggaattattgaaaattgcggatttgcatcaattgatgaacaactacgttttacgtacagccagacagtagcccccgcactaccggatgccataaaaaatcagttagacatcattggggatcaagagcatgaagatttatttatgggccttttgaaacaatactattttgatcaggagatgcatttggatacaaaagctgctctacctacgattggaatgtcagattcattgcctaaattgattatccatggaacagcagatgatgtagtacctgtgtctaacgcgcaaaaattatatgagttatcaggagggtataaagatcttttattagtagaaggagcagggcatggaaaggcacaggaagttgaccatgctgcctacacgaaacatgtaacggactttttgaaagtagtgttccatgatcagataaacgtaaagtatgtggatgaaaacaataaaagtctactcaaagaccaggacgaaatccagctttacggagcttatggagaaaattatatgacagagcaaaagacattcgaaggatacgaattagcaaatgttgaaggaccgactgaagggatttttaatgagacgataccaactattattttctattacaaaaaaatcccagtagctccaccaaaaaagcaagatccgacagagaatgcagacaataagggaaagaatgaacctcgagaggatcaatcaagtgatgatacgcaaccgattcagatgacagtgaaagtacaaaaaaagacagatgcaaaaaaaagaatgttgccgaaaactggagaaaagaaacattcgcttctcatttattcaggtggatttttatctgttagcacgattatcacatggatttggcgaagaaagagagggtaa

SEQ ID NO: 2765 - DNA (genomic), 189 bp, Enterococcus faecium; double-stranded, circular
  misc_feature (B) LOCATION 1...189
  hypothetical: NO
  anti-sense: NO
aacaaaaagggaaaaaatgggtttgtaattcacgtatttctaacaaaaaaaaggatcagattaaagaagagattaaacaaagaatcaaagatattcaaaagagtcctacagcacaaaatgctctcctgtttaatgctctcgtgctcggtgttcataattatttcaggtatgccactcatattaatttag

SEQ ID NO: 2766 - DNA (genomic), 1020 bp, Enterococcus faecium; double-stranded, circular
  misc_feature (B) LOCATION 1...1020
  hypothetical: NO
  anti-sense: NO
tgtgaaaagggaggaatttttatggaaatctatgacattacaatcatcggtgcaggtcctgtagggatgtttgccgctttttacgcaggaatgcgccaagctaaaacaaaaatcattgacagtctacctcaacttggtggtcaattagcaactttgtatcccgaaaaatatatttacgatattcctgggtatccagcaataaaagcaagtgaattaatcgatcaattagaaaaacaattaactacttttaaccatacattccatttaaaagaagaagttctctcgcttactcgtgaagacgaagttatcgagattactacaaataaaggcatccattattccaaagcagtcattttagctttaggaaatggttcattccagccaagaaaattgaatttagataatgctgaatcatttgaaaaccacggattggattatttcgtgaatgatttgatgaagtatgctggaaaaaaagtcgctattgctggaggtggtgattctgctatcgattggacgttgatgttagagcctattgcaagcgaagtttacttgattcatcgtcgcccggaatttcgtgcgcacgaacatagtgtatcacgcttgaaatcttcatctgtcaacttgcttactccctatctcatcgatggattatcaggcaataatggggaactgacagatatccggttaaaaaaagtgaaaagtgacgagacgattgatttgatgattgattctctgatcgtcaattatggattctcttctaatttaaaacatctttcttcttggggacttgatagtaccagaaatgccattactgtaaaatcagatatgtctacttctattccaggcgtttatgcagctggtgacatctgtacctatgaaggaaaagtgaaactgattgctactgggctcggtgaagcacctactgcagtgaacaacgctttacactatattaatccaaaggaacgaactcagcctggtcacagcacaagcttatacgataaaaatcttcgtcctagttga

SEQ ID NO: 2767 - DNA (genomic), 1314 bp, Enterococcus faecium; double-stranded, circular
  misc_feature (B) LOCATION 1...1314
  hypothetical: NO
  anti-sense: NO
ctaagaaagggagagaaaactatgagtttccaaagaccaaaaggaacaaatgatattttgccaggcgaatcagaaaaatggcagtttgtcgaagaaacagcacgtttattattcagagattatcagtataatgaaatgcgtacaccgatttttgaacactatgaagtgatatcccgaagtgtaggggatacaacggatatcgtttcaaaagagatgtatgatttttatgacaaaggggaacgccatgtgacgcttcgaccagaaggtacagcaccaatcgttcgttcttttgttgagcataaattgttcggcccagagtatgcgaaaccgttcaaaactttttatatgggaccaatgtttcgctacgaacgccctcaaaaaggacggttacgtcaattccatcaaatcggagtagaagcatttggatcagaaaaccctgcaactgatgtggagagcatggtgatggcacttgatttcttcaaacagttggggatcacgcaaatccggctagtcatcaattcattaggtgataaagaaacgcgtcaagcctatcgtcaagcattgatcgactatcttttaccttttgaatcagagctgagtgaagactctaaacgccgccttcatgaaaatccattacgcgtattggacagtaaagacaaacgagatcaaaaatttgtggcagaagctccatctatcttagattatctaagcgagcctgctcaaaaacattttgataccgttgtttccatgctggatgcattggctgttccttatgaaatcgacagtaatatggttcgcggactagattattacacacatacgatttttgaaatcatgagtgacgcaccaaaaatgggggcacaagcaacgatttgcgcaggcggacgttatgacaatctagtggaagaactaggtggtccttcaacacctggcttcggatttgcaatgggtatcgagcgattactcttgactatggaggcagaggaagtagttatccctgcatttaatgagttggatgcttacgtggtcgcactcggagacgaaacaaatatcgaagcattgaaagtggtccaagcgattcgaaactttggtttttcagctgaccgcgacttcatgaaccgtaaagcaaaagcgcaatttaagacagcagataaagcgaatgccaaattagtattggtgatcggtgaagatgagcttgctagtcaaacgattaatgtcaaagcaatggcaagccgaaaagaaaaaagttttccattagaagagatatatgaacattttgatgaagtctatgatgaaatgactttattcgagtag

SEQ ID NO: 2768 - DNA (genomic), 1668 bp, Enterococcus faecium; double-stranded, circular
  misc_feature (B) LOCATION 1...1668
  hypothetical: NO
  anti-sense: NO
gaaaagaagggacgaaacaaagtcatggcttatcaatttaaattgccggatatcggtgaaggaatcgcagaaggtgaaatcgtcaaatggttcgtcaaaccaggagatacgatcaatgaagatgatacattactagaagttcaaaatgacaaatcagtagaagaaatcccgtcacctgttacaggaacggttaaaaatgtgattgttccagaaggtaccgtagcaaatgttggggatgtattagtagaaatcgatgcaccaggacacgaagacaatgaaggggacagtggtgtagccgcagaatcccaaactccagctaaaccggctgctgaacccactgttgatacagaatcagctggatcgtcaagcgaaggagtcttccaatttaagttaccggatatcggtgaaggaatcgcagaaggtgaaatcgtcaaatggttcgtcaaaccaggagatacgatcaatgaagatgatacattactagaagttcaaaatgacaaatcagtagaagaaattccgtcacctgtcacagggacagttaaaaacgtgattgttccagaaggcactgtagcaaatgttggggatgtattagtagaaatcgatgctcctggacacaatagtgcaccgtcaactagtgcgccatcagctgaagcaccaaaagaaaaagtggaaacatcaggttcagcaagtgtcgttgaagctgccgatccaaataaacgtgtattggctatgccatctgttcgtcaatttgcccgtgaaaaagatgtagatatctcacaagtaactgcaactggaaaaggtggcagagtaacaaaagaggacatcgaaaacttcttggcaggtggtccaagcagtgcaccagcgaaatcagaagcgccagaagcggcagcaccgaaagaagcagctcctgcagcagaaagcaaaccagctgcaccagcaaaaccattcaagtccaacttaggagacttggaagaacgtgtagcaatgacgccaacacgtaaagctatcgctaaagcaatggtcaacagtaagcatacagctccacacgtgacattgcatgatgaagtagaagtgtctaaactatgggataatcggaaacgatttaaagaagttgctgctgcaaatggtacgaaacttactttcttgccatatgtcgtgaaagctttaacagcgactgttaagaaatacccagtattgaatgcatctatcgacgatgcaaaccaagaaatcgtttataaacattactacaatatcggtattgcaactgatacggatcacggactatatgtaccaaatgtgaaagatgcagaccgcaaaggaatgtttgctattgcagacgaaatcaatgagaaagcaaaattagctcatgacggcaaactatctgcagaagatatgcgcaatggaacaattacgatcagcaatatcggatctgtaggtggcggttggtttacaccagtcatcaactatccagaagtagctattgtaggtgtaggaacgattgcacaacaaccaatcgtaaatgctgaaggcgaaatcgttgtcggtcgtgtgatgaaactgtcattaagtttcgatcaccgtatcgtagatggagcaactgcgcaacaagcaatgaataatatcaaacgtcttttagctgatccagagctattaatgatggaaggatga

SEQ ID NO: 2769 - DNA (genomic), 342 bp, Enterococcus faecium; double-stranded, circular
  misc_feature (B) LOCATION 1...342
  hypothetical: NO
  anti-sense: NO
aagaggaagggttgtatgtcagtgattttgatttcaggaacgattggtgcaggtaagagcagtttgacggatatgcttgcaaaagagattgattctaaaccattttatgaaaatgtcgaagataacgaagtattgccgctcttttattcaaatcctgagcagtacgcttttttattgcaaatcttctttttgaacaagcgatttttagcaatgaaaaatgctttagtgaacgatgacaatgtgctagaccgatccatctatgaagatagcctgttgttccatctaaacgctgatttaggtcgggtaacggatatcgaagtacagcagtacgatagcttatga

SEQ ID NO: 2770 - DNA (genomic), 762 bp, Enterococcus faecium; double-stranded, circular
  misc_feature (B) LOCATION 1...762
  hypothetical: NO
  anti-sense: NO
atctttgagggggaatgtacgatgaaattaactgttttaggatgcttaggagcgtatccttataaaaatcaagggacaacaggttatttgcttcaatctgacgagttcaatttgttgatcgatgcaggtagtgctacgctgatcaaattacaagaacaccttgatccacttgatctagatgctgtgatccttagccattatcatcatgatcatattgctgaccttggtgtattacagtattactggcaacttcatcctaagagaaatccggagacattgctttcaatttatggacacacaaaagattccattcactttgaagaattgacgatggaaaatgtctcaaaaggacatccttattttgaagctgaagaattaaaaattggtccttttctgattacttttatggaaacaatccatccagtagtatgttacgccatgcgtatcgtagaagaaacaacggggaaagtattcgtatttacaggtgattcaggttatttggaaagtttcgctgattttgcgaaagatgctgatttgtttctagcagatacctatctttttgaaggaaatgaacatcatcatgcccatttcacttcaaaagaagctggagaacttgcgaaatcagctaacgtaaagaaacttgtacttacacacctacctcagtttggtgatttagaacaattgaaaaatgaagcgcaaaaggcagcaggcaaagggattgatgtagaacttgctgcagttgacaaagtgtttaacatttag

SEQ ID NO: 2771 - DNA (genomic), 1173 bp, Enterococcus faecium; double-stranded, circular
  misc_feature (B) LOCATION 1...1173
  hypothetical: NO
  anti-sense: NO
aagttggagggtgggacgatagccagattaggcagtcgtctcacctttcaaaatgaagagaggaaaaagatgcggaaaaaactactattttccttaatcacactgggcatctcttttatggtgctaactggctgcagcaactcagcaaataaaacaaccactgaaagttcagcagctaccaagatattgaaagatccatattctgatgaacagttcttgttagggacttacgttcgtatccgtgtgtatgatgaaggcaaagaatcaacattgaaacctgccttcgatcgagtaaaagaacttggtgataaaatcacgatcaatcaaaaaggttctgagatcgatgaagtgaatgagcaagctgggatcaaaccagtaaaagtttctgatgacgtctacacgttagtcaagcgggcctacgaatatagccaagattctcaaggcggattcgatatggcgattggtgcaatcacacaattatggcgaatcggttttgatgacgccagaaaaccttcccaagaagaaatcgatcaggcattgaaattagtggattatcataagatcgaactaaatgacaaagaaaaaactgtttatctaaaagaaaaaggaatgatcatcgatttaggtgcaatcgccaaaggttacattacggacgaagtagtgaaagtcttgaaaaaacaaggagtgaccactgccatcgttgacttgggcggtaatgtctatgtcttaggccacagcccaagaggcgaaaaccaagactggacagtcggcatccaagatccgaacatggctcgcggatctgttttaggttctattaaagaacggaacaaaacattagttacctctggaatttacgagcgttatttagaagtagatggcaaaaaataccatcatttgtttgatccaaaaacgggttatccgttcgacaatgatatcgcaagtgtcacgatcataacagataaatcaattgatggtgacgggttgtgtacagcagtcttttcaatgggtgtgaaaaaaggactggaatacgtcgaaagcgaattgaataacgggacggaagcgatcttcgtgacaaaagacgataaagtatatgtgaccgatccaatcaaagacaccttcaaattatcggaggactcccattacacgatgggtgaccgttctgaactaaaataa

SEQ ID NO: 2772 - DNA (genomic), 390 bp, Enterococcus faecium; double-stranded, circular
  misc_feature (B) LOCATION 1...390
  hypothetical: NO
  anti-sense: NO
caactttgggggaataaaatgtttgactttaatgaatatttatctatttccaaacaaattgaatcagatgataaatataattctaaagaatcttatagaagaactgctgtttcaagagcatactacagtgcttttaaaaaatctgatgagtatttgaaagaaaattatgatattatttataatggaagtagcggaaaaggaagccaccaaaccgtttggaatttgttttcaacagttaaggaattgaataccttaggaatacataatagtgggtatagaatgttagagaaaagaaaatgtgctgactatattcctaatgaaaccattacgaaaacagatatggcgctgatgaatcgagaagcagaaaaaataataaacaaactcacctaa

SEQ ID NO: 2773 - DNA (genomic), 747 bp, Enterococcus faecium; double-stranded, circular
  misc_feature (B) LOCATION 1...747
  hypothetical: NO
  anti-sense: NO
acaagttgggggacacgatttcccggattttctcgaangaaattcaagcggtattggaacaacaaattattccaaacttttggaatgactgccgcatccaccggtttaagtgaaagaacagccaaagaaaacgaactgtcttttgaagtcattcatgtatcaggaaaagatcatgcaagctattatccagaagcaacagatattttactgaagttgatcttccatccagagactggcgagatttatggtgcacaaggtgttggggcaaaaggtgtggataaacggatcgatattttagcaacagcaatcaaagggcatttgacgatcttcgatttaccggaattagaattgacgtatgcaccgccatttggctcagccaaagatccagtaaacatgctaggatatgcagcaatgaacattgcagaagggcttagtgaaaccgtacaatggcatgaattgccgacagaactagcaaaaggaaaaattttattagatgtgcgaacagcagaagaattggaaaagggcaaattcaaggaagccaaacatatccctttgaatgaacttcgggaccgattaaatgaattagacagccaacaagaatatatcgtcagctgtcatagcggattacgtagctatctagcggaaagaatcttgaagcagtctggctaccacgtaaaaaaccttgatggtgcattttctttatatcaaactgtccgacctgaagaactgatatatcctaacaaatga

SEQ ID NO: 2774 - DNA (genomic), 792 bp, Enterococcus faecium; double-stranded, circular
  misc_feature (B) LOCATION 1...792
  hypothetical: NO
  anti-sense: NO
agtaaatggggtgattttatgttgaatgaagtggagaatagacagcaggagattgtgaattatctaaaaaacaatcaatttgcaagagtcatcgatttgatcgagttagtaaattatagcgaagccacgattaaacgtgaccttgtttttctggaaaaaagtggattgatccgtagagttcgcggtggcaccatgcttgttgacaatcgaaaaattgacgtgccttacctgatgaagattaccaaattagaagaagaaacagaaaaacgtaagattgcagatacagcttcttctttgattcgagatgatatggtcttgttcttggattccagtacaacctctttacatttagtcagaaacttagcaagatttgatggtttgcagattattacgaatggcatagtcacagctgctatgttgagtgaatacacaacggcaaaagtatttgtattgggaggggcaattgttccgaaacgagcaacaatcaacggttcaaaagcctataacgatgcattgtcatattatgcggatttagcgataatgagttgtcgcgggctagatttcagccaaggagtaacagaaactcatgaaggagaggcaatggtcaaaaaagcttttagaaaacaatcagaccggcttgccgttttagttacacagcaaaaaattgcacataaattcatgcatcaagccattgcttttcatgaaatcgattatctggtgacaagtaaagaactgacaaaagaacagtatgcgaaagtaaaggaacaccatatcgaatgtctgtacggataa

SEQ ID NO: 2775 - DNA (genomic), 1326 bp, Enterococcus faecium; double-stranded, circular
  misc_feature (B) LOCATION 1...1326
  hypothetical: NO
  anti-sense: NO
agaaaatggggtggaactgaaatgatctcaatcacccatacaggtaatttattcttagatacttgtttgtctattatgtatttttttctcgtttcttatccgattttaggcggatttgtatggtttattggtgtctggtgttatgtgtttttatacaaacataagcaaaaagaatgggtagatgttcccttgagtgtcgaaccgttcatcacgatcatggtgccagcccataatgaagaaattgtgatcgaatatacaatcgagtatttgatgacgaaattgaattatcacaactatgaggtattagtgacagacgatggttcaacggaccaaacaccagaaatattagctagactgatgaaaaaatacgctaatcttcgtgtggttcggatcgaaaaaaataaaggaaaagcccacgcgtttaatatcggacttgcctttgcaaaagggaaattgattttaagcaatgatgcagacacggtaccggagccagatgcactgattaggtatgtgaattatttcattcgccctggtgcaagacatattgctgcggtcactgcaaatatggatgtccaaaatcgtaccaaattgattgcaaaatctcaaacggttgaattctcaagtatcgtgggcatcattaaacgaacacagtcagctgttttcggtggtctttatgcgtacagtggagcaaatacgatgtatcgaaaagaagccttgatcgatgtgggcggattcagacaagatcgagcgacagaagacatcagtattgcttgggatcatcagttaaatgactggttatctgtttttgctcctgagattatctttttcatggaagtacctgtgacgttgaagatgctatatcgacacagaaaacgttgggcaaaaggtggaacagaagtctggctgacgaatttcaaaaaagtgatgctccatccttttaaacatattggaagaacgatcatcttcattgatcaaacattgagtattgtctggtcaatattcttttgtatttccgtagttctttttgctggattaatcgggcattatgtatatcaaggaaactacgaacagatttatattacttttacattcagttttgtgttcatctgctttgaaatggtcgcaggatttttccagttgctagcttcgctgattgtagatgatcgacgaagaaaattgaaataccttcttttcgcaccactatatatgcttttgttctggatagtgaacgcgataacgatcgtgacgactttcattccagcagtcaaaacgattttaggttatggaagcgggacatggaaaagcccggaacgtacaaaaaaataa

SEQ ID NO: 2776 - DNA (genomic), 282 bp, Enterococcus faecium; double-stranded, circular
  misc_feature (B) LOCATION 1...282
  hypothetical: NO
  anti-sense: NO
ggggaatggggagcgatagcaggatcaataaccgctatcgtttctttgattttattagtaattagaccgattgttgcatcatttacaaaaattacgaaaacactatcacaagtgagttacaacttggaactattaacaaaagatttagaatcgagcaaatcagatcgattgatgattcatgaagaactaaagaaacacgatgaaagattagatacacatgcagaaaaattggtagaacacacacaacaaattaaaactttatttagggaaacatctcgataa

SEQ ID NO: 2777 - DNA (genomic), 1566 bp, Enterococcus faecium; double-stranded, circular
  misc_feature (B) LOCATION 1...1566
  hypothetical: NO
  anti-sense: NO
cgttcccggggaggaaagctatatccaaactgtacgcggaacaggttatgtgatgcgctcgtgataaagccgaaaaaatcggaaaaaagagaactgaaagggccctccttgacaatcaagtgggcctttgcgagttctttcttcatattcgttgtgtttacaattttcgctgtcattacctataaatcatctatcaatctgattgtggcaaaagaaagaaacaatgtagagcgtacgatttcagaagtagcttctcgtttggctaactcggatgaagaactgacattagtaaatacgtatcgtaatctgacgaaagcgacaaatgacggagatgaggtcgtagatcatacttcactggtcgaaggaaacttaatgaagatcgattcctttatagctgagctagggcagccatcaatggatctttatgtttatgatttggacgagaacttgatttttaaaacccatgaaaacagtcgaaacctgattcagactacacgtaaagttccaacgatcgttacactagaaggaaaaactggctttttatctatccagcctatatattctaaaggtacaagagaaaagatcggctatgcgcaaagcttctatgaattatcttctttctatgatattcgaaataagctattattgactcttattgttttagaagttgtttctttgatcttaagtagtattttaggtttctttttatcttcttatttcttaaaaccactcaaggtactcagagatacaatggatactatacgtaaagatccgcaatcagatatccacatgcctgaaatcgacacaaatgatgaattggcagatttagctgaaatattcaatgagatgcttgaccgtatgcgtttgtatattgaacaacaagagcaattcgtggaagacgtatctcatgagttaaggacacctgttgcaattattgaagggcatcttagtctgctaaatcgttgggggaaagatgatcctgagatattagaagaatcattaagcgccagcatgcaagaaatcagccgtatgaaaagcttagttcaagagatgctagacttatcaagagcagaacaagtagatgttcattatgcgaatgaaacaactaaaggaaaagaagtcacctatcaagtttataataatttcaagatattatatccagactatgtgatcactttagatgatgatttgacaaaagaagtgaccctgcaaatttatcgtaatcactttgaacaattaatcattatcatattggataacgcagtaaagtattcaactacacgaaaagaagtccatatctctatttcttccactctgaatgaatttgagatcgcgattcaggactttggcgaaggaatacccaaagaagaccttaataagatcttcaatcgtttttatcgagtggataaagcaagagctagaacgaagggtggaaatggtctggggttgtctatcgctaaacaactggttgaaaactataaaggacgtatcttagcagaaagtgtagtagggcaagggacaatttttagaatctttattcctatcgcaaaggcagaagacaagtaa

SEQ ID NO: 2778 - DNA (genomic), 324 bp, Enterococcus faecium; double-stranded, circular
  misc_feature (B) LOCATION 1...324
  hypothetical: NO
  anti-sense: NO
atgatacgggggagaacaaagatgaacaaattgaacattttattcgtatgcggtgcaggtttaggaagtagttttgcagcacagatgtctgctgaggatgttttgaacaaattaggagtagaagccaaactggaccattgtgatatttcttccgcagtttccatgaaaccagatgtgatcatcacagcagaaaattttcgttcgcagttcgaaaagttcgcagttgatcctaaaacggcgatgatctatttgaaaaatattgtttcaaaaaatgaaattgaagaaaaaatcaccccagttctgcaagataagggagttatctaa

SEQ ID NO: 2779 - DNA (genomic), 1242 bp, Enterococcus faecium; double-stranded, circular
  misc_feature (B) LOCATION 1...1242
  hypothetical: NO
  anti-sense: NO
ccaaagcggggaaatcctgcaggagctgtttttgagttacagaaccgagaaggagaaacgctacaaaccggtctaactacaggagaagatggaaaactggcaattgacggtttagcaccaggagcatatcagctggtagaaactcaagcgccaatagggtatgaattagatgcgacaccaatcgagtttgagatcgaaagaagtcagacagcggtggtagaattgacgaaagaaaaccgacttacaccaggcggtgtcgtgttgacaaagatcgatgaccaaagcggggaaatcctgcaaggagctgtttttgagttacagaaccgagaaggagaaacgctacaaaccggtctaactacaggagaagatggaaaactggcaattgacggtttagcaccaggagcatatcagctggtagaaactcaagcgccaacggggtatgaattagatgcgacaccgatcgagtttgagatcgaaagaagtcagacagcggtggtagaattgacgaaagcaaaccgacttacaccaggcggtgtcgtgttgacaaagatcgatgaccaaagcggggaagtcctgcaaggagctgtttttgagttacaagatgccaatggaaccgttctgcagtcaggtctaaccacaggagcagatggaaaactggcgattgacggcttagcaccaggagtgtatcagctggtagaaacccaagcgccaacggggtatgaattggatgcgacaccaatcgagtttgagatcgaaagaagtcagacagcggtggtagaattgacgaaagaaaatcgacttacaccaggcggtgtcgtgttgacaaagatcgatgaccaaagcggagaagtcctgcaaggagctgtttttgagttacaagatgccaatggaaccgttctgcagtcaggtctaaccacaggagcagatggaaaactggcgatagatggcttagcaccaggagcatatcagctggtagaaactcaagcgccaacggggtatgaattggatgcgacaccagtaactttcaagatcgaaaaagaacaagaagtggcgatctttttaacaaaagagaatagaaaagttgctgatagctcagatataagaggaaacaatccaacaagcagtggaaataagcatcttccaaaaactggagaaaccatcattagccagtttatattgtcaatattgggtgtgctacttgttttcatcagtataaaatttagaaagaaacgaaatatatga

SEQ ID NO: 2780 - DNA (genomic), 480 bp, Enterococcus faecium; double-stranded, circular
  misc_feature (B) LOCATION 1...480
  hypothetical: NO
  anti-sense: NO
gaaaaaaggggaaagaattgcaacggaagatggcgggaaaactcatttgatttcaatgactttattgaacaactcgatcaagtgatggggatgggcccactggaagatctaatcaaaatgatcccaggaatgaatcaagtccctggaatcgaaaacgtcaaggtagatccaaaagatgttgaacgcaaaaaagcgatggtttattctatgacaccagcagaaagagcaaatcctgatctgttgaatccaagccgtcgtcgccgaattgctgctggttctggaaacagtgtggttgaagtaaaccgaatgatcaagcaattcaaggaatcaagaaaaatgatgcaacaaatgtccaaaggggatatgaacatcccaggtatggaccaaatgtttggatcaggcgtcaaagggaaactaggcaaaatggcgatgaatcgaatgatcaagaaaaataagaagaaaaagaaaaaacggaaataa

SEQ ID NO: 2781 - DNA (genomic), 411 bp, Enterococcus faecium; double-stranded, circular
  misc_feature (B) LOCATION 1...411
  hypothetical: NO
  anti-sense: NO
aacgaaaggggacgtctgatgggagaaaaggaattgcgccgatctatgtccgtatttccaattggtacagttatgaagctgactgatttgtctgctcggcaaattcgctattatgaagaacaagatttagttcatccggaacgaagcgaaggaaaccgacgtatgtattcgctgaatgatattgatatgctgcttgagattaaagactatctttcagatggattgaatatggctgggatcaaacgtgtatacgaaatggcacaggcgaaaaaacaagaagcaaaaaacaagaagccgttgacagatcatgacgttcgacaaatttttcgtgatgagattttggcgcaaggtgggttaagcaaaacaggtcattatcagtcgcaaggattgcaaagacaattctttgactga

SEQ ID NO: 2782 - DNA (genomic), 294 bp, Enterococcus faecium; double-stranded, circular
  misc_feature (B) LOCATION 1...294
  hypothetical: NO
  anti-sense: NO
catttagggggaaataaaatgaaaaatttagttatcagcaagtttgcaatgttaccaagaatggattttttcgataatgtaagtaagtttatgtcaaatatgacttcaaaactacaaggaatttcactatctgtaattatcttttgtattgtggttactggtttgatgtttcttttcggagaagggccaagtcgtactgctaaaaaatggttaacttatatcgtgattggggcaataattatcttcggagcttcaactatcggacaaacgatcaagtccgttggtggtttctaa

SEQ ID NO: 2783 - DNA (genomic), 1887 bp, Enterococcus faecium; double-stranded, circular
  misc_feature (B) LOCATION 1...1887
  hypothetical: NO
  anti-sense: NO
aggataggggggacgcacatgacgctagtaaacagatggtaccaattattgaaattactagtcactcacaagaaagtttcaatccaggaagtgcaaaaagaaatcaaaaccagtaatcaaaccataaaaaaagatattggggagttgaatgaagaaattgccggtattgcaaaaatcatccaaaaaaacaaacattttgaacttgaaatttatgattttgatttttttgatgagatcatgcaaggaaaattgaaaacagccagtgatttcaattcggcatccaaaagaatcgcttatttactaaataggctgatcgaaacagaggatttcttacgtatggatgatttgtctgaagaagtcggtgtcagcagaggaacagtggtcaaggatctaaagacattaaaagagatgatcaatgattttgatgtaaagattacaggcacaccaaataaaggactaagaataataggagatgagctagaattacgactacttttattttattttgtttctccctacttttcagagacgaaaacagaacagtttctagaagaaaaacaagcaatcaaacattttcagaagaagacgaatgctagtaaacaagaaatcacccttttaacgaaagttatcggtatttctttgaatagaatctctagtaactatctgttgaagaagcccatcaatcgttacagtgggtgttttgaatatatccaagaattcaatgaactgatcaatcagttggaagaaatctatgaactaactttgagccaatatgaaaaagattttatcagttttcctttgaacatcatcaacacaagtataacgatgataaggaaagctaactctgatttgcgcttatatttcgaccccatgatgatgcgtattcgacgattagatctcattgatctggatgagtccttcttatatcaagagatgaaacagcacctctctttattgataaatcgggtaatttttcgttatcgattgactgatttattttatggtgagatagaaaaaaagtatcctttttcttaccaaatcgctagcgaatgcatacaagcattagaagctatcttgcaacataagatctctaaagtagagatcagctacctaacgttgtatttggagttagcatttcgatatcaaaaagagcatttttcctctaaaaaagtagccattgttcatacgacaggaaaaggaacagcattaatgatccaaagacaaatcaaaaggatattggggagggatatacaaataacacatgtttcagaagaacaatatgaaaaagtagatctaaacaaatatttcgctgtttttacaacgattccgttaaaaaatgtaaatgaagagacaccggtgatccatttgactaatctttttgatgactcttggttaagggcacaatggcaaaaagcaaaaaaaaagcgattagccgggtttcattctactgtttttttctatcaaatatggaaagaaaaaaagacgtatcaagaatatttaaacaaattagtcgctcctttgatcagaggctattatgtggatgaagaatttgaaaaaaggatcttgaaaagagaatatcagcaaagcacatttgttaacaaagaatttgcttttcctcacacaaccaaccagctatctcaacacattgttttatcagtagggctaataactgatcaaggtttagcagaaacaggaggaaatggagttatttttttatttgccatacctgaagaaatgacggctgaagttgagaatgaattatttgagctatacgatatcctatttgaactcataaaaatgggaatagatgagtttattgaattagcaccgacacaagaatcatttttaaaactaatcaaaagtaaaggagagagacttcatgaatga

SEQ ID NO: 2784 - DNA (genomic), 843 bp, Enterococcus faecium; double-stranded, circular
  misc_feature (B) LOCATION 1...843
  hypothetical: NO
  anti-sense: NO
tttgtttttttcaatccttcacttataatgaaaaaaaggaggcgatcccaactgaatcaagtagtggataaacctttatatttcaaagtagataaaaaaattaaaaaattagccagcactcagcagctgcagtcaagaaaaagtaaattgctttttttagctctggtttttgaagatcaaagttatgtgattatcgatcaatcaggacatccggtagaatattctccagcaaaatatacttatcaagagggtctttcttgtaaaaaatggaagctgatcaatgaagagccaatcgagttatctagatggatcaacagaaaagaagatattcccgttttgatcgaagaaaaaaggtcaggaaaggaactcgcaaattgctgggtgggattgccagaagaacgttttttgaggtataagaaatgggctaccccctcaggctatctttgtggtacttacgcggcagcagttctccttgcctattatcaagactatcgtaaggggtggatgcttccaaatgagattcgcaagaaaaatacggctgattcgttggttttgacgaaggcattgcgtagccagatccaaccactaggacttcctacgattccttttcaggttagtacagggatttctagttttttaaagaagaatggcaatcatgagcgtgcacgagcaactcttctaggttcatggcagcgagctacaaaacgtatacgtgaaggcaaacctgtgatgattggtattttgaaagtacttggcagtacatatggcaatcattgggtgacagcgtacgcttattttgaaactgaaacaggagaacgatattacaatgtattngacaggtcg

SEQ ID NO: 2785 - DNA (genomic), 216 bp, Enterococcus faecium; double-stranded, circular
  misc_feature (B) LOCATION 1...216
  hypothetical: NO
  anti-sense: NO
tatataattttatattatcatatttttattccaatacacagatactcttatataatgtcttttcatgtagtttatcaaatttctatttcaaaccgcttaatacaaatatcaaagcccaaaattttctactggaagcttttagagcctaaaatatattttttatttgatccaaaacttcagggaaatacaaacctaatatcaacacagcacctataa

SEQ ID NO: 2786 - DNA (genomic), 204 bp, Enterococcus faecium; double-stranded, circular
  misc_feature (B) LOCATION 1...204
  hypothetical: NO
  anti-sense: NO
aatataattttttatttttccaaactatggtataacaatataagtattatgcttaaagttgttcttacacgattagtatatgatcgattaatatatgagcaagcacgagtaagtgtacggacacttacgaaaaaattgatgaagcagccctttgggatctgcttcatcaatttgaatcggctacactatactagacagaaaaga

SEQ ID NO: 2787 - DNA (genomic), 390 bp, Enterococcus faecium; double-stranded, circular
  misc_feature (B) LOCATION 1...390
  hypothetical: NO
  anti-sense: NO
attgtttttttgtttattttttctggtattccttggtctcttgcgtccgtatctggttctggagtcacatctggtttttcttctggatctacctctagtttttctggattttcagtttcattatctgtgtctggatttgtttccggtactgtttggtttccagaatccgtatctggttctggagttacatctggtttttcttctggggctacctctggtttttctggattttcagtttcattatctgtgtctggatttgtttccggtactgtttggtttccagaatccgtatctggttctggagtcacatccggtttttcttctgggtctacatctggtttttctccaggggttatttcaggttttgattcattgtctggctctggttga

SEQ ID NO: 2788 - DNA (genomic), 330 bp, Enterococcus faecium; double-stranded, circular
  misc_feature (B) LOCATION 1...330
  hypothetical: NO
  anti-sense: NO
gtggaacagngcgtcgcagtactgctaccctcaatgaactggaaatcaaattgtattcgctcaattcttgtttattacgcagatcaagagtacgagaaagccaccgatttattgaaatttctaattgctcgaacagagtatactcgctttgaatatattgaacgtttagcaaacatctatcatattatgaatgaacctgtcaaagaatatcagttattggacaccgtcttgtcagtagcagaactgattgcccttcctgctggattagaaaagaaactagtacgccgccttttacgagtaaagcaacaactatccgatcaagaaaaataa

SEQ ID NO: 2789 - DNA (genomic), 810 bp, Enterococcus faecium; double-stranded, circular
  misc_feature (B) LOCATION 1...810
  hypothetical: NO
  anti-sense: NO
attanggggnggatgcggggtccccngcaaaaattgaatcgcatcccagtctcgtgtgaatacacnacaccacctggggcgatttgttcggctcccacatcgcccgcagagatgggggaccatgtgaatccattatggacccatgaaggattcgatcttgaaatcggcggattcgatgactatgtattaccgaaccaatctttggaacaaggcgacattgatgccaattacttccagcatattccttatttgaacaaagaaatcaaagaaaaaggatatgactttgtcaatgccggtgctgtccacatcgaaccaatgggcttgtactctaaaaaagtcaaagatgtttccgaattaaaagatggtgcaacaatcattacttcaaattctgaatcagactggggacgcatcatcacaattctacaagatgctggcttagtcaaagtcaaagatggagtagatctgganacagcaacattcgatgatattgaagaaaaccctaaggacttgaagttcaaccatacgatcgacccatcacttttagcttttacgtaccaaaatgatgaaggtgacctagttgcaatcaacgcaaacttcgcttacggcgcagggttgaatccattagaagatgccgtattgcttgaaaaggacaactctccttacgtgaatattattgcgactcgtaaaggtgatgaagacagtgacaaaatcaaaaaactgattgaagtgcttcaccgcaaagaagtccaagaatggatcacagacaaatggggcggctctgttaaaccagtaaaggctgatgcaaaataa

SEQ ID NO: 2790 - DNA (genomic), 1356 bp, Enterococcus faecium; double-stranded, circular
  misc_feature (B) LOCATION 1...1356
  hypothetical: NO
  anti-sense: NO
agggcaatttttatgcgtggatttattgattggcagattcagcagctgaataaccaacaattgtttaaaggtaatgttgcaatcattcaacctttagaacaaggtcttggaaatatgatgaaccagcaagataatttatatacggtcattttacaaggactcagcaatggcgaaatcgttgatacttccgagattatcaccgtagtagaacaaatgatcaatccttatgatgaatgggatgcttatctatctctagcagaaaatgacgacttggcctatatcgtctccaatacaacagaggcaggaatccaattcgtggagactgataatttaacagatactcccccacagagcttcccgggcaaactgacagcctttttataccgacgtttcaaattaaacaaagctggctttaccatcattccttgcgaactgattgacagaaacggcgaacgtctaaaagaaatcattttacgctacgcagaaaaatgggatttagaacctgcttttgttgagtggttagaaaaagaaaatgttttctgttgtagtttagttgatcgcatcgtcccaggttatcctcgcgaagatgcaggtgttttcaatcaacggcataactatgaagatcaattgatggtcaaagcagaaccattcatgctttgggtgatcgaagggcctaaagaattggagaatcaactaccattcaaacaggctggcttgaatgtcatcatcacagatgatatgactccttatcgtgaacgtaaggtgcatttgcttaatggaccgcatacagcgatggtccctcttgctttgttggcggaattggaaactgtagaagaagtaatgaaagatcctttattctccgcatatgttgatcagttattcaatctagaattgattcctatgctttctttacctaaagatgaattagccatttatgctgaccaaatcaaagaacgtttcttgaatccttttgcccatcacaaattagaagcgatttcattaaatagtgtttcaaagttcagcacccgtctgcttccagtgttcaagaagtatatcgaagaacaaaatcaggtaccaccgttaatcactgtttcactagctgcgctacttcttatgtatcgaggcgatcaagtaaagccacatgatgatgaaaagacgataagcgaatttactgatgcttggtctgataatggaacagctattcctcgattattgcaaaacgctgcgctttggggagaagatttgtctcaaataccgaatgtgacagatacagttcaagaaatagctgcaaagatcgatcaaaaaggtgtccggtcagtattacaagaaatgaaaggaacgatggtccatgcttga

SEQ ID NO: 2791 - DNA (genomic), 633 bp, Enterococcus faecium; double-stranded, circular
  misc_feature (B) LOCATION 1...633
  hypothetical: NO
  anti-sense: NO
gtaaaaattttgaaaattgcttatattcgagtttcgtcgattgatcaaaatgagcaacgccaaattgaagaaatgaaaaagttcggcgcagaaaaaattttcatcgagaaacaatctggagcaacgattactcatcgaccgattttccaggaagctttagagtttgtccgagaccaagatatttttattgtcgaagcaatcgaccgacttggaagaaattacgacgaaatcattgcttcagtcaattacctaaagaagaaaaacgtgcagctgatcatcaccagtctaccgatcatggctgaagcaattggcaatcctcatttggataaattcattaaagatttaatcatccaaattttggccatgattgcagagcaagagcgtaccgaatctaaacgacgccaggcgcaagtcattaaaattgcaaaagcaaatggcgtctataaaggtcgtccaaaactctatagtgcagatacaaaaaatcctcaacgacgtttagtttatgaaaacatcgttaaggatttaaatgagggcatagctatttcaaaaattgctaaaaactacaatattactagacaaactatttacagaattaagaatgatattgagtataacagtaatcaaatgaattaa

SEQ ID NO: 2792 - DNA (genomic), 957 bp, Enterococcus faecium; double-stranded, circular
  misc_feature (B) LOCATION 1...957
  hypothetical: NO
  anti-sense: NO
gaattttttatatcatccctggatttcatggatgacgaaggtttcttaccagagattcccaagtggtttacgcctcaaacgtccaacgtgcatttatctgcgctgaaaaacactggtttgaccctttttgcagtttttttcggtattggcgtttgtctttacaatatggattatctgacttcggcagttcagacaaaaccagtgactgtatctcacagaggtgtaagtacgcaaaatggggcgcaaaatactttagaagcacttgaaaaaacaagcagagactatcatcctgattatatagagatggatgtgcaggaaacaaaagatggccgtttcgtagtgatgcatgatgcaaatcttcgtcacttaactggggtaaatcgaacaccacaggatttgacgttgaaagaattgacaaatcttacggttactgaaaatgggttccaagcccctgtgtgttcttttgattcttatttagaaaaagcgcatgaattgaaccaaaaattacttattgagattaagacctctaaaaaagaatcagatgacctggtcgaacgatttgttcagaaataccgcaaagcgattttagagaatcatcatattttgcaaagtttgacgtaccaaactgtttctgatttaaaagaagcagaaccaaacttttatgtgggctatatcttgcctttcaatatcgttgggcctcccgtaacgcctgctgattttttgacaatggagtatagtacgatcaatcgtaacttcattaattctgcccatcaagatggaaaaaaagtatatgtatggacgatcaacgattcagatgctatgagtcgcatgatgttttatggtgtggatggtatcataaccgatgagatgggactactaaatgaaagtgtgaaacaaacagatgaagaaatcacttattcagacaagctactaaattttgttttgggtgttggctaa

SEQ ID NO: 2793 - DNA (genomic), 258 bp, Enterococcus faecium; double-stranded, circular
  misc_feature (B) LOCATION 1...258
  hypothetical: NO
  anti-sense: NO
tatacttttattaagggagtgatgataatgcttgttacaaaatctagattacaaggaagttctgtagtggtaactttaccttctgataacggaaagaaaccttcagaaaaccaagaatatatcgttgtgtattctgatgatggaacaattacgttagttccaaaaattgaagatccatttagtggtggggaagaggccgagtattatgagaaagacgaatgggaagatttaactcctgaagggagagaaattttatag

SEQ ID NO: 2794 - DNA (genomic), 1131 bp, Enterococcus faecium; double-stranded, circular
  misc_feature (B) LOCATION 1...1131
  hypothetical: NO
  anti-sense: NO
cggtttttctttttgctctttctctttcttattttcatattccatcatataatgaataacgtgtttattttttgttatttggaggttgtcgatttgaccgtttatcagcgttttttggcgaatgaaaaaatacgccgtctcactgttttattatttgtcgtttttgttcttttcttagttagaagtatgattacaaccattttgctcacatttatctttacttatttgatgattcatcttgttcaaatcattcagcgatttgtccgaatccctacaggtgttttagctatcatgatttatacactgatcgtttaccttatctatctggcattcacaaagtatatcccgatgcttattcatcaaacatttgatatgatccagtccgttattgatttttacgagcatcagccaaaagatgcagatcctgttttacaatatatccatacttatattgagcgaaacgatttttttgaacagcttcaaaatggcgcttcgattgcgcttggctatttacaggatataggaaaaatggcagtggcgtttgctatgtcattcatcttaagtttcttttttatgattgaaaagaaaaaaacaattgtattctcaagattgtttttaaaaagtgaattttcttggttctttcaagatatttactattttgccgataagtttgtcaatacatttggtttggtattagaagctcaatttgttatcgctcttttaaacacgttgctcactacaatcgccttggctgtatttggctttcatcagctgctgagtttagcgatcatgattttcattttaagtctgatcccagtagcaggtgttatcatttcttgtattcctctatctttcatagcttattcccaaggaggcatccgagatgttgtttatatcctgattacgattttgattgtccatctaattgagtcttatgtgctgaatccgaagttgatgtccagcaaaacagaactgccgattttttatacatttgtggtcttacttgttagcgaacggttctttggcgtttggggcttgattgtcggcattccgatctttaccttctttttagatgtattgaaagtgaaaaagatcccgaaccatcttccaaaagaaacagatatcccttaa

SEQ ID NO: 2795 - DNA (genomic), 639 bp, Enterococcus faecium; double-stranded, circular
  misc_feature (B) LOCATION 1...639
  hypothetical: NO
  anti-sense: NO
atgaaaattttattagctgctggaggtaatccgcaaaactggccgcagtctctgctgtccaaatacgatgcctatgtcgggatagaccgtggtgcgctgtacctgcttcaagcaggctacccagtagatctggcagtgggtgattttgattcattgtcgaacgaagagcagaaggaagtatttgcaaaagccaaagagtatacccgttcccctgcagaaaaagacgatacagatacacagttaggtatcttaaaaacatttgaacgttacccgcaagcggaagtcactttgattggagctacgggcggaagattggatcatcttttagccaatctctggttaggtatggaacctcgcttcaaaccctttgcccatcagcttattatcagagattgtcaaaattatttgtcttattatttgcctggagagcatatagtaagacagataccagatatgaagtatttagcttattgctgcttgactcccgtctcgaatcttacattaaaaggcagcaagtatgtattggaaaataaagaagtagaatatccgacatcttatgcaagtaacgaatttctttcagataccgcagaattttctttttcagatggtatgattgcagttattcaaagcaaagattga

SEQ ID NO: 2796 - DNA (genomic), 2721 bp, Enterococcus faecium; double-stranded, circular
  misc_feature (B) LOCATION 1...2721
  hypothetical: NO
  anti-sense: NO
ggggattttatgaaaacaagaacatatcttaaagcaggttttcgcgaaattcggcaatctaaaggacgattcattgcaatcatccttattgtcatgctaggaacacttttatttgtaggtgtcaaaactgctggacctgtcatgcaaaaaacgatggatcactatgttggtacagcaggactttctgatttgcaaatcgtttctactggtggcttgacacaaaaagatattgctcaagcagaaaagatcccagatgcaaaagtagaaacaggaaaacagatctattattccaatactggcaaaaacgaagtgattcaaatattttcttataacaaaaataacaagcagaacaagctacaattaactgatggaaaactcccggaaaaaccaaaccagcttgtattggatgaaaaagcggaagatgaagggtataaaatcggtgatatttatcagattgattcagatgaattgaaagaaaaagagtataccatcacgggctttgtccgttctccattgttcatcaacaatttggagagaggatacgcgaacgtcggaaatggtagcgtcgattattttgtctatttacctgaatccgtttttaaaacagatatttattctgtcttatatcttgattttacaaacgtaaagaatttgaatacgtacagcaaagcttacaaagataaaatggagcaaaatcaagaaaaggcagaaaagtatttacaagatcgacccgaagaacgcttagaagagctgaaaaaatcggccaacgaagaattagaaccggcacagcaaaaaatagcggatggcaaagcacaaacaacgcaagcaagaacacggttagaagatgctaaaaaacagttagcgcaacagtcagcaactatccagcagcttcctgaagcgcaacgaacaatcgctgttcaaacattatctcaacaagaagctcaacttgctgaacaagaaaggcaattagttgagaaagaacgtgaactggcctctgcagaggaagaattgaatcgaaatgcagaaaaaattgaaaatttaactaaaccatcatacctatacaatgaacgttcagaaaatgtcggttttcaagaatttggtgatctgtctgatcgtatcgctgcgattgccaatgtttttcctgttttctttttctttattgccgcattgatcacctttacgacaatgacacgtatggtagaagaaaaccgcagggaaatcgggacattaaaggcgttaggttatacgaaagttgaaatcgcaaaaaaatatgcaatctatgcaagtctagcctcagggataggtattgttttaggaacgatattaggaacgaatcttttgccaaggatcatttttgagctgtctaacgagcggtatgatattgggagtgcgcttattttttatgactggccgccgattttacaagcagctgccgcattcttcattgccgcatttggcgctgcaatgatcgttttattcaaagatttaagagaacggcctgctgcattgcttcaaccgaaagcaccgaagccagggaaacgcatttttcttgaatacatcactccgctgtggtcacgccttagctttaatcaaaaaatcagttaccgaaatctcttccgatataagtcaagaatgcttatggcgattatcggaattgctggatgtgccgggctgatggttgcaggcgtgggattgaaagattctctaagttctgtttcagccaaacaatttggaccgatcattgactatcaagcaatcgttacattggattcatccacggaagatagtcgtcaaaaagcagcggatatgctgcagaagcaagaaaaagtaaatgagatcctagctattcatactcaaaccgtagaattgagaaaaaaaggacatgcttcgcaaagtctgacagtgatcgtaccaagtaaaacagctgatttggatcgttttatccatttaactgatcttgaagagaacccacgctccttgcctaaaacaggaatcgctattacgcaaaaagtagcagaactatttgacttatctacaggagatcatatttcgctttatgatgaagatcaaaaagaatggaaagtcgaagtaaaagaaatcgtgaaaaactatctaggtagctttatttatatgtcccctgaatattatgcttcagttactgatcaatcgatgatggataatgcatttttgctgcgtacagataagatgacaacaaaagaagaagaaatgctttccgagaaactgcttgccacagacgctgtgacaaatacgtctttcatgtccaaacaaatcgaaacgcaagaagaatcaatggcgaacttagactcggttgtcttaatctttgtcgtattatcaggactgctggcttttatcgtcttgtataatctaactaatatcaatatttccgagcgtgtacgcgaattatctacaataaaagtccttggattttttgataaagaagtcacgatgtacattgttcgagaaaatatcatctttactcttttaggaatcatcggaggatttggtgtaggatatatattgactgacttcatcttgcaacaagcgtctatggagaatgtcatctttccattagtgatcacatggtgggcttatgtcttatcagcaggattaactatcgtatttacggttattgtgatgattgttacccatttcaaattaaagcatatcgatatgattgatgcgttgaaatcgaatgaataa

SEQ ID NO: 2797 - DNA (genomic), 225 bp, Enterococcus faecium; double-stranded, circular
  misc_feature (B) LOCATION 1...225
  hypothetical: NO
  anti-sense: NO
atagtctttattataccacgtgtgaggggagaaataaaaagccgttttttagtagatatgaaacaaaacaaaaacccgcatttattcaacctattcatccttttaaaggatagattgaacgtagatagaagtcgtttatccagtctttttcattttgaaaaaaagctaacagcatgctttttttatggtatactagcaaggaaacgaattcgcatcatgcgataa

SEQ ID NO: 2798 - DNA (genomic), 222 bp, Enterococcus faecium; double-stranded, circular
  misc_feature (B) LOCATION 1...222
  hypothetical: NO
  anti-sense: NO
aataactttatttttcttcataactgttcctttccaatttactattttgttatctttaatgataacaaaatagagggaaaatacctacttaaattattggaatttatcatttattttaaaagaaaaagaaaaggtgtagaccatttactttgtgtttgctataatgtaagtggatacaaaaacgaaaagatgcaggaggaaatggtaatatgggaaaattag

SEQ ID NO: 2799 - DNA (genomic), 1287 bp, Enterococcus faecium; double-stranded, circular
  misc_feature (B) LOCATION 1...1287
  hypothetical: NO
  anti-sense: NO
catttatttatcgaatatgcactcccccgggaaaaaaaaaattttnnaaaaatcctctctttttcttgtttaaacacccggggccgcccgcataattttttggtgggattttggaaaaaattcccaaaaaattttttaacccaatcccctgatcgtcagcctgtaaaaaacaatgcattacttcgcataggtatcgcacctttagcccatttgaagtatgaacaacagcttgtcttcaaacaaaaacaagtagagcatgtaatggcgaagattgctaagatgccagaagttcctgtacttccaacggtcggaatggcagaaccattcggctaccgtaataaagcacagatccctgttcgccgtatcgatggacagttagccaccggtttttacaaaaagaatagccatgatctagtccctatcgaagatttttatatccaagatcctgtcatcgatcaagcaatcaaagtagtcagagatatcttgcaacggttccaagtacgaagatataatgaagaaaaaaatgaaggacagcttcgtcacatcattatccgtcgtggtcattattcccatgaaatgatggtcgttttagttactcgtaaagaaaaattctttaaatccaaggaaattgctgaagctattcatgaagaattgccagaagtggtttcggtcatccaaaatatcaatgaagaaaaaacaaatgtgattttaggagacaaagaaaaagttttatatggcagagactatatcgaagatcagctattaggaaaaacctatcgaatctcagcaaagtcattttatcaagtaaatactcaacaagcagagtatctgtaccaaacagccatcgagtttgccgagttagataaaaaagacattgtgatcgacgcttattcaggaataggtacgattggcttgtctttagcagacagagtggataaggtgtatgggatggaagttattccagaagcaattgaagatgcacagttcaatgctttaaataataaaatcgaaaatgttcattatgaagtcggaaaagcagaaaaagttatgaaaaaatggcaagaaaaagggatcaaaccatctgtgatcgtagttgaccctccacgaaaaggattagatcatcattttattgaatcagcaatcgaaatgtcaccagaacgaatcgtctatatctcatgtaatccggcaacttttgcaagagatgctaaattatttgcagaagcagtttatgccgtgaagaaaattcagcctgtaatcttttcccgcaaacccatcatatggaattag

SEQ ID NO: 2800 - DNA (genomic), 549 bp, Enterococcus faecium; double-stranded, circular
  misc_feature (B) LOCATION 1...549
  hypothetical: NO
  anti-sense: NO
ggagtatttatggcagataaaacaatcaaagaacttgcggaagaattaggagttagtaaaacagcaattaacaaaaaagtttctgacaaaaatcgaaaactttggtttgcaaaaaacggaaacaagtttgtgattaacgaaaccggtcaaaaagctataaaatcaatgtttttagtcgataacgcaaacttaaatcgaaaactagttggcgaaaaatcaaaaaccaaaaaccataaaaacaccaaccaagtttccgaattaaaactcctttctttcctagaaaaacagttaaatcgaaaagatatacagctacaagaaaaagataatcaaataaaacaaatgcaaaaattactcgaccagcaacaacaactcactctacaagcgaaccaacaaattgagaacctacaagaacagctccatttaacttatacagaagaaactccaacaaccgaatcaactgccttttctgaaaaaaaagcagacaatacacaaccacttattgaaaaaaagtggtggcaaatttggaaatctaatagaaccaatctctaa

SEQ ID NO: 2801 - DNA (genomic), 1080 bp, Enterococcus faecium; double-stranded, circular
  misc_feature (B) LOCATION 1...1080
  hypothetical: NO
  anti-sense: NO
ttctcatttattttttccattaaggagcaggagatgtcgtctaaaggaacgaaaactaaaatccatctgaatctgcttttgctgatagtgatttttgccattatttattatttaatcaatcaatcatttgcagatatctttgccgaattgctgtctaccagtgttgttgttttggcagcggctgttatattagggacagtttaccaaatcgctgaagggcgctcaatcaaagaaattgctgaacctttcgcgccgaattttacaacgaaagatgggttcttgacctctagctatattgcgttttaccgaatcgtttcgtttggtacaggaacgctgatctcggagatttatttttataacaaaaaaggaatgaagctatcccagggagcaggggtgacagcactccatatgattatgtacaaactggcagtgatcacttatgcattagctggcttggtcatccaattctctcttttttattctaatggtccatcaatgatctggtttatcatcgctggtatccttttgacgatcgtgattgttgcctttttattggcgatgtccgtcagcttgaatgttcaaatattttttgtcagcttatcgaataagttatttaaaagtgagcgtttgcggaaatgggtggatacatgcaatcagcagatctactctttaagggaaacggtccaaaccattatccaagacaggactgcgctattgcggatttatctatggaatatgttaaaacttgtattttggtatgtacttccttatttgattctgattgaaaaccatcctaaaatagattttctactgaccatttcgtttatcagctttgcagtagtgctttcaggggttattcctacgcctgctggtattggttcctttgaatttgtctatttgttattattcagaccagttgttggaacagttgacgcagtttcttcgcttttactgtatcgtttcagttcctttatcttgccatttctctatggatttgtgtatgtgattgctgaacggcgaagagtgatcaaagaagaaataatagaagtaaaaaaagagaataaagaaaatcaagggtag

SEQ ID NO: 2802 - DNA (genomic), 1170 bp, Enterococcus faecium; double-stranded, circular
  misc_feature (B) LOCATION 1...1170
  hypothetical: NO
  anti-sense: NO
tcatcatttatattggatgttaacaagagcagcttcttgctctttgtgtatttcaaaaaagaaatgaaaggaaatcatatgtataaattattaacttctggaccattgacgacttctgaaacagtgaaaaatgctatgctgatcgatcattgtacttgggatcaagaatacaaagaaattacacaatggataagaaaaaaattattggatcttgctcaagtatcggaaggaatatacacaacggtcttaatgcaaggtagcagctccttcggggtagaatcggtattaagttctgtgatcaggccagaagatactgtactgatttgttcaaacggcgcatatagacaacgaatgatcaacatgtgcgaatgtctgaaactgaactataccgtttatgaggtatcggaacatcaaatcctccaagctcatgtgattacacagctgattgaagagaatccgtctatctccgcactagcaatggtccatagcgagactacttccggtattttgaataatttggaagagattgctgctgtcacacaagaaagagatcttttgtttatagtggacgcgatgtcaagctttggtgggataccgatttgtgtagccgaactagggattgattttttgatttccagctcaaacaaatgtattcaaggtgttccaggcttttcttttgtacttgctaataaagcggaactggaaaaacgaaaaaatgttagccgaagtttgtcacttgatctatatgaccagtaccgcgtgatggaaaacgagaatggcaaatggcgtttcacttcccctacccatacggttttggcttttcaacaagcgctgaaggaactagaggcagaaggaggaatcgaaactcgatattcacgttatctcgccaataatcatgtgctacgacaaaaaatgacagagatggggttccagcctttcattcaagaatatcaggggccattcatcacctcttttctttaccctaaggactggcgatttgattttaatcatttttatcagtatttaaagcaaaatggatttgtgatctatcccgggaaaatcagcgatcatgaatgttttcgtatcggaaatattggcgagatctatccggaagatattttggaactgacagcaattatcaaagactataaggagaacgttaatgattaa

SEQ ID NO: 2803 - DNA (genomic), 264 bp, Enterococcus faecium; double-stranded, circular
  misc_feature (B) LOCATION 1...264
  hypothetical: NO
  anti-sense: NO
aatacatttataatactagtatctaatccagcaaatttgacagtggataaattaatatctagcgattatgaactatctcaatttataatagattcgttagagaagaagaatctatgtgtggatttgagtcaatatcttggacacattttagtagagacggttaagccattttttcttttgctaattcttcaaattcctgtggggttagatagtgaatcgagctatggattcgatttcggttataaaatccttcaatgtagctaa

SEQ ID NO: 2804 - DNA (genomic), 210 bp, Enterococcus faecium; double-stranded, circular
  misc_feature (B) LOCATION 1...210
  hypothetical: NO
  anti-sense: NO
gccaaatttatgcaaaaatgtggaaagccattttcacaaaatttttcttcatactcaaaactaaacgactttttcacaacctctgattcacggtgttccagaaggagttttgtcgaaaacaagccgaaattctttgaagatggctacttctttttttcaaatctagacagaggaggcggacattattccgtgttttttgacaaaaaataa

SEQ ID NO: 2805 - DNA (genomic), 216 bp, Enterococcus faecium; double-stranded, circular
  misc_feature (B) LOCATION 1...216
  hypothetical: NO
  anti-sense: NO
gccaaatttatgcaaaaatgtagaaagccattttcacaaaatttttcttactactcgaaactaagcgactttttcacaacctcttccttaaacggtgttcaaaagcttgcatctgcggtaataagcccaaccaaacgaaaaataggaggagctatttttgtttggctgttcttattacttgatgcagaacagctttttcacaacctctttttataa

SEQ ID NO: 2806 - DNA (genomic), 915 bp, Enterococcus faecium; double-stranded, circular
  misc_feature (B) LOCATION 1...915
  hypothetical: NO
  anti-sense: NO
ttgactttctttgataatatgataaaaaggcaatcaaggaggaagataaatatgcttaaagatctgaaccaattgatcgattacatcgaagaacatttgacagaaggactttcctataaaataatagccgaaaatacaggaatctctgaatatcaattaaaacgcatctttacgtttattgcagggatgtcgctaatggactatatcaaaaaccgtagattggctttggctaatcgcgatcttctagatggatcaagagtgacagaaacggcgtttagatatggatatgaaacagtcgaaggtttttcaagagcttttcgtgattggtcaggatatctgccttcagaaatcagtagatacggcatacaaaaatcttttccacgcttgacattttttattgatgtcagaggaggaaaatcgatggaatttcgtatcgaaaagaaagaacagttttatgtggcaggtgtggcgaaaaaagttcctgtcaaatttgaaggagtcaatcaagaaatacaaaagttagcgcagacgatcacggagactcaaagggaagagatgcataagttaggagatttatatccaaatcaagtaatcaacgtttcttatggatttgatggagaccgcttggaagaaaagggcagtttgatgcacatgattggctttgctacgacaaaagaaaatccgtacgctgatttagaaatgcttgctatagaagaacacacttgggccatttttcctaataaagggccatttccccaaactttacaagatacttgggggaaaatctatgcagaatggcttccttcttcagattatgggttagtcgaagctcccgagatctcttttacaaaatggggagaggatttcagtaatgtttacagtgagatttggattgcagtgaaagcaaaaaaatag

SEQ ID NO: 2807 - DNA (genomic), 207 bp, Enterococcus faecium; double-stranded, circular
  misc_feature (B) LOCATION 1...207
  hypothetical: NO
  anti-sense: NO
acaccgtttatatcagaggttgtgagcctgccgtttaactctgagtcacaaggagcaatttcaaaaaacagcttctcatgtttgatgaatattttgacttgtgaccgaagagttggtaggagaacaccgtttataagaggttgtgacaaaagtcttgtcgcaacctcttttttaaccaaaaaagtgcaaatagtttactttaagtaa

SEQ ID NO: 2808 - DNA (genomic), 189 bp, Enterococcus faecium; double-stranded, circular
  misc_feature (B) LOCATION 1...189
  hypothetical: NO
  anti-sense: NO
tccaagtttatggttgaagttgtggatgaaaaattttttatttgtttttttattataaaaaaacacttatttgacaaggatgtaaacgactttttggtttatcaacaagtttatccactattgacaaatagattatccacaaacagtggaaaacttgaggataaactcagacaaaataagaatgtatga

SEQ ID NO: 2809 - DNA (genomic), 192 bp, Enterococcus faecium; double-stranded, circular
  misc_feature (B) LOCATION 1...192
  hypothetical: NO
  anti-sense: NO
attggtttcttaaacagtatttttgagaattcgcaagaactcccttataatataaataaagacagaagggagcgagaagatatgcctaaaagaaaaagttcagggaaaatgggaattattcttgcagtgatctctgcaattcctgctattttagctattgttcgtgcgatgaaggaatcaagagataattaa

SEQ ID NO: 2810 - DNA (genomic), 357 bp, Enterococcus faecium; double-stranded, circular
  misc_feature (B) LOCATION 1...357
  hypothetical: NO
  anti-sense: NO
tcatcacttatttttaatacacgtgcaggtattccaccgacaacagtttctgctgccacatcttctaaaaccactgctcctgctgccacgactgcatcttttccgatatggacaccttcaacaatcactgcattcgcacctaccagtacgccgtcttctacgataaccggtttggccgatgctggttcgatcacacctgctaagacagctcctgcaccaatatggcagtttttgcccactgtcgctcgtccacctaagacagcacccatatcaatcatcgtgttttcaccgattactgcaccaatattgataatcgctcccatcatgatcacggcattgttgccgattgacacttga

SEQ ID NO: 2811 - DNA (genomic), 537 bp, Enterococcus faecium; double-stranded, circular
  misc_feature (B) LOCATION 1...537
  hypothetical: NO
  anti-sense: NO
tcaatgcttatgcacagctccttacctattatttatctcaacagatctaacaaattaatggactatttaaggagtttttttatgcttacgatctattcttctcgcacacatagttaccatctgatggcaaactggctgaaagaccatcaaatgccttacagagaacgaattttcacacctaaacagcctttaacaaggaaagagatattttatttattgtcattaacagaaaacggatttgacgatctattagctaaacgctcgattgattataaaaatttgaaagaccaaatcgaccaatgtacgacctcagagcttgtcgatctgatcgtctcgcattttactttgttacaacgtcccatcattactgacggaaagaaattattagtcggattcaatgaagatagcatgcgtctttttatccctgtacaatggcgcagaagtcaactgaaatctgtctataacgattttacatgggtaagcaatctagaaaattctacggatttagatgatgaatttttaaattattatatataa

SEQ ID NO: 2812 - DNA (genomic), 348 bp, Enterococcus faecium; double-stranded, circular
  misc_feature (B) LOCATION 1...348
  hypothetical: NO
  anti-sense: NO
gaggtgcttattatgccaatcattaagaatgtaaatgaattgactgagagagtcaagtttaaaaagacaaaacgggtaaaagatgaagatgggcagatggtggatagtgaagaaactgtatttgaatgttgggctaatgtgcgttcacaaatgctaaaagacgtgcttgctagtgtaggtaccattcttgaaggaacgttgacgtttattattcgatacgatcaagattatgaactaacaaacgatatgaaagtagcttggaaaaacaagagttataaaattatttcaatcaatgaaggaacggcgtttaaagattatacaacgatcatagctaaacagatttcttag

SEQ ID NO: 2813 - DNA (genomic), 264 bp, Enterococcus faecium; double-stranded, circular
  misc_feature (B) LOCATION 1...264
  hypothetical: NO
  anti-sense: NO
gagaagcttatggcaaatgaaattgtaaaatatgaaaatagattaaatcatattcctctgagaaaatttaatagtcgtgaaatgaacttatttttttcaattgcttcacgtgtacgtgaaaaaggtgtagatgagattattttttcatttcacgatttgaaaaaactaagcggttatacagaacgtggggaacaatttataaaagatcttagtagcacgtatgacaaattatggttctgttgcaaagttttaaataaagaataa

SEQ ID NO: 2814 - DNA (genomic), 792 bp, Enterococcus faecium; double-stranded, circular
  misc_feature (B) LOCATION 1...792
  hypothetical: NO
  anti-sense: NO
aaatggcttataataaggaaaatcctagaaaaaagagggaggaggaataacaaattgattaatgctcaacaaatcgtagaaaaaatgaaaaatcaaaaaataaattatgatacagttctgaaaaaaatgatcatgcaatgggagaaagaagaagtaaagcctaagatattaatacatacatgctgtgctccttgcagtacgcacacattggaattcatgtctcaatatgcagagatcacgttatttttttcaaattcgaatattcatcctaaaagtgagtatttgcgaagattacatgaacaaaaacgatttgtagaccaatttaatgagaaaactgaccatcatgttgcgctaatcgttgatgaataccgtccaaatgaattcaccaaaatggttttaacaaaccatcttgaaaacgaaaaagaaggtggtgctcgctgcagtgcatgcttcaatatgcgattagatcttgttgcgcaaaaagcgcaagaactaggatacgattactttggaagtgccctgaccatctcgccaaagaaaaatgcagctttgatcaatcagatcggaatggatatccaaaagatttacgggacacaatacttgccaagtgatttcaagaaaaacaaaggctatgaacgctctttgcaaatgtgcaaagagtatgatatttatcgccaatgttattgtggttgcgtgttcgctgccaagcagcaaggatgcgatctgaaagaaatcaatcgggaagcaaaagcttacttaaaaacatcaaccgtagtttttgaggaaaattaa

SEQ ID NO: 2815 - DNA (genomic), 477 bp, Enterococcus faecium; double-stranded, circular
  misc_feature (B) LOCATION 1...477
  hypothetical: NO
  anti-sense: NO
aaatttattatatacttgaattgttcattaatgaaagcgaaaccaatcgttagcaactatgtaaaagaaaggaagattcttgtgaaaaaaagtattttgcttatttctcatagtcaaaaagtaacagatggtattaaagaaatgattgagcagatgcaaaaatccgaagaggtgcaaattttttctctcggcggaataaatggcgagatcggatcagacccgatgaaaatcgtagaagcagtcaatgaatcaagcgatgcagctagttattttgtttttgcggatatcggtagcgcggtattgaactcggaactggcaaaagacatgttggaagaagagcagcagcaacgttatcatctggtggatgcgcctttagtggaaggagcttttgcagcagccatcactgccggtataacagatgatactcagcaaatcttaacagaagcacaaaatgccggaaagaaaggatgggaataa

SEQ ID NO: 2816 - DNA (genomic), 972 bp, Enterococcus faecium; double-stranded, circular
  misc_feature (B) LOCATION 1...972
  hypothetical: NO
  anti-sense: NO
atgtttattatgaaacgcatcggaattttgaccagtggcggagacgcacctggaatgaatgcagctgttcgtgccgttgttcgtaaaggtatttacgaaggactggaagtatacgggatcaattatggttttgccggtttagttgctggagatattcgtcgtcttgatgtggcagatgtaggtgacaagatccaacgtggtggtacattcttgtattctgcacgttatccagaatttgcaactgaagaaggtcaattaaaaggaatcgaacaattgaaaaaattcggaatcgaaggtctagtggttatcggaggagacggctcttatcatggcgcaatggctttgacaaaacgcggtttcccagcagtaggtattcctggaacaatcgataatgatattcctgggactgatttcacaatcggttttgatacagcaatcaatacagtactagaatcaattgaccgtattcgtgacacagcgacttctcatgttcgtacattcgttatcgaagtaatgggacgcaatgcaggagacatcgctttatggtcaggtgtggctggcggagcggatgaaatcatcatcccagaacatgattttgatatggcttcagttgctaaaaaaatccaagaaggccgcgatcgcgggaagaaacattgcttgatcatcttggctgaaggtgtaatgggcggaaatgaattcgctgagaaactttcagaatttggtgactatcatacacgtgtatctatcttgggacacgttgtccgtggtggagcaccaagcgcacgcgaccgcgtgtgggccagtaaattcggtgcttacgctgtcgaattgcttcaagaaggaaaaggtggattatgtgtcggtatccatgacaacgaaatcgttgcgtctgacatcattgatacacttgaaaacaacaaacataaaccagacttatcactatatgatctaaataattcactttcattttaa

SEQ ID NO: 2817 - DNA (genomic), 960 bp, Enterococcus faecium; double-stranded, circular
  misc_feature (B) LOCATION 1...960
  hypothetical: NO
  anti-sense: NO
tttatcattattgaaactgggaggatattttatatgaataaaagattgttagattattcagcttcagattttttgaaagctaagccgatggaattaaagcaggcaattttggcttctgaaggtagaacaattatggcagaaaatgtgccaagtagctgtccttacatgggaaaatcagtgacaaatgcagaattggagagagctgctggagctgatttaattttgtttaatgcactagatctttttaatcctcaaatttcaggtgtacctttaactctaaaagagaatccaataatctggattaaaaaagctttaggaagagctattggtgtaaatttagaacctgtagacaaagaagttttgatgagtgaaaatcgaactgaaatttcaagtggtagaatcgtctctcctgagactttaaaaaaggcaaatgaattaggctttaattttatttgtttaactggaaatccaggaacaggagtatctaatagaactattgagaaagcaataacattatccaaatcaatttttaatggattaattatcgctggaaaaatgcatggtgctggtgttgatgaaccaattatgaacttagatatagcaaaaagatttattaaaacaggtgtagatattttattagttcctgctccatacactgttccgtatttcatggaaagtgatttgcgaggaatcgttgattatataaaagattttaatagaaataaatctattgaggaaaaagttctagtactaacggctaatggaacaagccaagactcttctgaccaagaaactattaaaaaaattgcattagcatcaaaagcatgtggagctgatattcaacacataggggattctttaaatggtatttgtcttccagaaaatatttttgctttgggtcaagcaattcggggatatcgtcatcaaattattatgttaggaaaatctaattatcgttaa

SEQ ID NO: 2818 - DNA (genomic), 189 bp, Enterococcus faecium; double-stranded, circular
  misc_feature (B) LOCATION 1...189
  hypothetical: NO
  anti-sense: NO
ataatcattattatcaaaataatgttaaaaataaaaaagaattgtccatcactgttattcaaatcattttatcaaaactacatagtaaatgttaaaaagcaacatgacataatatatagaaggctttacagtatatatgggagcttactaaaaaagaatggagtaagagttaacacaatgggccattag

SEQ ID NO: 2819 - DNA (genomic), 1368 bp, Enterococcus faecium; double-stranded, circular
  misc_feature (B) LOCATION 1...1368
  hypothetical: NO
  anti-sense: NO
atacgcattattttcaatctttttgtagaaaaagggtacaatagaaaaagagaaaggcgggagaatatggttatcaatttcattattttatttttgatgattgcaattacttcattttttgtagcaagtgaatttgctttagtgaaaatcagacgatcaagattggaacaactagaaaaggaaaatgtaaagaacgccaagctagctcttcatgttacacaccatttagataactatttatcagctagtcaattaggaattacgctaaccggtttgatcatcgggtgggtcggtgaaggatctgtcgcggctttactagaaccagtgatcggtaaactaccttttagttcggctattagcagtacaatctctgtggcgctgggatttattttagttacgtatatcgatgtggttattggcgaactgcttcctaagagctatagtatcgtcaatacggagaaggtcgtcttgttcgtagttaaaccacttcattatttttataaagtaatgtttccttttatttgggtattgaatcattcagctgcagggctagggaagctattaggtgtgcgtctcgtatctgaaggagaagagacattgtctcaagaagagctgacattagtcgcattgaattcttatgaaaaaggagagttgaccaaagaagaatatcattatttggaaaacgtgtttgaatttgatgataccttggcaaaagatatacaagtagaccgtacgtccatgcaagtattcgaagcttcagaaaccgtcaaagaagcgataaaagcttcgattgaacaaggacatactcgctatccggttatcttagaatcaaaagacaatgttttaggttatgtcaccttgccagatttgatcaagcaatcttataaagatgaccagctgacagtagaacagttgattgaagagccgatcgtaacaactgaaacgatccctataaaaaaattattgacgatcatgcgaaaaaagggaaagcatattgctatcttaaaagatgaatacggagggacaagcggcttagtgacgattgaagatattttagaagaaatcgtcggggaaatccgagatgagacagatttggacgaagcattgatagcggaacagtcagatggctcttatatcatctccggcaaactaacattagatgatttccagcgttattttcatgtagagattccagagtttgaagaaacgaattttactacacttgcgggctttgcttctagccgatataaagaaataaaagcaggaacaatcattgagattgcatcattccgtttcacggtattagaataccagcatgcacatatcgattatttcaaagtagagtccacggaaagaaaaatagaataa

SEQ ID NO: 2820 - DNA (genomic), 198 bp, Enterococcus faecium; double-stranded, circular
  misc_feature (B) LOCATION 1...198
  hypothetical: NO
  anti-sense: NO
agcggcattatcattaatacaaataataggataacgaatattaatgtatttgtcaacagaattttttcgaaaaaatgtgtttctttaataggaaaacagattttagacaaaataaaaatgacaaaaaatgcgaacggtttctttgataatataataaaaaaattcaaaaaaagtattgcgttatttagaagaaattga

SEQ ID NO: 2821 - DNA (genomic), 1002 bp, Enterococcus faecium; double-stranded, circular
  misc_feature (B) LOCATION 1...1002
  hypothetical: NO
  anti-sense: NO
aaggtaattatatggagagtgatagaaatgaagaaaacagcgaccgtattatttgttattcttgggctgagtataattgcagcaatgattggaatcagtacttctgcaaatgaacgggcaaatgagaatctttcatttactgtgaaaactgatcggattgtttatgacatgacacaacaagtcattactattccagtcaaaccaaacaaaagcgtgaatgctagtgatgtacatgctgttctaacatatggttgggatggtaatggaagttcagaaaaagttattggggaagtttatttaaaagacgtacaatggaccgctggtattgagtatacaataatgatttctgcagaactatcgattgatgagatcaagagtaaagataaagttgatttgattgttttttatgatggacagatgacgatcacggagaatttgaaaccaagcagttggacagttgttggaccgccaagcagtacggatagcacaagtagtgaaagcagtacagaaaacacgagcggtgaaagcagtacagagagtacgagcagtgaaagtagcacagaaaacacgagcagcgaaagcagtacggagagtacgagtagtgaaagtagcacaggaagcacgagcagcgaaagcagtacggagagtacgagtagtgaaagtagcacaggaagcatgagtagtgagagtagcacaggaagcacgagcagcgaaagcagcacaggaaaagtaaataatgaacttgatttggtacctatcataccaactaaggaacaaaagagaaatgcagggagcaacctaaaaagtgtgctaaaacagcctgattttgtttctcgtggaattgatcatcaagaaaaagcgaaagaaacagataatagaaaaagcgatttaccagaaactggtagtagaaccttgaacaagctaattacatggatgggtgtgttactcattttgattgtaggagcaagctattttcgttctctcttccatcgagtgaaataa

SEQ ID NO: 2822 - DNA (genomic), 267 bp, Enterococcus faecium; double-stranded, circular
  misc_feature (B) LOCATION 1...267
  hypothetical: NO
  anti-sense: NO
aaggaaattatgccaatccgcatattaacagcattagtgaataaaatcacaataaggaaagcgttttatatttcatctgcattttttctattttctaatcaaacttacaaccatctgtttctatttaaaaacgttggtgttatacagttttgttgcaaacatttattttatttacacatcgtgaacggacgtacaaataatggttttttcttagtttctttatatcgtattctttttccgaaaaaaaagaaacagcttgaaatttaa

SEQ ID NO: 2823 - DNA (genomic), 669 bp, Enterococcus faecium; double-stranded, circular
  misc_feature (B) LOCATION 1...669
  hypothetical: NO
  anti-sense: NO
tcattgattatgaagaaaagtggaaccacgcggaaagcgtcttttgataaggaaacttatttaaaaggcgcttcttttctttataagaagatgatttcctacataaaattcttacgaaaggagtggaaagtcatgagttggtttacccgagcgattgatgcagcaaagagaaacgatccggctgcacgttcgacagctgagatcgttttgacataccctggttttcatgccttgttttggcatcgtttctctcattttttatatcagcaccggctctttttattggcgaagatcaatgctcaattctggcgtttcctaactggtgttgagatccatccaggagcaacgattggaactggcgtgttcatcgaccatggaatgggaatcgtcattggcgaaaccgcagaaatcgaggacgatgtgattttattccatggcgtaacattaggcggcacaggaaaagaaacgggtaaaagacacccaactgttaaacaaggagccatgctctctgcgaatgcgcagatattaggaccggtaacgatcggaaaaaacgccaaaatcggtgcaggtgccgttgtgttgaaagatgttccagacgacgctacagcggtaggagtaccagcaaaagtcgttcgaatcaaaggagaaaaagtgaggagatcagaatga

SEQ ID NO: 2824 - DNA (genomic), 264 bp, Enterococcus faecium; double-stranded, circular
  misc_feature (B) LOCATION 1...264
  hypothetical: NO
  anti-sense: NO
agattgattatcggtctgtcttatgttgcaacaattattttaggtggaaagtatgtcttggaatgcgggaggtcaaccggggggataggcccatttattagttatatcggtatgcnngtnnggcccatgtttgcggaccggtcgattgttgccccctcttggagtccacgagatgcgacagaggatcccctcgagcccctcaggctgggagaacactcgtggaacaactgggtgcagtgcagaccccggcaaaaggcgagctga

SEQ ID NO: 2825 - DNA (genomic), 714 bp, Enterococcus faecium; double-stranded, circular
  misc_feature (B) LOCATION 1...714
  hypothetical: NO
  anti-sense: NO
tgcatgattattggagttttgattgtcagcttgcttgcttttgctttaacgaacgtgttcgctaaaaaaacatggcaaacctttttatctttgattttcggactaatcttcgtcgcttcactaagtttgatcgtcgctaatttgtccaatcactttggaatggaaaaagtaacggaaacaaaaacagaaaaaattgtttccagtgctgattcccaaggagcagatatgcttttgtataaagctttagggaatggaaaagaaaaagtgtatctttaccgaacaaatgaaaaacaagaaaaaccaaaagcaactggtacggataacgaaacaaataaagtagaaaagacagacggcgatgctgaaaaagtgacgaaaactacttattgggaatacaaaaacgacatgtataaattctggttcaatattgctgataacaatcacgaatatgacagccgagtgaatacattcaaaatcccagagacatgggtagaattaagtacggaccaagcagccaagttagctgaattagtgaagaaacagcaaagtacgatggaaagtgaagcaaaagcttatgttcaagacggtatggtaaaagcaatgactgaaaatccaaaaatgagcaaagcagagcaagaacaacgtacgaaagccttagctgctgaattccaacaacaagcattcgcaaaattagtgaaagaagcaaaaggcgaataa

SEQ ID NO: 2826 - DNA (genomic), 867 bp, Enterococcus faecium; double-stranded, circular
  misc_feature (B) LOCATION 1...867
  hypothetical: NO
  anti-sense: NO
aagcagattattttatccattatgactatggatattatggctataaggagcattacgcctacggggaaaatcaaggtcatggcttctgatgatgaacacatgggcgtattcttggaattaaaaggagcaggctcacgcaacatggaatatgtcttacaggcacagaacagagattggtattcattcttgaaccgctgtcttgattgtggcggtgttatccgacgttttgacttggcaatcaatgatatgtgcggtctactggatattcctgtgctatctgaaaaatacaaaaatggcggtgcggaatgtcgctgtaaaaactatgaaaatgtgcaaggtggaaaattaagcggaaaaaaccgtaatttagcaagcaccctttatatcggctcaaaggcaagcacaaaatatttctgcttatatgaaaagcaaaaggaacaggcagcgaaaaagaaacatacggatattatcaaccgttttgaaattcgtctgcgtgataaaaaggcagtacaggcagttgaggaattgttattgacatataaccctcatgggttggtgttttaccttattactgattttgtgcaatttcccgattatccgctgtgggagatattcatttcccatgacagtttaccttttgaaatgaaccccgtacctgtcaatatggaacgcactctgcaatggctggaaagacaggtcatgccgtcaatcgtgatgatagaggaaatcgacaggctgacaggctcaaactacatgaaaatgattgatgaatgtacccacctttccgaaaaacaggaaatgcttgtagaacagatgtgtacggatatagcagatgtaatccaaagtgagggggtgttttatgagtaa

SEQ ID NO: 2827 - DNA (genomic), 852 bp, Enterococcus faecium; double-stranded, circular
  misc_feature (B) LOCATION 1...852
  hypothetical: NO
  anti-sense: NO
gagcagattatgactgaattcaaaaccgaaaaagaaaaaatgattgcaggcgagctttattttgccaatgatcctgagctggttgccgaccgtatgtttgcaagaagtcaaagccaaatcatcaaccaagcagaatcagcggaactgcgatcccaattgttgaaagagacttttggccgtacagggaaaaaaatctatatggagccagttatcaattttgattacggatataatatatttgttggggagaatttttatgcaaatttcaattgtacatttttagatgtcagcacgattgaaatcggtgataactgcatgttcgctccgaatgtccagctttacacggcgacgcatccactacatccagtgaaacgtaacagcggtctggagtacgcaaaacccattaaaatcggtaataatgtttggttaggcggaggagttatcgtcacgccgggtgtcactctaggggacaacgtagtagtcggcgcaggttcggttgtgaccaaatcttttcccgacaatgtagtgattgcaggaaatcctgctcgtatcatcaagacagtagaggaagaactaacagaagagtctcttgaaacattacgtcataagatcgatatgatcgatcgagagttggttgctttattagaaaaaagaatggatacggtaactaaaataggacaagtgaaaaaagaagaaaaccaagcagtttatgatgcaaaaagagagcagcaagtattggataaagttgttagtctgctgaaaaataagggatataaggaaacaataacagacacgtatgttgatttgatgaaacactcgcgcgaataccaaaacaaaatgaaggaggaataa

SEQ ID NO: 2828 - DNA (genomic), 354 bp, Enterococcus faecium; double-stranded, circular
  misc_feature (B) LOCATION 1...354
  hypothetical: NO
  anti-sense: NO
gtgaagattatggaaattaatgttgaacatattttagattgtctcgatcaatatggaaaaggtgagctaacggaggaacaactcactaacgcattaacctatgatgaaaaaatgtttctgattatgcatcaagggttactggaagtaggtaacgatgccaaagaagactttgatataccggattggttaggagaagaagagtctttctttatggttgtcgaggtaaatgaaagtttatgtcgacaggcagagtctgtcttggaagaaatcggtgtggagatgccggatgccattgaaggctttttaaaacaattggtggaaacgaaacaacttcccgtagtagtaaatgactag

SEQ ID NO: 2829 - DNA (genomic), 873 bp, Enterococcus faecium; double-stranded, circular
  misc_feature (B) LOCATION 1...873
  hypothetical: NO
  anti-sense: NO
tctcacttctttatggaggtgataattatgaacgttggttttattggagccggcaaggtaggttgttcattcgggaagtatttccaggaacataaaatacaagtaacaggattttatagtaaaagcgaagactcgtcattagcagcttcgaattttacatctagtaaacaatatttaaacttaagagaattagtagatgaaaatgatactattttcattacgactcctgatggtcaaattcaggaggtatggcaagaaattaaaaattatcaaatcaaaaacaaattaatctgccattgcagtggtgcaatatcttcagatatcttttcaaatatacaggactatggtgcttatggctattctgtccatcctatgttttcaatatcagataaatataattcatacaaaaaattaaaaaaatcttttataacaattgaaggcgatgaaaaatatgcaaagtttttatgtgatttcttcaaaaagttaggtaatagtactgtaattgtatctaaggagaataaatctctttatcatgccgcatcagtagtatctagtaaccttgtgctaggacttattaatacaagcgttacatatctaattcaatgtggatttactgaaaaaatggcaattgaagctttatatccattaattgaatttaatattagaaatataaaagaaaaaggaattatagaaagtttgacagggccagttgaacgttgtgatatttcaacaattaaaggtcactgtgaagttttatcagatgaagacagagctttatatatgctattatcaaaaaatgtattagagatagctatgttaaaaaatattaatagagattatagtgaattagaaaagtatttaggagagagttag

SEQ ID NO: 2830 - DNA (genomic), 192 bp, Enterococcus faecium; double-stranded, circular
  misc_feature (B) LOCATION 1...192
  hypothetical: NO
  anti-sense: NO
gaatgtgttatactgtttttgaaagcaattaaaggagagagtgcaatgattcaggcaaagattacagaaattgggacagaagcaataaacaaggaagaacccatgctgattttgttcgataaaacagcaacagctgccttacgaaaatattcggtgattcaagaagtatcaaaagacgaactttttctttga

SEQ ID NO: 2831 - DNA (genomic), 522 bp, Enterococcus faecium; double-stranded, circular
  misc_feature (B) LOCATION 1...522
  hypothetical: NO
  anti-sense: NO
aagagcttcttcaacagctccagtttcctaaaagcagctatttttatcaaaaacaagcacttgagaaaccagataagtattacaaagaacgtcaaattaattatcacgattttcaatcataacttctgtgcgtatggttaccgtagaattcaccaagctttaaaaaatatgggtaaaaagctttctgaaaaagttgtacgtagattgatgactgaggaaaatctatttgttaaattttctagacgaaaaaagtattcttcgtatgctggggaaatttctcctgcacaccccaatttattaaatcggaattttaaagcaaagaagccaaatgaaaaatggttaacagatattactgaatttagaattctcgcagggaaaatctacttatcaccacttgtcgattgttacgatggtgctattgttagttggactattggaacaaagccaacttgcttcactctatgtctaaaaagagttattcaccagataattcagcgtgcgaaggtttctttggacgattaa

SEQ ID NO: 2832 - DNA (genomic), 975 bp, Enterococcus faecium; double-stranded, circular
  misc_feature (B) LOCATION 1...975
  hypothetical: NO
  anti-sense: NO
caaatagttatgaaaaggagctgtttattcatgaaaaaaacaagtcgtaaagtagtaatcgtcggtacaggttttgttggaacaagtatcgcttatgcaatgatcaaccaaggaatctctaatgaattagtattgatcgatgtgaatcaagaaaaagcagaaggggaagcattggaccttttagatggtatggcttggggcgatgaaaatgtggctgtatggtcaggtggctatgaagaatgtaaagatgctgatatcgttgttatcacagctggtatcaaccaaaaacctggtcaatctcgtttagatttagttaaaacaaatgcgtcaatcatgcgccaaatcgtaaaagaaatcatgggatcaggattcgacggtattatcgttgttgcttcaaacccagtagatattttgacatatatcgcttggaacgaatctggtctgccaacatcacgtgttatcggtactggaacaacattggatacaactcgtttccgtaaagaaatcgcattgaaattaaaagttgacccacgcagcgtccacggctatatcttaggtgaacatggtgattcagaagttgctgcatggtcacatacaactgtcggtggtaaaccagtgtttgaaattgtagaaaaagaccatcgtattgcccaagatgaattagatgtgattgctgataaagtccgtaatgctgcttatgagatcattgatcgtaaaaaagcaacttactatggtattggtatgagtactgcacgtatcgtaaaagctatcttgaataacgaacaagctgtattgcctgtatctgcttatttaactggtgaatacgacgaaaaagatatctttacaggtgtgccatcaatcgttgacgaaaatggtgttcgtgaagttgttgaattatcaatcaacgaagaagaaaaagcaatgttcagcaaatcaacaagtgctttaagagaagtattgaacactgtattataa

SEQ ID NO: 2833 - DNA (genomic), 471 bp, Enterococcus faecium; double-stranded, circular
  misc_feature (B) LOCATION 1...471
  hypothetical: NO
  anti-sense: NO
aaatcagttattattgaaggaggcaaaataatgagtcaaatatatttagcaggaccatttttttcagaggagcaaatcgatcgagtaagtcgtatcgaaaaagcgttggaggaaaacaaaacagtcacaagtttctactctccacgtcatcaccaagaaagcaattatgaactattcagcgctggatgggcgcaggaagtatacgaaaaagatatggaagaactgacaaatgcagaatttgttgttgctatccttgactttgagcatcaaacaatcgatccaggaacggcttacgaattaggtgtggcaactatgttgaaaaaaccgatgatcattgtacaagaagagacggtacctacgaacttgatgattacacaaagtctccatacgtatttaaaatcagaccaagctgtacgtgaatatgattttgaaacattgcctgttgaaacttacgtaggcgagtacttatag

SEQ ID NO: 2834 - DNA (genomic), 231 bp, Enterococcus faecium; double-stranded, circular
  misc_feature (B) LOCATION 1...231
  hypothetical: NO
  anti-sense: NO
agtaaagttatcaagaaaagtgaggacacggagatggaacagtttttaaatgaaaaaattactgaagccaaaagagaagttgatcgtttaacgcacgtctgtcagacgaagccttttgattcagctgatttttttgaaaatgagtttcaaatcgaacgcttggcagcacaaatagaagtgtacgaattaattttaaaaaaagtaatagaagaaaatatagatgtacaataa

SEQ ID NO: 2835 - DNA (genomic), 942 bp, Enterococcus faecium; double-stranded, circular
  misc_feature (B) LOCATION 1...942
  hypothetical: NO
  anti-sense: NO
aagctggttattcaaatggaagtaaaagaattagaacaattgattggaaaaaatttccactattatcaaacaggacaagtggcggattacattccagcattagctgaagtggatcccaaacaattaggtatggcgatttatgatttggatacaaaacaactgattgagggaggagacgccgatgtgcgctttgccatcgaaagcatgtcaaaagttcccgtattgttattagcaatcaaagacaacggaatagaaaaagtctttcaaacaatcaacacggaaccaaccggttttgccttcaattctatcatgaatatggaaatcaatcatcgcaaacatccaatgaatccttttgttaatgcaggagcgattgcaacaacctcgttgattgccggtaaagatgcagatgaaaaatttgagcgaatcttgtcatttatgaaagagatctgtgatgatcctaatatcacattgaatgaagaaatctatcattctgaatcaagaacaggtgatatcaatcgctctcttgcttactatatgaaaggtaatcaaatgatcgaaggagacgtaccggagatactcgatgcttatttcagacaatgctccctcaatgtcaccgctacaggcatagcaaaattagctgctgtgctggcaaataaaggaattgctccttggaatggcaaacaaatcattactgaagaaagtgctacaatcgtcaaatcaattatgacaactgctggtttgtatgatgaatcaggagagttttccgtccatgttggtgtacctgcaaaaagcggtgtaggcggcgggttgatggcagctgtgccaaatcgttacggcataggtgtcttcagcccggcactagatccatttggtaacagcgcagctggtatccaattgttgaaagatgtagtcaaagaactagacgctgacatctttgaataa

SEQ ID NO: 2836 - DNA (genomic), 1086 bp, Enterococcus faecium; double-stranded, circular
  misc_feature (B) LOCATION 1...1086
  hypothetical: NO
  anti-sense: NO
ggaggaattttaatgattgaattgcgagatgtttctgtatgtttcaaacaaaaagaaaaagagatacaggcagtagattctgtagatttaacgattgaaaaaggcgatgtttatggaatcgtcggttactcaggtgcagggaaaagtacgttagttcgtgtgatgaatttgctgcagaaaccaacagcaggagaagtcattgtcaatcagacgaatctgagtcagctctctcccaaagaattgcgaaaagaaagaaaggccatcggtatgatctttcagcatttcaatctaatggaaagccgaactatttttgacaacgttgatttttctttaaagtattctggaaaatcgaaacaggaacgtcgtcaaaaagtgaatgaactactggaacttgtcggtttggaagaaaaagcatctgcttatcctaaacaactgtcggggggacaaaaacaacgagtagcaatcgcacgagctttggcgaatgaacctaaggtattattatgtgatgaagcaaccagtgcacttgatccgaaaacgacccttcagatccttgcattgttaaaaaaattgaatcgccagttaggtttaacaatcgtcctgatcactcatgagatgcaagttgtcaaagaaatctgcaacaaggtagcggttatggaagatggaagaatcgttgaaaaaggtagcagcatccagatcttcagcaatcctgaagaagaattgaccaaagattttattcgaacagctactcatcttgaccaagcattagaaacgatcattgcccattctgcttttgccgatcagatcgccaataaatggctggtggaattaagttatattggaaatcagacgaacgaacctctaatcgctcatctgtacagcaaatatcaagtaacagcgaatattttatatggcaatgtagagttattacaagaaacgccgttagggagtttgatcgttactttagctggagaaaccaaacagcggaaaaaagcattggattatttgatcaaatctggtgtaaaaataaatattttacaaaaaaacgatttagatagtcgtatcaaagtgatcgaaggaggaagataa

SEQ ID NO: 2837 - DNA (genomic), 1248 bp, Enterococcus faecium; double-stranded, circular
  misc_feature (B) LOCATION 1...1248
  hypothetical: NO
  anti-sense: NO
ggaggaatttttattatgttatctgattttaatgaacttctaaaaaaatatgcacgcttaattgcagaaactggcgtagccacagaaaaaggacacacagttgttttacagatcagcgtggaacaggcaccccttgctcgattgatcacacaagaagcttataaactaggagccgctgaggttatcgttcaatggactgacgaccagatccaaagagaatttcttttacatgctgcaacggatcgtattgagaatgtaccacaatctaaaatcgatcaagcggatgaatggcttgaaaaaggagcaagcaggatcagcgttgtttctgccgatcccgatgcatttgctggtgtagatagccatcgagtagcgtcttatcaatcagcgaatggcaaagcactaatgaatttacgcaaggcaactcaagcaaataaagtcagttggactgtcgtggctgcggctggtaaacaatgggcagcaaaagtcttcccagaactgccagaagaaaaacaagttgaggcattatgggatcagattttcaaaacgactcgtgtctatgaagaagaccctgtcttagcatggaagaagcatgatgaaaaattagcaaaaaaagcagaagaattgaatcgagaacaattttctgcccttcactatactgctcccggtacagatatcattatcggattgcctaaaaaccatctttgggaaggcgctggaagctataatgctcgtggagaaaaattcatggcaaatatgccgacggaagaagtgttcacagcacctgacagtcatcgagtagatggttacatttcaagtacaaagccactgagttatgctggcaccatcatctcgggtatgaaatttacttttaaagatggaaaagttgttgatttttctgccgaacaaggagaagatgtcttagcaaaactgcttgatacagatgaaggtgcgcgtcgtttaggagaagtcgcacttgtacctgacccttcacctatttctcaatctggcatcatctttttcaatacattatttgatgaaaacgcatcgaatcacttagcactaggttctgcttatgccttcagtgtgaaaggcggtacagaaatgtccgatgaagaattagcagaagctggattgaatagaagtcaaacccacgtagatttcatggtaggatctgacaagatggatatcgacggaatccgtgaagatggctctacagtaccgattttccgaaatggcgattgggcttga

SEQ ID NO: 2838 - DNA (genomic), 621 bp, Enterococcus faecium; double-stranded, circular
  misc_feature (B) LOCATION 1...621
  hypothetical: NO
  anti-sense: NO
ggaggaattttggttatgtcagtatcattagaagtaagtaaaagagaagtacgtccccgttcattaagaaacaaacttcgtcacgaagggaaagttccagctgttgtttatgggtataaagtagaaagtacccctatctcattcgatggtttgacactaagcaaattgttgcgtgaacatggagcgaacacagtcatcacgatggacatcgatggacaaaaagtcaatacattggttcacaagatccaaacgaacacttttaccaatcatttcgaacatgcagaatttctatctgtaaacatgtcggaagaaacagaagtcgaaacagaagtcgttcttgttggcgaatcagtgggtgctaaatctggtggagtgttagctcaaaacttgtatacagtagtcgtatctgctacaccagacaaattgcctgaacgaattgaagttgacgtgacaaacttggaattaggtgattctattacagtagccgatcttccaaaaaacgacgattacaaattcgtgaccgacagtgaagagcaaatcgctgctgtagtcgctcaaagtgaagaagaaagcacaggtgaaggtggcgaaccagaagtgatcggttcaacagaagaataa

SEQ ID NO: 2839 - DNA (genomic), 840 bp, Enterococcus faecium; double-stranded, circular
  misc_feature (B) LOCATION 1...840
  hypothetical: NO
  anti-sense: NO
accagattctttctggcatctctaacgatgaacgaaccaaaattatggaccaagcagtcaaagatcagcctgctgcaactgatagtgaagaaaaacctggcatcatttctgatttcactacgatttggaaacaatacggcaatatgttcttacgaaggtgctggacttaccttgttcatcgcattgatcgggacagttgtcggtactacacttggattactgattggtgtcttccgttcggtacctgaatcaggaaatgcactgactcgcttcttccaaaaaatcggaaatgcacttctttctatctatgtcgaagtattccgcggaacaccgatgatggtacaagcaatggtcatcttctacggtctggcactcgcttttggcatttcattgaaccgaacgattgccgctttgtttattgtctctctcaatactggagcttacatgacagagatcgttcgtggggggatttttgcagtagatgaagggcagttcgaagctgcgcaagccattggtatgacccatggccaaacgatgagaaaagttgttattccacaagttttacggaatatcttgccagcaacaggaaatgagtttgttatcaatatcaaagatacagcagttttaagtgtaatcggcgtagctgatttgttcttccaaggaaactctgcttccggtgcgaatttccaattcttccaaacatttacgatcgtcgggatcatctacttagtcatgacctttacgatcaccagaatcctgcgggcggtagaaaagaaaatcgatggtccttcagcttataccaagcttgaagaaatcgacaattcaaatttgcaggaataa

SEQ ID NO: 2840 - DNA (genomic), 198 bp, Enterococcus faecium; double-stranded, circular
  misc_feature (B) LOCATION 1...198
  hypothetical: NO
  anti-sense: NO
ggtggatctatgagtagaaaaaccagtgttaaaatcagtggcgaccttgaaaaaatcataaaatccgaagcaaacaagattttaaaaaagggcgtcgattatacttgtccttcctgtggtaaaaaaattaaaatatctaatggaaaaaacaagtgtaaatattgcggagctgaaattgatttcaaagggaaggtttag

SEQ ID NO: 2841 - DNA (genomic), 321 bp, Enterococcus faecium; double-stranded, circular
  misc_feature (B) LOCATION 1...321
  hypothetical: NO
  anti-sense: NO
gacaagtctatgacgcataagatcggtgtagttggcgacaaagattctgttttgccattcaaattgtttggctttgatgttcgttatggtacaaccaagcaaaccgttcgtcaggcaattgaagaaatggcaaagaatgagtatggcgtgatttatgtcacagagcaatgtgcagcattgagcccagaaacgatcgaacgttacaaggaacaaatgatacctgctatcgtattgattcccaatcatcaaggatcattagggatagggctggaagaaattcaaaaaaacgtagaaaaagcagtaggtcaaaatatcttatag

SEQ ID NO: 2842 - DNA (genomic), 378 bp, Enterococcus faecium; double-stranded, circular
  misc_feature (B) LOCATION 1...378
  hypothetical: NO
  anti-sense: NO
cggtcgttcttgagatatgattttaattgggaaaaacttatcgataaggaggtctttatgaaaaaaagactgttatggtgtttgctgtctctatccctaagtttaacaagtcaaccagtttttgcagaagaaacacagcgttctctaagcacaggcgcacatatgtacaaaaatatttatgcgcagacatcagcgtttgattctgcgttccctgaaacagaagaacgggctttgcagccaaggtttggttatttttggtattgtccgtcatgtgattacgaaagttgctggcatttcttccattcaacagctgcagcttttgctgttacccatgctcagaaatatgatgggcatcatcctgtcatttatgaggtatag

SEQ ID NO: 2843 - DNA (genomic), 888 bp, Enterococcus faecium; double-stranded, circular
  misc_feature (B) LOCATION 1...888
  hypothetical: NO
  anti-sense: NO
aaaaagcctatggagatactatatttattggagagggggaataatatgcttcaaaattttattaatggtctgtatgactttcactttttacagaatgctctaattacatctgtagttatagggattgtttctggaacagtaggttgttttattattttaagaggaatgtctcttatgggtgatgctatttctcatgctgttttgccaggagtagcaatttcttatattttaggtattaatttttttattggtgcgattgtatttggtctattagcttctatcattattacttttataaaaagcaatagtgtaataaaaggagatacagcaattggtattactttcagttcttttttagcattaggagttatccttataggagttgcaaatagctcaacggatttatttcatatcttatttggaaatattttagctgtacaagatattgataagtggattacaattggcgtttctgttttagtgttggttacagttgttctattttttaaagaattattaatcacttcttttgatccattaatggcaaaagcaatggggatgaatgtcagtttttatcattatctattaatgattctattaactttagtagcagtaacagctatgcaaagtgtgggaactatattaattgttgcaatgttaattacaccagctgctacagcatatttatatgcaaacagcttaaaaactatgatatttatttcggcgacagtcggagcgtgctcatcattgctaggtttgttcattggttatagttttaacatagcagcaggatcaagtattgttttaacagcggcattcttatttgtaattagttttctaatctcaccaaaacaaaaatttttaagaaagaaggagagaaagttatga

SEQ ID NO: 2844 - DNA (genomic), 207 bp, Enterococcus faecium; double-stranded, circular
  misc_feature (B) LOCATION 1...207
  hypothetical: NO
  anti-sense: NO
catcagttcttttccgagtttctggtaatttacccccatgctgcgctggcttccccgcgtgtcggaggtattgaaaaggtcgatggtttcctttcccagcgtttccgaaatctctttcagggtgctgcgctccttgccgcccaaaaacaggacgcaggagcagttgccgatgatagtttccgcatggtctttgtagacagcctttaa

SEQ ID NO: 2845 - DNA (genomic), 189 bp, Enterococcus faecium; double-stranded, circular
  misc_feature (B) LOCATION 1...189
  hypothetical: NO
  anti-sense: NO
agcttaactatatacatagtatatgaattgacagacatcggtacgccaatcgtcaaacagcataatggtatcaatgagatcaccttatattatgacttgccgctcttcttttatttcatcatcgggttgaccttcattggttggctgattttattcatcatgtttattagaagtcggatacattcataa

SEQ ID NO: 2846 - DNA (genomic), 1137 bp, Enterococcus faecium; double-stranded, circular
  misc_feature (B) LOCATION 1...1137
  hypothetical: NO
  anti-sense: NO
ggtgtaactatgtctttacttacatttgaacgcaatctcttactaaaaaacaaagtaaactttttatttcctctattgttggtcgtgctctttgcattcccacttttttttgatcataaacttgcttatacagaattcgatgaactgaatcataactatgaagagatgcaacgtttgattgaaacgttgaaagaagatgagaatgagaaagaatttgtggaaagtttagagaaaagcaacaaactgatcgaagcaatcttacatgcaaaaaacacagggaatgtccagcaaatggtcgaagcaacttatcattatgaaaaagatatactggatcgactgatttctggtcaaagacaaggaattccaatcattgaacaacaaaaacgtgtcgagttgctccgttatatgaaagaacatcagatccaaagatattctatttttgacttgccagcgcatctctctttagcaaattactacgaaaatattttttcaggaatgatttctagttttttgattttatgtataaccgccttgtttctttcttccatcatctcttatgaaaaaagaaagcaggtaatctctctagtcaatctattaccggatagtatggtaaagaaacatagcatccgttttaccatttattatggtgcagctatgctaagtctcgtgatgccatttttgatcgtctctatactagtaataatcaaaaatggtttgggagacttccgttatcctgtaggaacgatcattggtcaggagatacgaatcctgccgatgtatgagtatcttttccagagctttctgttcctgttgttgtgggtgctctttttaagtacaatcagttttcttctatctgctttatttgaacattctctagtcaatcttttaggtacacttctttgtcttttcttagcagagtatcgcttgttttcttcgattggatggatagaatcaatcagtcattacttgccaacttcttatgttgattttcaaaatgtgatcataggaggagatattttctcgccactagcttcagaacaggttactttcatgaatggtatcttgacacttggtatatggagtatcgttttattattcataggtatgggcactatctatataaaaaagagctattaa

SEQ ID NO: 2847 - DNA (genomic), 645 bp, Enterococcus faecium; double-stranded, circular
  misc_feature (B) LOCATION 1...645
  hypothetical: NO
  anti-sense: NO
gaggtaactatggataatagcaatgaaaaactaaccaaaaaagaatatcttgaattaatagttgaaggcggtattggagcaattccttatattggtggcgttgtgcagtcactttattttgggtctaaaaacgagaagcgtttcaaacgcatcgagaaattctacaaaaatttaaacgaatcattagaaaacattcgcgatcaaattccagaagatgttttcaacttagagaacaaggaccaactcattggaatattcgaagggataaatgacgaggtagaaaaatcaaaggcacaaaataaaatagatatgtataaaaatctttataagaattgtttacttcgaattaacaacgcttcatgggataacgaggagtattatcttcttgtactgaatcaattaacatcgattgagattcaattgttagcatgcttaatgagtcgtggaaacgaaaatttcactggaaatatcagcatgtctggctattcacaagagctaatagatggtagcttaaatagattatctgattttggtctgttagaaaaaacgattagctccatagtattaggtgatgtcggcaaacaaaatatgggctacaaaatatctcatttaggaattcaatttattaactcaactcttacttaa

SEQ ID NO: 2848 - DNA (genomic), 402 bp, Enterococcus faecium; double-stranded, circular
  misc_feature (B) LOCATION 1...402
  hypothetical: NO
  anti-sense: NO
ataaaaactattagacaaatgatattttacgaggaggaaacaatcatgattaaagtagttattgcagaccgtatgggtaaaggacaaaatgtggccaaaggggtagaagcagctggtggaaaagcagttgtcgtaccaggaatgggggcagatatgcgtttgggcgatgtgatgcaacaagagcatgcagatatgggtatctctttttgtggtagtggtggtgcaggtgcattaacagcagcaacaaaatatggctatccagaacgacatggtatgcgttcgattgaagaagggatcacagctatcaaggatggcaaaactgttctaggtttcggctttatggatcaagaggaattagggaaacgtctgacagaagaatttatcaaaaagcatggaaaatag

SEQ ID NO: 2849 - DNA (genomic), 2418 bp, Enterococcus faecium; double-stranded, circular
  misc_feature (B) LOCATION 1...2418
  hypothetical: NO
  anti-sense: NO
ataaaaactattagacaaatgatattttacgaggaggaaacggacatggcagaagaaaaagaaccactagacaatagtcgtttgggaaaatccaaaagaaaattagtacgattgcaaaatgaattaaatgatcaaatcgaaaagatgtttgaacaccaaagaaagaccaacggtcaaccaatgaacgataagagaaacgggcattcttggtttaggcaacaagaacgaatcgaaaataaagtccaaagtctgagagaagagatcaagcaacaagaaaaacaggtagaaaaacttgaaagacaagaagagctaaaggaaatgggttataacaagtacggtggcctggatatgacgatcgaaaatattccaagaatcaaagaagaaatcgaacgctttgaaaaaggtgaatcgactttttcagctgccacgatccgaaaataccaacgaaaattggaaacattagaacagctgaaagaaaaatcagagaaaggaaaagaaaatattcttcctgaagtacaagcgatcattgacagcggacgagtgacgcaatggaaaaagaatccaactatctattttctgaaaggctatcgaaaagtcgctttagaactcaatgaaaacgggggatttgaggaatctaaaaaataccaagccacgtcggaagaagaaaaggcagctgttcgtgaattacttgaagaagctacacctactgattctgtgaaggagaaagaaaccgatcatttctatcgagtagaattcaacgaaaatgatccagcaaaagggttgaaaagttatggtggggagatcgtaacactagaattgatcgatcaactcaaaacactggataaccaatacgccgcagaagcaggctattataaattctattttgaagaagtgaagaatggagaagtagtagatcagatacgaatggatctaggggatggcgtcaatagtaatcaccccatctatttagagttagctagattgtgcgaacaagtacctgagaaggaacaaaaacaaacagtcaaaaatgaacctatttcaaaagtacaaaatgagattaaagagacaaaaacaaaacaaaagggttatcaaaaacgaacggcagaagagattaagcaagaagtcaaatcactttcccaacaggcgcttgatgcggtgaaaaagcatactcattcacctgaagacgtcaaagaacttttgaattttatgtctcgttttccagaacgatcctttagaaatcaattattgatcgaggaacaatttccaggcgcaacggcttgtttaggtcgtgccgcgttgaaaaaagaaggaatctatatcaaaaaaggggaacaagggaacaagatctttgtcagaaaaacggtcaaaggattttatgagaaaggacgtggctttgttcgagaaacagaggctacaccagaagataaaaaacgaatcgaaagtggtcaaatcgaagtgatcaaaaaaccttactacacgattgaaaaagtgtttgatatcacacaaacacaattgaagcctgaagactatccgaaaatcttcccgaaccgcgtctttgattttcaattggatcaaacagggcatacagaacttcaagttgggattcaagcggtagccaaaaatattggaattcaaattcgagatatgacagaaagtgaagtctatcaaagagaattaggacaagcacgtggggcgtacgttcgtaacgaatttactggcgaagaagaaatcgtcatgaatactcgaaatactcctacgcagcatttagccacaagtattcacgaattagcccatgctagaatgcacaaattttcagaattagatactgcaacaaaagaactacaggcagaaatgacctcctatattgtgtgcaagcattttgggatggacacctcggagaaagctattccttatattgcgacatggacgaagaatggtcagacattggatgataaggaagctgcggaacgtgggaaaatcatgaatgatgtcagtcgtgtcgcaaatgaattcattcaaaccatttctaatgaaatcaatcaatacagagaaagagaaccagagatccagccagcagaagtgaagcaggatgagaaaaatgttgtagaaacagcagaacaaaagaatattgtgctcgttggctcactttggatcgacaagaaagacgggaaagtcctggaagaagacacgggccgaacgttacatttgaaggatgcggcgtttattgaagatacgcagcataatcaagtgattttaaaaggaaaaagttatggaaaagagattcaaacggcgttaccttcagaagaatttgcgctaggaaatccattccgattttcacttgaaacagtgtcagaagtggccaaacgaaaaaatgaaatctattatgaacaacaattgtcacaaaaagaacgcgtataa

SEQ ID NO: 2850 - DNA (genomic), 1248 bp, Enterococcus faecium; double-stranded, circular
  misc_feature (B) LOCATION 1...1248
  hypothetical: NO
  anti-sense: NO
ggggaaactatcttggatacttgcagatgtcccaggaaattaacaggaagagaagaatataacaaaattattgagtttcaagaagggcacaggtaccataggctcttgtgtcccacagagacaagattttgttatagtcttctcttacatatgattaaaggagcgattttcttgagaccaaaacaacaattatttataacactcctagttattttaggggcactttttaacaatatatcagtgtcagctagtgcatttaatttttcagtgacgccgataacttcagagaatcaaatcgacaagagaaaaacttacttcgatcttcaacttgatccggatcaggaagtagaagtaaaagcggaattgagaaatgatacagaaaaagaagtgaaaatcgatatttctgtgaatagcgcaaccaccaattcaaatgtgatggttgaatacggaaaaaacgagattgaaaaagacatgagcctgatctttgatctggtagattatgtgagctatccacagatagtgacgctaaaacctaaaagtgtccaaaccgttgcttttcatgtcaggatgccgaatgagcgatttgatggtgtattggctggtgggatcacattccaagaaatccagacggaaaaggaccaaacagaaactaaggatcaaagcttatcgattgagaatgaatacacctatattattgctttgttgatgcaacagacactgaacgaagttgctccgaaccttactcttcatgaagttaaaccagatcaaatcaatgcaagaaatgtcatcttagcaaacgttcaaaatgatcaaaaaacctatatcaatcaagtagttattgaaacaaaaattacaaaaaaaggacattctgaagttttatatcaagaggaaaaagaaggattgcagattgcgccgaatacaaatttttcttttccaactgctttaaatggtcaaccgctaaccccaggtgaatatcaccttacaatgactgttttaggaaatgaaaatgaaaatggaaaattttcgagaaaaaaaggaaatactacgatcaactataccaatcaatgggtatttgaaaaagattttacaatagacggaaaagtagccaaggaattgaacacgacggatgttacgattaaaaaagacaataattggatttatatcttagtagcttcacttttcttattgtttattttattatgcatacttttgtttgttttgagaaaaaaagaagagaaagaaaagtaa

SEQ ID NO: 2851 - DNA (genomic), 309 bp, Enterococcus faecium; double-stranded, circular
  misc_feature (B) LOCATION 1...309
  hypothetical: NO
  anti-sense: NO
ggtaagactatggatcataaatcaaattattcatacaaagaaaattatatttggaagtatgtagtagccgtttttctactggtaggtggaattattgcattggttaaatgggctataattcctaatgctttagtatttatcaattggtttgtccctaatttttggagtttttttggctatatattgataatctggtttatgtttaaagtactctcttttttctggtcgcctgtatattctttgcttggaaagtggtcgtacctaattttaatagcgacagctatttatatcattatgcagattaactaa

SEQ ID NO: 2852 - DNA (genomic), 360 bp, Enterococcus faecium; double-stranded, circular
  misc_feature (B) LOCATION 1...360
  hypothetical: NO
  anti-sense: NO
atcaccttttttagattaaatcgtcttatatggaaaaatatatggataaatttgttttattgcgaaaaaaaaggtataatagagtatacttttaataatgaaaatgagggatgggcattgaaacaacaagtcattctaaatacggaattcatgacgttgggccaaatgttgaaagaagtcacagttatcggtagtggcggacaagcaaaatggtatttggcagaaaacactgtgttagtcgatggcgaaccagaaaatcgtcgtggacgcaaactttatcccggcatgatggttgaagttccagaagtaggaactttttttatggtaaaaaaaggaaacgacgataatgaggctgaataa

SEQ ID NO: 2853 - DNA (genomic), 1848 bp, Enterococcus faecium; double-stranded, circular
  misc_feature (B) LOCATION 1...1848
  hypothetical: NO
  anti-sense: NO
aaaagtgctatacttaattttgtattacaatatgaagggagttttttcatgagttattcattaaattggaatctagattctattttttccggaggcagtcattctgatgctttgaaccaacggatgaagcaattggaagaccaaatgaacgagtattatcaccgcgtaacaaaatggtcacctagttctgacaatgcagagcagttaaacgctattcttcaattgcaagaaacgattacgaatggttttacccaatgcagcagctatattactgcattgctttctgccaatgtcaatgattcagatgcaaaggtcttatcaggcaagctttacgcaatgctgcctcgtctgcaatcagccgaaactgtattgtcaaagaaatttgcagaaatatctgacaatgattggaatcagatgctttctcaatcttcgtttgaaacaattgcttttcgtttaaacgagattcgtcgtgatggctcacaattattatcagaagctgaagaaaacattataaatacgctttctttagatggtctaaatgcttggagcagtcattatgatacgattgtagccagcatttcgattcccttcgaacaagatggacaagtagtcgaattatctgctggacaagccttcaataagatgatgggcgatccagatccaaaagtcagagaaacacttttcgcagcatgggaagaagcctggaaagaaaaggcacccctcttcacggatactttgaatcatttagatggttttagactttctgactatgaacttcatggtgtcacagattttctacaaaaaccattagagtacaatcggttgaagaaagaaacattgtctgtcatgtgggatacaatccagaaaaacaaacaaccccttgttaattacttgactagaaaagctaatcttttcggtaaagaaaaaatggaatggcaagatcaagatgcacctattattttaggcgatttgaaagaaaaaacctttagttttgacgaagcagcagcatttattatcgaaaactttaacaaattcagtccaaaaatggctaaatttgcccaatctgcttttgaaaagagctggatcgaagcagaagatcgtcctgggaaacgtcctggtggttattgtactgagttaccagaaacaaaagaatcaaggatctttatgacctacagtaattctgttaatgaggttgcgacacttgctcatgaactaggacatgctttccatagcagcacgatgtgggatttaccttctttaaatcgcgaatatgccatgaatgtcgcagaaacagcaagtacattcgcagaactgatcgtagccgatgctacattaaaagtcgcaaaaacaaaagaagaaaaaatcaatttgctagatacaaaactgcaaaatgctttagctatgttcatgaatatccattcccgattcatttttgaaaatcgattctatgaagcacggcaagaaggattagtctcagaagataagatcacagagatgatggttgaggcgcaaaaagaaggctatcaaggagctttagctacttaccatccatatttctgggctgcaaaattgcatttctttattgatgacgtaccgttttataacttcccatacacatttggctacctttttagtttgggcatctatgcttacgccaaccaaaagggagcaaattttgaagaagaatatatccatttactacgcgatactgcctcaatgacgacggaagatcttgcgaagaaacatttgaatgtcgatcttacccaaccagatttttggcaagcaggtatcgacatggtgactgaagatatccaaacgttcatggaattgacagaagaatttatctga

SEQ ID NO: 2854 - DNA (genomic), 288 bp, Enterococcus faecium; double-stranded, circular
  misc_feature (B) LOCATION 1...288
  hypothetical: NO
  anti-sense: NO
aacacagctataacaacaataatgattaatattttgtttctatttgataaatttctcattattcgcacatcacctctacattctcacatattagttcgtaatactcctttaatatcaaaatatctactggtcgtaataatattcgctatgaattcctactactcgtataagaaaggccaaatcatcagcttttacttgctgatgatttggcttgtttctatttatcgtaattgttttctaatcaccaaaattgttaacaatcggttcagatatttcccagttgattaa

SEQ ID NO: 2855 - DNA (genomic), 495 bp, Enterococcus faecium; double-stranded, circular
  misc_feature (B) LOCATION 1...495
  hypothetical: NO
  anti-sense: NO
atgaaggctatatcaaacgagaacatgcagaaatctatcagcggccttgaaggtaaggttttagcatcaggatatacgttgtttgaatcactcttactgattttattacttacaacgatcctttcttttccagttctcgcattttctgcatggaagaatgaattggcagtctatcaatttttcggccaatttgaaaaacgaatctattctacgcaaaaaatcgctattgtgaatcagatccaaacaggcttttattggaatagtgaagagaatcaaatcatttttcatgttccgaatccagataaaataaattgggaagtattagatattcctgatgagattaccttgaaacgccatgcttctattacttttgctgctagaaccgggaatgaaagttcactaaaagcttatcaattttattgggaagaaaaagagcggacgattacgtatcaattccagatagggagtggtcgctatacaaaaagaattgaataa

SEQ ID NO: 2856 - DNA (genomic), 711 bp, Enterococcus faecium; double-stranded, circular
  misc_feature (B) LOCATION 1...711
  hypothetical: NO
  anti-sense: NO
tacttttatatagtaggaagaaaggggataattaatatggaaagtaatgattcttatttagagtatgcaaaagcaaataaggataagtttatttcttatattatcaaagggaaatcccccgaagttggacgagacgcagtttttatggcagggagtcctggggctggaaaatcagaggttgccattggattagctgagaattatgataaccatgtgattattgatgcggattactttcgcacccagtttcctgattataatggaaaaaactctagtctctttcaaaaagcatcttcttggttggtagagcaggcatttagatatgtcttagatcatggctattcttttattctggatgcaacttttgcaatattaagtgctgaaaaaaatatctcgcgggcgttgaaaaaacattttcgagtgacgattttctatgtttatcaagaccctaaaatcgcttggaaatttacacaagaacgtgaaattgcagagggacgtcatgtgccgaaaaaggcatttattaacgcttttttcaaatcaagagagaacattgcaaaagtaaagagtaaacatccagatgtattgcttcatatcataataaaagattatacgaataatatttccgaagttcattatgctacggataatctagaattatttttaccactagggtatagtaggaaagatttggaggttcaattacatgactga

SEQ ID NO: 2857 - DNA (genomic), 285 bp, Enterococcus faecium; double-stranded, circular
  misc_feature (B) LOCATION 1...285
  hypothetical: NO
  anti-sense: NO
agtatttatatattttatgagttgaaatacatcatattgttgtatataataaaacaggaggggagaatcatgaaaaaagtaagtaatctcagccgatacagaaaagaaaaaggactttcccaaactgagttagccaaaaaaatgaatgttacacagcaatgtgtaagttcgtggcaaacagggagaacgattcctaaaccctatcaaatgaaaatgctttctgagatattaagtgtaccaataaatgagctgttttctgatgtatttaataaagtaaacagttag

SEQ ID NO: 2858 - DNA (genomic), 828 bp, Enterococcus faecium; double-stranded, circular
  misc_feature (B) LOCATION 1...828
  hypothetical: NO
  anti-sense: NO
gtgaattatatcttaatttatctatcatcaatacttaggagtgaatctatggaaaagccattcgtcaagtcattgactgctgtggcggtaggtgcaggtgctattgcgatctgtttgtttggataccatatcaataatcagcggcaacatcagcaacggatcaattatgcagaatctgccatcaccaatcaaaaagacaccttgacttctttatcaaaagaagtagacaagctgtatagtacaaaagaaaaaatttttctaaaccctgaaataacagaagaaacaatcacaagtttgtcaaataagctatcctctgtcaaactttcagcagatgattacgacatcaaagaatcagaattgcctaaagaagctgttgcaatccaagatgagaagaaagcaatcgtgacacagttagatagtgcagaatcaaaactgaagatccagacagctgtcaacgatttatttactaaaaatgtatcaaactggcagcaagctgtagacgatgtcatcatcaaagaaaaggtgacaagtgcagatgtcgctcgtgtacgtgaaaatatgagcttttttaaagatagtccttggaaaacggttgttatgcaatatctaggattcgctgatattcagatcgcgcaagtcacgcaactagatcagttattcgatacgatgttaaaggatggtcaagtgactgccaccgctacttacgatcaatatttgacggtgctcagtcaaatagagcagatccggaatgaaaaaataagcgcagcatacgcaacaaaagcacaaactgttgctgagcaaatgggctatagcaatataagctattga

SEQ ID NO: 2859 - DNA (genomic), 390 bp, Enterococcus faecium; double-stranded, circular
  misc_feature (B) LOCATION 1...390
  hypothetical: NO
  anti-sense: NO
atcgactatatagaaaagaggaatgagatgaagctaatcgaaacacctgtgaatagtaatttaaatattaagacattttatcctaaagtagtggaattcttttttgggaatacggctattaattattacaaattattttcgttagatcgaacacaactgctattggtagacacatatgataaaaagcaagtcgtgatgatcaatacgaagaaaaaaatcacaaggcaagaaatcgactatgcgattcatcacgttttaaaaatgacacgagaagatgtcaaagtccatgtaggagtgaaacaggagctagaacgtgccggaatacaattcaaacgtccaaataaagatattgtagtgatagaacaaaaaaatacgaaggattctatttaa

SEQ ID NO: 2860 - DNA (genomic), 495 bp, Enterococcus faecium; double-stranded, circular
  misc_feature (B) LOCATION 1...495
  hypothetical: NO
  anti-sense: NO
tttttatatattggaggagaagtaatggaatataaatttaacttgaatttgaaagaagtactccccactcagggaacaataaacataaatggtcaagataatgatgacgatatagtaataaaaaaaatagaatttattgattctgatataaatgtttttttttattctaaagaaaaattagctgattttagcaatattgctgaaatgattgaacgtttaaaagattttatgatcagtgtttgggatgtagcgatgcttgctgacgaatcaaattatacttcgagcatatacagattagaagatagtaattggatagaaatttcattagagttaaagacacttcctaattccgttaactatataattagagatataacttctgaagctcaacaattagttaattacatgcatggacacgaaagtatcccttttctcttatactccttaaaagaagtaaaaatatatcaaatactagagataggtttatttcgataa

SEQ ID NO: 2861 - DNA (genomic), 318 bp, Enterococcus faecium; double-stranded, circular
  misc_feature (B) LOCATION 1...318
  hypothetical: NO
  anti-sense: NO
gcttctctcttctatcatgctatactaatgttattgtatgtaaggaggcacatttttgtggtatctagtattataaccgccctttatctattagatgcacttattgctttggtggctattttgatcaaaccccgagatgtagcagccatttgggcatggctcttagtattgtttgcccttcttggggtgggctctgtattatatttatttttcggacgtggattaacggataagaaaaaattctatttccgacaaagtgatttgaaagaattagtaaactttcagtcttttagaggagtatcctctggactccttatc

SEQ ID NO: 2862 - DNA (genomic), 657 bp, Enterococcus faecium; double-stranded, circular
  misc_feature (B) LOCATION 1...657
  hypothetical: NO
  anti-sense: NO
agaaaatatatgaatggtggtgaaaatgtggctagaaaaaaataccccgaagcagtggagacaggacaaagaattagactggctagaattgaaaagggactctcaatggaacaacttggaggtaaattatccccaccggccagtaaaggtgccgttagtaattgggaaaatggctataatcttcccaataacaccaggcttaaacaactttcaaaggtattagatgtatccactacctatctattaaacggatcttatacattaagagatatgcatatgatgcccgaaattaagcgaaatgtgcttgaaaagcaattgaaaaaaactattgaaaaaaataactctataattgattctaatctttctaatgctatcaataacatcgaagaagataacctgactgtctcacagaagatttatttaacaaacgcaataaaatatcttaaaacaggatctcgaattgaatttcctgacgggagtaccccaattgcttatctcgcagctcttctaaatacgcttttacgatatgactcattaattaatgattcagaaaaaaatacagatgagaaaaaagagtatcaagaattttatgaaaatgatcttctaaaagagttcacagctcttgttactgagctaaataaacactattcaaaataa

SEQ ID NO: 2863 - DNA (genomic), 273 bp, Enterococcus faecium; double-stranded, circular
  misc_feature (B) LOCATION 1...273
  hypothetical: NO
  anti-sense: NO
aaaatgtatattatatttttttttgtgattatcgttcaaaaaaagaatacacgcttgcatctagtactctgcgagttacaaatcatccgatcaaataaacattcgctgattattttccgcaaaaaaagcagcatatccacgataaatggatctactgctcttacttatccttatgttttacaaggtattttcttttacacattactaatgctgtctcaatacggaacgattgtcatcgcttgttcaaattcctcttgcaaatgttgtgtttga

SEQ ID NO: 2864 - DNA (genomic), 930 bp, Enterococcus faecium; double-stranded, circular
  misc_feature (B) LOCATION 1...930
  hypothetical: NO
  anti-sense: NO
tttcggtatatgatatacattaggaggtgtcgaatggaaataaatctttttgaggctggtaatcgaataaagcaaatacgagaaaaacatggatatactatggcagacttaggtaaactggttgatgccaatagtcctagcacaattaacaattgggaaaagggaaataacttacctaatagaaagcgtcttgaaaaaattgcactattaggtggtacttctgttgaatggataaagtatggagatttttccgattatgtttatcgcttgacacaaaatatagaggaaaaaattcttaaagagtacggagagactacactgaacaactaccgtgaagctcttctagatgaacttacgattgaaaaaatcacatacgaagaagatacaaagatattagcagctgccgaaaaaatcaatacacaaaatatttttcaggaggtgaagtacatgtattctcctgatgaagattatcgaaatatagaagtcaaaccagatttaggactgactgatgacaacaaaaatattaaaatgattggacaacgtataaggaaaataagaaaaaaagagaatattacattagaagaattcggcaaactattctctcctacagctgataaagctgttataagcaactgggaaaatggtaaaaaccttcctaactcagaaagaattaaaaagattgcagaaattggcggagtttctgaactttatcttatgacgggtgtcgattcaagcgtagcagaatcaatgtattttctatctgaagtagcattggatgctttggaacgtctgtcaattgaggaagtcaatagaataattgaaagcttcgccggttatcttaatgtgatttcaaaaattgatgatccagataagcgagaaatatctctcaatgctatttgtcaactatcacttctcgataaaatgggttga

SEQ ID NO: 2865 - DNA (genomic), 759 bp, Enterococcus faecium; double-stranded, circular
  misc_feature (B) LOCATION 1...759
  hypothetical: NO
  anti-sense: NO
atcaggtatataccagttataatagaagaaacgaaaggacgggtgtacgttatgtcgaatcaattacctgtatatatacagattcatgaccaattaaaaaatgaaatcgaacaaggtatatggaaagtcggagaccgtcttccttcagaaagagaattagcagtgaaattcaatgtcagccgtatgacgttgagacaagcaattcaaaacttggcagatgaaggaatcttagaaagaaagatcggttcgggtacatatgttgcgcgagaaaaagtacaagaaaaaatgtctggtgcaacaagttttacagaaattatggaatcgcaaaatcgagtaccgtctagtcggacaatctcttatttcttgacttcgccaagctcaagtgaaatggaaaaactaaacttgagtaaagatgacacgatcttgcgaatggaacgtattcgtttcgcagatgatgtccctatttgttttgaagttgccagtgtgccacaaaagctgatcgatggctacagcaaagcagagattactgaatcgttgtatcgcacgctagaagaaaaaggcgggaaaaagatcggtccagcgaatcaaacgattactgctgtgttggcttctgagaaaattgctgactatttagaggtaaaacgaggagatgcagttcttcgtttgcgccagatttcttattttgaagacggtacgccgtttgagtatgtgcgtacgcaatacgtaggaaatcgttttgagttttatttggaaaaataa

SEQ ID NO: 2866 - DNA (genomic), 189 bp, Enterococcus faecium; double-stranded, circular
  misc_feature (B) LOCATION 1...189
  hypothetical: NO
  anti-sense: NO
tataatcatatgccaatggttatacgcctaaaaaagcagcgctatacctgtaaaaactgtcgaagccattggaacgctcaaagttattttatccgtccaaggcactcgatttcaaatcatgtcagacataaaatcacttctttactgactgaaaaagtgtcgttattttttatttcgaaaagttgttag

SEQ ID NO: 2867 - DNA (genomic), 618 bp, Enterococcus faecium; double-stranded, circular
  misc_feature (B) LOCATION 1...618
  hypothetical: NO
  anti-sense: NO
ctgagtcatatgttatttggcataatggagacgaggagggatagaaaaatgttagataaaacgttaccttacgcagaaatctggatgacaagaccacttcaacaaaatgttccaatcacgcctttagcggaaggttttgaatttcgattttatcaaaaagaagatgaatctgcttgggcggagattgagacttccgttggggaatttcaaacgacagatgaagcacttgagtattttcaacaaaactttgctccttatcctgaagaacttgaaagaaggatgttttttgtagagacaaaaaaaggagaaaaagtagcaacctgtaccgcttggcgaaaaaaatcaagagagcaagtgtatccggtttttcattggttagcagtgaaaccagattaccaaggaaaagggctcgcaaaagcattgactgccagagtcttgcaagaatttcctaccctccatacggacggaccaatctatcttcacacacagacatggagccatcaggcgattgctctttataaaaaaatgggttttacttttattgctgaaaatctagacggcacacctaatccagattatgaaaaagttatgcaggttttaagtaaattagataaataa

SEQ ID NO: 2868 - DNA (genomic), 918 bp, Enterococcus faecium; double-stranded, circular
  misc_feature (B) LOCATION 1...918
  hypothetical: NO
  anti-sense: NO
ggactacatatgcgttcatcaaaatatactgaacattatacagatacttttataacattcaaggaaattatgagaactgtttctaacatataccacaattgtgtaccagataagattaaaaaccgaagaaatactgatcaactgaagcaacgcgatacagtgattattgcttgtgttatatggggcataattaatggctatactagccaaagagccacgtatagagcggtttgttccgtcttatttcctaatggtgactttcctagtaggagtcgattcactcgcttaagttcaaacttagcttacactatcaagattattcgatactttttcatcaagaagctcaccaaaggtgaactagtcggaattatagatagttttcctagtccattatgtaaaccagttagaaatagacaagcaaaactattgaatcaaatagccaaagttggctataactcaacaaaaaaatcttatttttatggtcttaaaattcatatgatcgttactaagactggctttccgattacttactcaatcgcgaatccaggtgtccctgacgtgaaagtgttagagactttatcggaagaagcgaatcttcccaatatcctaggggacaaaggatatattagccataaaatccatgaaaagcttgcccttaagggcattactatatccgttccgccacgtaaaaacatggataaatcagaaaaactagaccacagcttacttggaaaacaaagaaaaacagttgagactgttttttcttccttagaaaaattaggttgtcaaaatttcaactcacgttctgttaaatggctagagagtagatttgaaagcatattactggcttacagtgttctattaagtcgagcacaacgacgttttgaaggaactttgagatattctttaggatattaa

SEQ ID NO: 2869 - DNA (genomic), 705 bp, Enterococcus faecium; double-stranded, circular
  misc_feature (B) LOCATION 1...705
  hypothetical: NO
  anti-sense: NO
ggactacatatgcgttcatcaaaatatactgaacattttgagttagccaatcctgttactaaagtcgttgatatccccgattatgaaatgtacagtcaaacaatcgatagcttaaataagcgttttggcaatcgtgttttaaaaggcatagaaatcggttacatcgcttctgaaaaggatcggatcatcgactatttagccgataaagattacgatttaaaattactcagtgtgcatcataatggtcaatttgattatttagatgacgaagtcaaagatatggatcctgctattgtgattcctcagtattttgcacaactttcagaagcactagttgttatagaagcagatgtctttgctcattttgactatggttttcgggtatttggtctatccgttgctgaatttaaacaatatgaagcgcagtttttaccgattctagatcaagtaatcaaaaataaattggcattcgaattaaatgctaagagcgcttacttgtatgacaatttagcgttatatgaatatgtcatcgatttatatctttcacgtggtggtaccttgtttagtgttggatcagatgggcattaccttgaacatttccgtttccatttcgatgatctttttgctctgttaaaagcaaaaggtgtgacggaattagcgatttatcaaaaaagaaagcgaattatggttccattaccagtctaa

SEQ ID NO: 2870 - DNA (genomic), 918 bp, Enterococcus faecium; double-stranded, circular
  misc_feature (B) LOCATION 1...918
  hypothetical: NO
  anti-sense: NO
ggactacatatgcgttcatcaaaatatactgaacattatacagatacttttataacattcaaggaaattatgagaactgtttctaacatataccacaattgtgtaccagataagattaaaaaccgaagaaatactgatcaactgaagcaacgcgatacagtgattattgcttgtgttatatggggcataattaatggctatactagccaaagagccacgtatagagcggtttgttacgtcttatttcctaatggtgactttcctagtaggagtcgattcactcgcttaagttcaaacttagcttacactatcaagattattcgatactttttcatcaagaagctcaccaaaggtgaactagtcggaattatagatagttttcctagtccattatgtaaaccagttagaaatagacaagcaaaactattgaatcaaatagccaaagttggctataactcaacaaaaaaatcttatttttatggtcttaaaattcatatgatcgttactaagactggctttccgattacttactcaatcacgaatccaggtgtccatgacgtgaaagtgttagagactttatcggaagaagcgaatcttcccaatatcctaggggacaaaggatatattagccataaaatccatgaaaagcttgcccttaagggcattactatatccgttccgccacgtaaaaacatggataaatcagaaaaactagaccacagcttacttggaaaacaaagaaaaacagttgagactgttttttcttccttagaaaaattaggttgtcaaaatttcaactcacgttctgttaaagggctagagagtagatttgaaagcatattactggcttacagtgttctattaagtcgagcacaacgacgttttgaaggaactttgagatattctttaggatattaa

SEQ ID NO: 2871 - DNA (genomic), 918 bp, Enterococcus faecium; double-stranded, circular
  misc_feature (B) LOCATION 1...918
  hypothetical: NO
  anti-sense: NO
ggactacatatgcgttcatcaaaatatactgaacattatacagatacttttataacattcaaggaaattatgagaactgtttctaacatataccacaattgtgtaccagataagattaaaaaccgaagaaatactgatcaactgaagcaacgcgatacagtgattattgcttgtgttatatggggcataattaatggctatactagccaaagagccacgtatagagcggtttgttccgtcttatttcctaatggtgactttcctagtaggagtcgattcactcgcttaagttcaaacttagcttacactatcaagattattcgatactttttcatcaagaagctcaccaaaggtgaactagtcggaattatagatagttttcctagtccattatgtaaaccagttagaaatagacaagcaaaactattgaatcaaatagccaaagttggctataactcaacaaaaaaatcttatttttatggtcttaaaattcatatgatcgttactaagactggctttccggttacttactcaatcacgaatccaggtgtccatgacgtgaaagtgttagagactttatcggaagaagcgaatcttcccaatatcctaggggacaaaggatatattagccataaaatccatgaaaagcttgcccttaagggcattactatatccgttccgccacgtaaaaacatggataaatcagaaaaactagaccacagcttacttggaaaacaaagaaaaacagttgagactgttttttcttccttagaaaaattaggttgtcaaaatttcaactcacgttctgttaaagggctagagagtagatttgaaagcatattactggcttacagtgttctattaagtcgagcacaacgacgttttgaaggaactttgagatattctttaggatattaa

SEQ ID NO: 2872 - DNA (genomic), 198 bp, Enterococcus faecium; double-stranded, circular
  misc_feature (B) LOCATION 1...198
  hypothetical: NO
  anti-sense: NO
ggactacatatgcgttcatcaaaatatactgaacattatacagatacttttataacattcaaggaaattatgagaactgtttctaacatataccacaattgtgtaccagataagattaaaaaccgaagaaatactgatcaactgaagcaccgcgatacactgttttttgcatgtcgtcaaatacttgcccaaaatgtt

SEQ ID NO: 2873 - DNA (genomic), 918 bp, Enterococcus faecium; double-stranded, circular
  misc_feature (B) LOCATION 1...918
  hypothetical: NO
  anti-sense: NO
ggactacatatgcgttcatcaaaatatactgaacattatacagatacttttataacattcaaggaaattatgagaactgtttctaacatataccacaattgtgtaccagataagattaaaaatcgaagaaatactgatcaactgaagcaacgcgatacagtgattattgcttgtgttatatggggcataattaatggctatactagccaaagagccacgtatagagcggtttgttccgtcttatttcctaatggtgactttcctagtaggagtcgattcactcgcttaagttcaaacttagcttacactatcaagattattcgatacttttttatcaagaagctcaccaaaggtgaactagtcggaattatagatagttttcctagtccattatgtaaaccagttagaaatagacaagcaaaactattgaatcaaatagccaaagttggctataactcaacaaaaaaatcttatttttatggtcttaaaattcatatgatcgttactaagactggctttccggttacttactcaatcacgaatccaggtgtccatgacgtgaaagtgttagagactttatcggaagaagcgaatcttcccaatatcctaggggacaaaggatatattagccataaaatccatgaaaagcttgcccttaagggcattactatatccgttccgccacgtaaaaacatggataaatcagaaaaactagaccacagcttacttggaaaacaaagaaaaacagttgagactgttttttcttccttagaaaaattaggttgtcaaaatttcaactcacgttctgttaaagggctagagagtagatttgaaagcatattactggcttacagtgttctattaagtcgagcacaacgacgttttgaaggaactttgagatattctttaggatattaa

SEQ ID NO: 2874 - DNA (genomic), 375 bp, Enterococcus faecium; double-stranded, circular
  misc_feature (B) LOCATION 1...375
  hypothetical: NO
  anti-sense: NO
ggactacatatgcgttcatcaaaatatactgaacattatacagatacttttataacattcaaggaaattatgagaactgtttctaacatataccacaattgtgtaccagataagattaaaaaccgaagaaatactgatcaactgaagcaacgcgatacagtgattattgcttgtgttatatggggcataattaatggctatactagccaaagaaccacgtatagagcggtttgttccgtcttatttcctaatggtgactttcctagtaggagtcgattcactcgcttaagttcaaacttagcttacactatcaagattattcgatactttttcatcaagaagctcaccaaaggtgaactattcggaattatatat

SEQ ID NO: 2875 - DNA (genomic), 918 bp, Enterococcus faecium; double-stranded, circular
  misc_feature (B) LOCATION 1...918
  hypothetical: NO
  anti-sense: NO
ggactacatatgcgttcatcaaaatatactgaacattatacagatacttttataacattcaaggaaattatgagaactgtttctaacatataccacaattgtgtaccagataagattaaaaaccgaagaaatactgatcaactgaagcaacgcgatacagtgattattgcttgtgttatatggggcataattaatggctatactagccaaagagccacgtatagagcggtttgttccgtcttatttcctaatggtgactttcctagtaggagtcgattcactcgcttaagttcaaacttagcttacactatcaagattattcgatactttttcatcaagaagctcaccaaaggtgaactagtcggaattatagatagttttcctagtccattatgtaaaccagttagaaatagacaagcaaaactattgaatcaaatagccaaagttggctataactcaacaaaaaaatcttatttttatggtcttaaaattcatatgatcgttactaagactggctttccgattacttactcaatcacgaatccaggtgtccatgacgtgaaagtgttagagactttatcggaagaagcgaatcttcccaatatcctaggggacaaaggatatattagccataaaatccatgaaaagcttgcccttaagggcattactatatccgttccgccacgtaaaaacatggataaatcagaaaaactagaccacagcttacttggaaaacaaagaaaaacagttgagactgttttttcttccttagaaaaattaggttgtcaaaatttcaactcacgttctgttaaagggctagagagtagatttgaaagcatattactggcttacagtgttctattaagtcgagcacaacgacgttttgaaggaactttgagatattctttaggatattaa

SEQ ID NO: 2876 - DNA (genomic), 201 bp, Enterococcus faecium; double-stranded, circular
  misc_feature (B) LOCATION 1...201
  hypothetical: NO
  anti-sense: NO
ggactacatatgcgttcatcaaaatatactgaacattatacagatacttttataacatacaaggaaattatgagaactgtttctaacatataccacaattgtgtaccatataatattaagaaccgaagaaatactgatcaactgaagcaacacgatacagtgattattgcttgtgttatatggggcataattaatggataa

SEQ ID NO: 2877 - DNA (genomic), 918 bp, Enterococcus faecium; double-stranded, circular
  misc_feature (B) LOCATION 1...918
  hypothetical: NO
  anti-sense: NO
ggactacatatgcgttcatcaaaatatactgaacattatacagatacttttataacattcaaggaaattatgagaactgtttctaacatataccacaattgtgtaccagataagattaaaaaccgaagaaatactgatcaactgaagcaacgcgatacagtgattattgcttgtgttatatggggcataattaatggctatactagccaaagagccacgtatagagcggtttgttccgtcttatttcctaatggtgactttcctagtaggagtcgattcactcgcttaagttcaaacttagcttacactatcaagattattcgatactttttcatcaagaagctcaccaaaggtgaactagtcggaattatagatagttttcctagtccattatgtaaaccagttagaaatagacaagcaaaactattgaatcaaatagccaaagttggctataactcaacaaaaaaatcttatttttatggtcttaaaattcatatgatcgttactaagactggctttccgattacttactcaatcacgaatccaggtgtccatgacgtgaaagtgttagagactttatcggaagaagcgaatcttcccaatatcctaggggacaaaggatatattagccataaaatccatgaaaagcttgcccttatgggcattactatatccattccgccacgtaaaaacatggataaatcagaaaaactagaccacagcttacttggaaaacaaagaaaaacagttgggactgttttttcttccttagaaaaattaggttgtcaaaatttcaactcacgttctgttaaagggctagagagtagatttgaaagcatattactggcttacagtgttctattaagtcgagcacaacgacgttttgaaggaactttgagatattctttaggatattaa

SEQ ID NO: 2878 - DNA (genomic), 2010 bp, Enterococcus faecium; double-stranded, circular
  misc_feature (B) LOCATION 1...2010
  hypothetical: NO
  anti-sense: NO
acaatgatttttcaaacgaacagtttaagactaggagaaaaagagtataataggaaaatgtttgaaaggaaaggaaggggaaaaatgaaaaaaagggcaagtttactagtcctagttgctttgttgttcaatatcttttcgtatggtgtggccgtttcagcggaaacatacattcctaaagaccctgggaatatttataatgatctaactggtaactatggcttgttaggaattgctagtcaattccacgtatttgctaaaaataagacaactgtgaatgcacatacagacggaaatatagcaacacatgaacttgatgcaaaaaataattttggtacagagcttcatgaaggtttattgaaccaagaaataaattatatacaaaaaactgattctttcgctaattcttcaggcatacctacaggtagcacaagaatgaataaatttgtcgttggcagtaacgtggatgtagcacttcaagatggtcatcctacagtcaatggatccaggcttgatcacttaactccagatgatttttataaagatcgtgctgggcatgaatatattgatttcgagcaggaatttgctaaattgaatgtagcagcaaatgatcttgcaacgatcactccagctaaaacatatactgctgcagattttccagacatgaacaatcggacaatcgatttaactgatttatcagataccgggtttttattggtaaatatcgatgcagaagtgttaacgatgaatacgccacttcaaatcattaatccaaatgatcaagtagttgtatttaatgtcatcaacagttcttctgcattgaacgtacagtcaccaatcaaatacaatgatcgttcaaatcatgaaacagaagatttttcggatgcgaatatctcttggaattttggaaatgagatgactgatttgacaatcagtgctccttttcaaggaacaatccttgcgcctaatgctactatccgcattactcaaaaccaagacggaacgattataggaacaaatgtgattttagatgcagctaccaatcgttgggatcctaacgaaatatttatcagcgacaatggtacagatacgacagacacaagcgacagtacagatacatctaccacaagtgatagctcagattcatcaacttcaagcgacagtacagatactacctctaccacaagtgatagcacggacacatcagcttcaagtgacagtacagatactacctctaccacaagtgacagcacggacacgtcagcttcaagcgacagtacagatactacctctaccacaagtgatagcacggatacatcagcttcaagcgacagtacagatactacctctaccacaagtgatagcacggacacatcagcttcaagtgacagtacagatactacctctaccacaagtgacagcacggacacgtcagcttcaagcgacagtacagatactacctctaccacaagtgatagcacggacacatcagcttcaagtgacagtacagatactacctctaccacaagtgatagcacggacacgtcagcttcaagcgacagtacggatacatctaccacaacaagtgatagcacggacacgtcagcttcaagtgacagtacagatactacctctaccacaagtgatagctcagattcatctaccactacaagtgatagcacggacacgtcagcttcaagtgacagtacagatacatcctctaccacaagtgatagctcagattcatcaacttcaagcgatagtacagacacgtcgtctaccacaagcgatacacgtcatgcaagtgtctccttctcaaaaacaagttcggataacaggacgaactttaacttaactaataaaacaagcaatgacaatggaaacaaatcaaaaagagcacttcctaaaactggaagtcaatcgaataattggataacactcgcaggcgttatattacttgtaatcggtttaagaatcacttttatgagttataagaaatcgaaaaggtaa

SEQ ID NO: 2879 - DNA (genomic), 270 bp, Enterococcus faecium; double-stranded, circular
  misc_feature (B) LOCATION 1...270
  hypothetical: NO
  anti-sense: NO
caaattaatattgtgaaaataaatactaagcgtataattttagttatcagcgagtggtccgctgaaataaatcaaaaggtggtgaaaaatttgtactttgttataagagaagcaactaatggccaatattacttcgttattaagtccaataacaatgaagtagtagcaactagcgaaacatacttgactaaatattccgctgaacaaaccattaattctataaaaaacggaatcaccgaagactctcaagttatcgatatgactaaataa

SEQ ID NO: 2880 - DNA (genomic), 1353 bp, Enterococcus faecium; double-stranded, circular
  misc_feature (B) LOCATION 1...1353
  hypothetical: NO
  anti-sense: NO
gaggataatatcatgaaaaaatttgtgacagaacaacatcatgaacaagcattagaatcattgagcgaattgatccgaattccttccgtactagatgaagcagattcaggacaaggacatcccttcggtaaaaaagtgattgaagctttggataaagtattggaaatcagtgaaaagctaggatttagaacatttaaagatccagaaggctattacggttattcagagattggctctggagatgaattattcggtatcttgtgtcatatggacgttgttccagcaggggacgaaaataattgggaaacaaaaccattcgatccaactataaaagacggctggttagttggtcgcggatcccaagatgacaaaggtccttctattgcggcaatgtatgccgtcaaagctttgattgatgctggcgtggaattcaagacacgtattcgttttatctttggtacagatgaagaaaatttatggcgttgtttagaaaaatataacgaaaaagaagaaggaattacgcaaggatttgcgccagatgctgaatttcctttaatttatgcagaaaaaggcttattgcaagcttacttgacaggaccaggaacgaacgagttttctgtaaaagctggaggagcgttgaatgttgttcctgatgcagctccttactctggagaaaagctttctgaagtaaaagaagcattgaaaaaacacgaattcgatttcgaagaacaaggtgaaggcatcgtcgttcttggtaaaagtatccacgcgaaagatgcagcacaaggagtgaatgctatttctcgtctggcaattgctctttcagaagtatttgattttggcccaatcaatttcttaggaaaattagttcaagaaaatgcaactggtgaagctgtcgtgggcaaaacagaagatgaacaatccggcgagctaacgatgaactttgcaagtttggaaatcacaccagaacaaacaaaaatcggtgtagatatgagaatccctgttacattcaagaaagatgatttagtagctaaattaactaaaacagcagaaaaatatgggttgacttatgaagaatttgacttccttgattcattatacgtgccactagacagtgagttagtgaaaaatctattggggacatatcgcgatattactggagacatgactgaaccgtttgtatcaggcggcgctacttttgctcgtacgatgaaccagtgtgtggcattcggtgcgatgttccctgatactcctgactttatgcaccaggcgaatgaacgatgggaattaagtagtatgtataaagcaatggaaatttatgcagaagctgtgtatcgtttatgtgctaaataa

SEQ ID NO: 2881 - DNA (genomic), 408 bp, Enterococcus faecium; double-stranded, circular
  misc_feature (B) LOCATION 1...408
  hypothetical: NO
  anti-sense: NO
atgctcaatattatttcaacaaacaaagcaccgaactttcaatatacagatgaaatggatcggtttctaatgaacacgctggcatttagtgtgggattggtaacagaagattattccacatttgatccagaagtattaaagataatggaagaagaacctgattggctgcaggagtcagtagcgtggtgtcaatcgctagtagtgggatcattggtagatagtggcaactatgatgatacaggtgagctaatggatgaatttaattgtctgcttaacctatatgatcgagcgagacaacgagagcttacatcgaatgaggataatttgtttttaaacatccatgataagttcttggctttgctactaacagatgatgaattgataactaatttattggaggtagaataa

SEQ ID NO: 2882 - DNA (genomic), 687 bp, Enterococcus faecium; double-stranded, circular
  misc_feature (B) LOCATION 1...687
  hypothetical: NO
  anti-sense: NO
atgagcaatattctaatcattgaagatgaaaagaacttggcacgatttgtcgagctagagttgaagcatgaagggtataacgcagaagtccactacaacggccgaactggtttagatgcggcattaaataatgagtgggatgccatattgttggatctgatgctcccagaattgaacggtttagaagtctgcagacgtgtacgccaagtcaaaaatacaccaatcattatgatgactgcaagagattctgtgatcgatcgtgtatctggacttgaccacggagcagatgactacatcgtcaaaccatttgctatcgaagaattattagcacgtcttcgtgcattgttgcgtcgaatcgatattgaaggcgataaaaatgtggctaaacaaactactattacttatcgcgatttgactatcgaaaaagaaaaccgtgtcgtacgtcgcggaaatgaagtaattgaactaacaaaaagagaatacgagttgctgcttactttaatggaaaacgtgaacgtggtattagcacgtgacgttttactaaataaagtgtggggatacgaaacagaagttgaaacaaacgtagtggacgtatatattcgttatcttcgcaacaaaattgacgttcccggggaggaaagctatatccaaactgtacgcggaacaggttatgtgatgcgctcgtga

SEQ ID NO: 2883 - DNA (genomic), 621 bp, Enterococcus faecium; double-stranded, circular
  misc_feature (B) LOCATION 1...621
  hypothetical: NO
  anti-sense: NO
gtgttaaatatgttagttggctatgcacgagtcagttcagatgatcaaaatttggaaagacagcttgaagaatttagaaaaattggtgtcgaaaaagtatttgctgagaaaaaatctggacgtaacacagtagaacggccagagttcaataaaatgttgtcatttgtcagagaaggggatacgcttgtttttgagtcgcttgaacgcttaggaagaaattctgatgaaatactagaaacagtatcttttatagataaaaatggtatgggcttaatggttttgaatttaccaattttagatacaaaatttggtgatccaaacttagaaaaacttgttagaagcttagtaattaacattttttcttggacggctcaaaatgagagggaggaaattaagagaaaacaaaaacaaggaatagcaattgcgaagaagaaaggagtctataaaggaaaaccctacgaatattcttctactgcaaagaatccacaaaagaggtttatctataatgaaatagtaagaatgcttggagaaggtgttccgattaagcgaattgcagaaaaaacaggaacaaatagaaatttagtctatagaataaagaaaagaataagtgaatctgattga

SEQ ID NO: 2884 - DNA (genomic), 2367 bp, Enterococcus faecium; double-stranded, circular
  misc_feature (B) LOCATION 1...2367
  hypothetical: NO
  anti-sense: NO
ggaataaatatgacaaaagaaacgataaaagagaaaattctctttttcatggaaagcagtcgcaaacgcagtttttctatggaagaaatcgctgaaggtttagggttccaaaaaagcgatgattttaaattactagtacaaacgattgctcaaatggaaagagaacagagtatagttttcaataaaaaaggaaaagtgaaacttcctttaaaaccaatcttgatcgaaggaacatttcgagcaaatgaacgaggatttggatttgtaacgattgatcccgaagaagatgacatctatatcccaaaagaaacgactggttttgcaatggatggagacaccgtagcaatcgatatcatgaagcgagcaaatacagatatggatcgcggagcagaggggaaagtagtcgagattcgagaccgggcgactactcagttagcaggggaattcgttgcttattcagaagaagaaatacaagaaacggatctttacggcgttgttatcccgaaagatagaaagctcaaccaatttaaagtatatgcagcagcagagggagttcgtccagttgacggaagtattgtgctgatcgaactgacccattaccctgaaaaagggtatgcgactagtttagaagggataatcaagcaagtgattggtcataagaatgaccctggcatggatatcctctcaattgtcgtggctaatggtatccctacgaaatttcctgatgatgtattgtctgaagcagatgaagttccagatcaaatcagcgaaaaggatataactggacgtagagatttaagaaatcagctcattgttacgattgatggagaagatgcaaaagatctagatgatgcagttacggttaaaaaattagataacggtaattattttcttggagtacacattgcagatgtttcttactatgtgacacaaggcagtcaattggacagagaagcatatgaaagagggacaagtgtatatttgactgatcgagtgattccgatgatcccgcaacgtttatcgaatggtatctgttcactgaatccccatgttccaaggctgaccatgagttgcgaaatggagattgatccaaatggacaagtagtctctcatgatattttcccaagtgtgatccaaacaacagaacggatgacctacacagctgtcaatcaaatcttagaagatcaagacgaagaaacgatgcaacgctatgctcagctcgtacctatgttccaagaaatgggtgaattgcatcgaatccttgaaacgatgcgaatcaaacgtggcgcgatttcttttgaggatcgcgaagcaaaaatccttgttgatgctgaaggacacccaaatgatatccagctaagaagcagaggaattggtgaacgcttgatcgaatctttcatgcttgcggccaatgaaacggtagctgaacattataataaattaaatctgccgtttatttaccgaatccatgaacagccaaaagaagaaaaaatgcagcgcttctttgattttgcttcagctttgggcattctggtccgaggaacgaaaggaacgatcacaccaaaagatttacagcatgtgatcgaaggagtagaagacaaaccagaagctgcagttatcaatactatgttgctaagaagcatgcaacaagcacgctattcagaagacaattttgggcattatggcttagcggcagattactacacacactttacatctcctattcgacgctatcccgatctaatcgtccatcgtctgatccgttcttacagtgaagataaaagtgaaagcaatcaaagttcgtgggctacggaacttcctgaaattgcagatcatagttctaagatggaacgtcgtgcagtagaaacagaacgtgaagtagattccatgaagaaagcagaattcatgatggacaaagtgggggaagaattcgatgggatcatcagctctgttgtgaaattcggcctgtttatcgaactgccgaatacagtagagggattgatccatatcaatgaattgaaacaggactacttccattttgttgaaaatcatttagctcttgtaggtgaaagaactggtctgacttttaaaatcggacagaaagtgcgagtaaaagtagtcaaagctgatccagatgaacgagcagtagattttgaacttgtttccgcagaagaggttacagcgttggaacggccaaaaacacgaaatggaaaatcaggaaaacgcgaaggaaaacaagcaggaaaacgcccagaaagaaatggcaagaagaacaaacgatatagcgatagtaagcaaacgttcggtaagaaaaaagggaagaagccattttacaaaggtgttaaaaagaagaaaaagaaaaaataa

SEQ ID NO: 2885 - DNA (genomic), 1008 bp, Enterococcus faecium; double-stranded, circular
  misc_feature (B) LOCATION 1...1008
  hypothetical: NO
  anti-sense: NO
atggcaaatatcgcagaattattttcacaacgtaacgtcttagactatgtaaacaatcgtcaagctccccctttgttgggtgaaacactttttccagcacgaaaggtgcaaggacttgaatttgacattctaaaagcaggtactcgtattccaacgatcgcaagcgtacatgcatttgatactgaggcagaaattgcatctcgtgtagcttctcgcagcgctcaggaattagctttcatcaaacgcaaaattcagttgaaggaaaaagacttgattgcattgcgcaatcctcgtactgctgaagaacaggctttcttggaaaatgaagtatataatgatgtattttcaatggtttcttctgttaatgcgcgtgttgaaaaaatgcgcatggaagtattggcaaacggaaccgtaacattagatgaaaacggattggacttagttgttgattacggtgttccgtcagaacacaaagctaccgttgatttcgctgcttcttctaccgatgttatcggattattaactacatgggcaggtacgctagataccacaccaactcggatcttaacttcgactaaagttcgtaatgctattttgcaaaatgctggtatcaaagcttacttcaaagatgctggattgctgccaacagctggaacattaaatcagttgttacaacaatttggtttgccaataatcgcaacgtacgatgctaagtactataaagaaaatgctcaaggcgtgttggtcaaagagcgctacttcccagaaaataaacttgtcatgttcggtgatgaaaatccgggcgaatctattttcggtgtaacgccagaagaatctcggctattatctggtggtactaatgattatcaagttggaaacatttttgcaatggtttatgaatcaaatcttgaccctgttggaacatggacaaaagcatctggtactgcacttcctagcttccccgaagcggacaacgtgttccaagcaactgtattagcagaagggtag

SEQ ID NO: 2886 - DNA (genomic), 324 bp, Enterococcus faecium; double-stranded, circular
  misc_feature (B) LOCATION 1...324
  hypothetical: NO
  anti-sense: NO
aataaaaatattcctgctaatttggaatcgtttccttcttttggtataataatacctgaaattcttttgagaggagttgttcgtgaagtgaaaactactatgaaggatgttgctgcgttagcaggagttggtgtgggtacggtatctagagtaataaatggagtaaaggtgaaagaggttaccaaagaaaaagtaatggctgcaattagtgagcttaattatgagcctgatgaatatgccagaggtatgaaaacgaatagtagcaatacaatagctgttattttacacacgatgtggcatcccttcttttctgagtttgcgtaa

SEQ ID NO: 2887 - DNA (genomic), 354 bp, Enterococcus faecium; double-stranded, circular
  misc_feature (B) LOCATION 1...354
  hypothetical: NO
  anti-sense: NO
caaaaaaatatgatttgccggttcggagcaactttgaacgaaaagatgaagttcgtcatgtcgattattttgacccttgttttgatgttcctagggagaaaactgatgaannaaaaacgacaaatcaatacgagtgtggaagaatatttggcaagtttactcatgatattgagagaagataaaacgatcgaagtcatgtgtcacgcagcgtatttggatttgcaggaattgttaaatggttcaagttttgtgtatcctcgtacccaccaagtcgaatttttaattcattcagcatttgctcaaaaagtgaaaaatgatcctttgattgagttagtaacatatgaggatatttaa

SEQ ID NO: 2888 - DNA (genomic), 978 bp, Enterococcus faecium; double-stranded, circular
  misc_feature (B) LOCATION 1...978
  hypothetical: NO
  anti-sense: NO
cgaagaaatattatccaggaaaggggcaataagatggacttttttacaaatcctgatattttattaggcgataaattactggagatcctttatatcgtgatgggactcgtattgatttacactggagtaagaaatttaacaaataaaaccaatcctcatcgttatgggtcagcctttttctggacggtcttaggggtagttattgcaggaggaagatggcttccggcaatcgtgaacggtggcttgatctttgcgatgaccataccagcaattgctaagaaagtcagcaaaggagaaagccggcttccatcaaaagaatatatggaaaaaatgtcagacaaactaggaatgaaaatttttattccagctttgagtatcggtgtctttgcgatcttgtttgctctatttaccaatttaggtgctttantcggcgtgggcgtcggtgtttttgcagccatgctaatcttgatgttcttttctcgagataatcgaccaagtacatttttagatgatgcagcagatatgctgggcacagtagggccgttaagcatgttgccaatgcttttagcttctctaggtgcggtatttacaagcgctggagttgggacagtgatttccaatgcagtaggtacgatcgttccagaaggaaatgtgaacatcggcatcatcatttacgctcttggcatggtgatatttacggtaatcatggggaatgcatttgcggccatcaccgtgatgacggttgggatcggtgcaccattcgtatttagtcatggagcgaatccagcgttaataggaatggttgcattgacttgcggtttttgtgggaccctgctgacaccgatggctgctaacttcaatatcgtgcctgtagcgatgctggagatgaaagacaaatacggagtgatcaaaaaccagttgtttattgcgttatttatgctagttttccaaattgcttatatgattctatttaaataa

SEQ ID NO: 2889 - DNA (genomic), 216 bp, Enterococcus faecium; double-stranded, circular
  misc_feature (B) LOCATION 1...216
  hypothetical: NO
  anti-sense: NO
ggaggaaatatagtcatgccaaaacaaaaaacacaccgcggatcagcaaaacgtttcaaacgtactggtaaaggcggattgaaacgcttccgcgcgtttacaagtcaccgtttccacggcaaaacaaaaaaacaacgccgtcaattgcgtaaagcaagcatggtttctaatggcgacttcaaacgtattcgccaacaactagcaaaaatgaaataa

SEQ ID NO: 2890 - DNA (genomic), 246 bp, Enterococcus faecium; double-stranded, circular
  misc_feature (B) LOCATION 1...246
  hypothetical: NO
  anti-sense: NO
accatgaatatgtggaatcccaagtccatagaatcaccccaatcgtggatcgagtatgtggcggagatgcttttgcaggtggcgtgctccatgggattttatccaatatgtctccgcaagaaatcattgattttgctacgggcagcttctgccttgaagcatacgatccatggggactgcaaccaatttagtcaagatgaagtcgcacaatttttagcatgcggctctggaaaaatcattcgatag

SEQ ID NO: 2891 - DNA (genomic), 600 bp, Enterococcus faecium; double-stranded, circular
  misc_feature (B) LOCATION 1...600
  hypothetical: NO
  anti-sense: NO
ataatgaatattgctgcctctcgaaaactgataaacttcatttccattattggattaggtctatcgatcgcgctgacgatttattttattaatttaggtgttttcaaagatttgaatgctttaagaggattagtaggtgattcgatcattttaggtccggtcatttttatcttcatccaaatcttgcaagtggttattccaatcattcctggaggaatcagcactgcagcgggtgttctgatatttggtccttatgctggctttatttacaattatgttggaatctgtattggttcgattattatctttcttctaggacgacgttacggaaaaccattcattctttccatgatcagcgataagacctataacaaatatattggctggttagacaatcaaaaccgctttgagaagctgtttgctctagctatttttcttcctgttgctccggacgatgcgttatgtttgatggctggattgacaaacatttcaatgaaacgatatacactgattattttgatagctaaaccactatcgattttcttatacagtatggctttgatttatggaggacaatatctaagtggtcttcttggttaa

SEQ ID NO: 2892 - DNA (genomic), 906 bp, Enterococcus faecium; double-stranded, circular
  misc_feature (B) LOCATION 1...906
  hypothetical: NO
  anti-sense: NO
gcaatgaatattcagcagatgaaatacgtggtcgctgtagcaaacaatggtagtttcagagaagcggcaaagaaaatgtttgtctcccagccaagtctttcagctggtatcaaagaattagaaaccgagttagggatcacgctgtttactcgaacgaatcgaggggcatatttaacagaagaagggcaagacttcttaaatcgtgccgagaaaatattggtccagcttgatacattagaaactcactatctaacgagtgaaaagagagacaatttttcgatcgctgcccagcattatgatttcttaggtcctttgaccgcacagctactcgaggaattcaaagacgagatcaaacaatttcggatcatggagacgacaacagcgagagtgatcgaagaagtcaaagagcagcacagtgagatcggcattatttatatgaatgagcataatcaagctggtatcagaagatatttacaacaaggagagctaagtggccgcagcattggaaaattcaaaacgcatatttttttaaggcaaggacatccattagctgaacacgcagagatcaccaaagaagaattgttatcttatcctcaagttcgttttacacaggatggaaataatttcccgtatttttatgaagaccttatcgagatccctgatcaagaaacagtgatttatacgagtgatcgaggtactttgatgaatatcgttcttgaaactgatgcttacgcttcaggatctggtattgtgattggagggattcgcgagcacttgcggttaatccctttggcagaaggcgaactaaatgaattttatatcatttattcggcgaaacgtccgctcagtgaaatcgctcaaagatttatcaaagagcttactcggttactggaccagcagagctaa

SEQ ID NO: 2893 - DNA (genomic), 945 bp, Enterococcus faecium; double-stranded, circular
  misc_feature (B) LOCATION 1...945
  hypothetical: NO
  anti-sense: NO
cgaatgaatatcatcaagatcagacatccttaccaatcagaacaaattccagaagacgatgtcgttttagtgctgggatttttcgacggcgtgcatatcggacaccagaaagtcataaagacaggtatggaaattgcacaaaaagaaggattgaaattagcattgatgactttcaatcagcatccatctattgtctttaaaaagatcgatcctagcagcgtgaaatatttgactagccttaagcaaaaagaagaaaaaatggccgctttgggtatagattatttatatgaagttgattttacttcttcttttgctcatttagcaccgcaggaatttgttgatcaatacatcgtagggttacatgcaaaatatgctgtttccggttttgattatacgtatggaccaaaagacattgcagatgtcgctcattttcctgaatatgccaaaggaagattcaaaatcgtcacagtttctaaagaagaagaacaaggtgaaaaaatcagctctacccgtattcgtggattactagacagcggacaagtaaaagaagcagcaaaactattaggttgcacatatgaggtagaaggggtagttgtccatggcgatgcacgaggcagactactaggattccctacagcaaatgtcaaagtaaagagcacggttcatttgcctaaagaaggtgtttatgtgtcggaaataaaaattggggaaacatggtatccagccatgggttcaattggacataatgatacattcggtgaaggacgggagctgactgtagagttgtatattttggactttaatcaagatatctatggtgaacatgtcgcggtacgctggaatcaatttttaagagatcaagtgaaattttctagtgtagaggaattgattgaacaactcaaggaggatgaacaagcaacagctgaatatttttctcagcaataa

SEQ ID NO: 2894 - DNA (genomic), 495 bp, Enterococcus faecium; double-stranded, circular
  misc_feature (B) LOCATION 1...495
  hypothetical: NO
  anti-sense: NO
acaaagaatatacacgtgctaatatggtcatggatggacgagaggaaaatacccaaagaaatgggtgataaaatacgccgcggtattgtggaagaagtattgaactttaattttggggagcatggacaatatatcgtcgatatagctatttccttgttgaatgatgatcgtcgtcgctttatgctaatcgttcctaatcaaggggcgattccgaatctacggtcagatgcagttgttgaaataccggcatatgttggtgcaactggtgtggagccaattacactaagaaaaccaatcagtgattttcataaaggattgatggaggcacaagttgcagtagagaagttactagtagatgcttactttgaaggttcttatcaaaaagctttacaagcatttacattgaatcaaaccgtaccaaatgccagagtcgcaaaaaaaatactagatgaaatgatcaaagtaaacaaaaaatattggccagcattaaagtag

SEQ ID NO: 2895 - DNA (genomic), 1605 bp, Enterococcus faecium; double-stranded, circular
  misc_feature (B) LOCATION 1...1605
  hypothetical: NO
  anti-sense: NO
aaggggaatatgatgaataaatcgcctgcagtcattctcacttgtcaatttaccttgcccaataaaaaatctttttcaacatacattgattatatgacaagagaaaaagcgctggaagaaatggaacgacgtacgcctgaagaagaacaggaactgcaacgaatcaagaatgctttagaggatttttatattcctgaaggagaaactttttcggagagtaagacggataaagaattcagcgaaacgtcgaatgaagctcaatctttgatgggaaatggaatcaactttgacaagttagaggaacaagattttaccaaatatctttcttatatgacccgtcactatgcgttagaacaaaagaaagaactgacgcaaagtgaacaaaaagaataccaacgcttgaaccaagcaataaaaaaatatcaaacagagccacacaaaaaagcttcaggaaaccttcctggagttttttctatggcttcagacgaagtgaaaggaagtgatctgaaggagattaagcaaatcttccaaagaggacaacaaaaaggctcaatcatttatcaagatgttgtctctcatgataattcgtatcttgaaaaaataggattgtacgatcccaaaacagatactttagatgaagaaggattaaaagcagctggaagaaaaatgatggagacattattcgagaaagagcaactgaacgaaacaggctactggatggcaacgattcaccgtaataccaaacatatccatattcattttgcagttgttgaaaaagaaaatacgcgtaaaccttacacggaggttgaaaatggtgtgagttatatcgtaccgaaaggtaagagaagacaagcaacattagacgcaatgaagaccaattatgtacatgagttagaacgtttttcttatgaaaaggatcgaatgattggtatggagaaacgaaatttattgacgcggaaaagtgatttgcgtaacaccttaacaaaagtggtaaaagagccagcgcgttacgatcgacacgcaatgaacttattaaatgaagtatataaaaccctacctgacaaacgttcggaatggcattatggggatgaaaaacgaaccaaactttcaccatacacaagagagaaactcgatgagttaaccaaatatgttttaacaaaagaacctgaatatcaagaatatatacagatttcaaaagcattgaaagaagaagcaaaaagtctttatggggaaagcaaaagagaatcaaaggatgcagaaaaaaatgctctctttgatttgaaaaagcgcacaggaaatgccattctaacagaactgaagaaacaggatagtcaaataaaacctttaatagaaagtatggatcagatgcaatctatttacaatgaacgatcctttcgaacgcttaaacagttaccaacgaatgaatacaaatatagttacgaagaattcatgaagcgcaggaaacaattccaacaaagagttgtcacgcaacggagtttgcgtcaattaaatcgaacgattaatgcccatgaagaaaaataccacgcaagtaaagcctacgaagagcaacaacgaagaatccaaatagaacaagaaagacagtaa

SEQ ID NO: 2896 - DNA (genomic), 1107 bp, Enterococcus faecium; double-stranded, circular
  misc_feature (B) LOCATION 1...1107
  hypothetical: NO
  anti-sense: NO
atgtttgatattttgattaaaaatggaaggttagttgatggatctaaaatagaggtcgctatagaaaaaggcatgattaaagcagttgcagcagaaataaatcagccggcgcaagaagtagttgacttggagggaaagtattatttatccgctgggtggatcgatgatcatgtccactgctatgaaaagatgaatctttattatgactatcctgatcagataggggtcgaaaaaggtgtgacgacggtcattgatgctggaactacgggagcagaaaacatccgtgaattttatcaattgacgaaatcggtcaagacaaatgtgtatgcgctaatgaatatctctaaatggggcattgtcaaacaagatgaacttgctgatctaacaaagattcaagaagatctagtaagtactgcgttagcagaactgccggaatttattgtcgggattaaagcgagaatgagtaagacagttgttggtgaaaatggcattaagccattagaattagctaaaaaaatccagacagaaaacaatgatctgccattgatggttcatatcggttctgcacctcctgagttagaagaagtattgtcaagaatggaaagaggcgatgtattgacccattgttttaatggaaaaccaaacggtattttagatccaaagacagatcaaattaaaaactttgtctgggatgcttacaataatggtgtcgtctttgatattggacatgggacggatagctttaatttccatgtggcagaaaccgcactaaaagcaggaatgaaagctacctctattagtacggatatctacatccgcaatcgtacaaatggcccagtttttgatctagcaactactttagaaaaattgagggtagtcggctattcttgggaagaaatcattgaaaaagttacagcagttcctgcacggaattttcatttgaagaataagggccagttagctgtcaattatgatgcagatttgacgatatttgagattgttgaaaatgaaaaggaattgaaagattccaacggatttacacgtatagctaaagaacaaattttaccgattaaaacaattattggaggcgtcatatatgacaattag

SEQ ID NO: 2897 - DNA (genomic), 429 bp, Enterococcus faecium; double-stranded, circular
  misc_feature (B) LOCATION 1...429
  hypothetical: NO
  anti-sense: NO
acaaatgatattttacgaggaggaacagagatgacgatctttgaaacggttgtaacagatgttggtatagaagcagaagtattcaggaaagaaaaaataatgattttatttggagatgaagcaccggaaacattaacagattattgttataagattgaattgaatcaggtaagaaaagaaataacttgtgatatgaagctctgttttgataaacaaatgtatgtaatcacagcagtaggagatgttgtccaaactaatttgaatgaattaggacatatcacgataaaatttgatggatctcatgagccggaacttccaggaacaatgtatgtagaagataaggaaatgccgcatttaagaaaggggacaatcattaaaatcgatcaagaggatcagaatgggggaaagctatatggaaatcatgcttga

SEQ ID NO: 2898 - DNA (genomic), 273 bp, Enterococcus faecium; double-stranded, circular
  misc_feature (B) LOCATION 1...273
  hypothetical: NO
  anti-sense: NO
ggaaatgatatgatcgattttagaacggttatggataaactaagtaatggagattttcgcgtattgattgaactatacttaaatgtaacgtctacagtcaaagagtttttatattctaatcccaaaacagctttagtattagttgcagtactgatagtttttgctgtgatctcttttattaagaaaatgattccgctattaattataggtgctgtgttgatattaggtttgtatttccctgaagttttggatcaaataaaaaatatattttag

SEQ ID NO: 2899 - DNA (genomic), 714 bp, Enterococcus faecium; double-stranded, circular
  misc_feature (B) LOCATION 1...714
  hypothetical: NO
  anti-sense: NO
atgaatgatatggtattgacaattccagagattattttacgtttagggatcgctatgctatttggcggagcaatcggttttgaacgacaatataaaaatcgtccagcaggtatgcgtacgcatattttagtttgtatgggagcatgtatcattgcattgatccaagttgagatcgctagtggtgcattaagagatgctttagagtatccacagcttgctggaacgattcgttcagatgaagcaaggctgattgctcaagtggtgagtggtgtcggtttcttaggcgcgggaacgatcatcgtcacgaaacaatcggtgacgggacttacgactgccgcttctttatgggcaattgctggattagggatcgccatcggcatgggttactattccattgcgatcatcagttttatcgggattgctattgcactcacagtagtgaaacgcgtgatccatgtacctacgactaaaaagttagaaatccaatttatccatagaaaagaaaccaaagattttcttaccgattattttgaagagaaaaatatcgtaatcgaagatgtgaattttgacgtaaaattcgttgatgactaccgagtgtacaaaaatatctatacgattgatcttccaaaagggctcacttatgccgatgtgatcgaggagttgtccgtacacaaaaatatcacaaagttgcatttagtcagtattgcgcaataa

SEQ ID NO: 2900 - DNA (genomic), 2166 bp, Enterococcus faecium; double-stranded, circular
  misc_feature (B) LOCATION 1...2166
  hypothetical: NO
  anti-sense: NO
cgcaacgatatcatagaagtcaaacatacacctcgcaaagattatgctcctgaaggggaaaaacgagtagagcttcatgttcatagcaatatgagtaggatggatgcaacaaacagcatctctgatcttgtggcacaagcagggaaatggggacaccgagctatcgccattacagaccacggtggtgcgcaagcctttccggaagcacatagtgctggaaaaaaagcaggtgtgaaaatcttatacggcgtggaagcgaatgtcgtagatgatggtgtcccaattgcttataatgatgcacatgaagcattgagtgaagccacatatgtcgtatttgacgtggaaacgacaggattgtctgcagtatatgacacgatcatcgagctagccgcagtcaaaatgtataaaggaaatgtgatcgaaagctttgatgaatttatcgatccaggacatcctttgtcacgaacaacggtagatctgactggtatcacggatggaatggttcgaggatcaaagtcggaagaagaagtattgcggatgttccttgaattttcaaaagatacaattttggtagcccacaacgcggcttttgatatggggttcttgaatactagctacgcaaggtatggtattcctgaagcggccaatccagtcattgatacgttggaattagctagatatctgtatcctcaattcaaacgtttcggattaggtgtgttatctaaaaaatttggtgtcagcttggaacagcatcaccgagcaatctatgatgctgaagcaactggtcacttagcatggatctttgtgaaagaggcaatggacaatcataacatgctttatcatgatcagctaaatgagcatatcggagaaggagattcttacaaaagggctcgacctttccatgtaacgattttagcaaaaaatcaggcaggactgaaagatttgttcaaactgatttcaatgtcgaatgtcgaatacttcgaacgcgtcccacgaataccacgctcccaattgaaaaagatgcgtgaaaatctattgatcggctcagcttgtgataagggagaaatattcgaagccatgatgcaaaaaggggtagaagaggcaagaaaccgagcaaaattctacgattatattgaagttatgccaaaagcggtctatgcgcctttgatcgagcaagaattggtaaaaaatgaacatgatttggaagaaattatccaaaatttggtagaaatcggaaaaagtttggataaaatcgttgttgcaacaggtaatgtacattatctgaacgaagaagatgccatttaccgaaaaattttgatcaattctatgggcggagcgaatccgttgaatcgtcatagtttgccggatgtccatttccgaacaaccgatgagatgctaactgcatttcactttttaggggaagaaacagcgaaagagatcgtagtagaaaatacgaataaaatcgcagatatctgcgaagaagtgattccagtcaaagatgaactttatacaccgaagattccaggttcagaagatgaaatatcagaattgagttacacaaaagcaaaacaaatgtacggagatccgttacctgagatcattcaaaaacgattaaaaaaagagttgaattctattaatggtaatggcttctcggttatttatctgatcgcccaaaaactagtgcataaaagtaatgaagatggctatctagtaggttcacgtggttctgttgggtctagctttgttgcgacgatgacgggaatcactgaagttaatccgttagcccctcattattattgtccagagtgccaatattccgagttttttgaagatggtacgtatggttctggatttgacatgccagaaaaacaatgtccaaaatgtggtgcacgcttaaacaaagacggtcatgatattccatttgagacatttttaggattccatggagacaaagtgcccgatattgatttgaacttctcaggtgattatcaagcagaagcccataactataccgaagtattgtttggcgaagactatgtttaccgtgccggaacgattggtacagtcgccgacaaaacagcatatggctatgtaaaaggatacgaaagggacaataatctgcagtttcgaagtgcagaagtcgacaaattagcaaaaggcgctact

SEQ ID NO: 2901 - DNA (genomic), 528 bp, Enterococcus faecium; double-stranded, circular
  misc_feature (B) LOCATION 1...528
  hypothetical: NO
  anti-sense: NO
aatgacgatatgaatgtaggaggaaagaaaatgttagttattattgatatgcaaaatcatattcttgatccaaacagcgaattttatattccagagtcagatcaattggcagaacgtattgctcaaagattagctaaagcacgccaaaataatgaatatattctcttcacacgggatataccagttgaactgaaggacaaagaagaagaacgagaagatttgcaattgatccctcttctttctccacaagaaaatgaacgagtgattaaaaagtattactttacgattccacctgaaactttagctgaaatccaggaaactttatttgaaagcaaagaagaacaaaaagagatcgaagtagtcgggattgaaacaaacttgtgtgtactctctaatctgataggcctgcagagtgcttttcctgaagcagacttttttgttgatccaatgttagtctccagtagaaaacacggagaatccgctttagagctgttgaaagatttcaacgtctctatcgtcgaatcataa

SEQ ID NO: 2902 - DNA (genomic), 270 bp, Enterococcus faecium; double-stranded, circular
  misc_feature (B) LOCATION 1...270
  hypothetical: NO
  anti-sense: NO
agagacgatatcttttgggaaggaggctgcgatatgtataatttaattttgggaatcgtgatcgttttatcgattgttatggtcattgcgattatgatgcagccaagcaagcaaaatagtgcagcgagtgcatttaccggcggtgcggatcaactattcggcaaacaaaaagctcgcggctttgaagctgtcatgcagcgatcaactgcagttatgggagctatctggatgatcttattatttgtcctagcatatttatcttcgaagtag

SEQ ID NO: 2903 - DNA (genomic), 810 bp, Enterococcus faecium; double-stranded, circular
  misc_feature (B) LOCATION 1...810
  hypothetical: NO
  anti-sense: NO
ggtaaagatatccatgccagcacagcgatgcgtgtatttggaatcgaaaaggcagaggatgtcacaccaaatatgcgtaggcaggcaaaagcagtgaattttggtatcgtgtatggcatctctgattacggactttcacaaaatctaggaatcagccgaaaagcagcacagcaatacatcgatacgtactttgaaaaatacccaggtgtcaaagaatatatggaaagaatcgtacgcgaagcaaaagaccaaggctacgtcgaaacgctgtatcaccgccgtcgatatctgccagacatcaattcaagaaattacaatatccgttcttttgcggaacgaacagctatcaatacaccaatccaaggaagtgctgctgatattttgaaaatcgcgatgatcgaattggataaacgattaaaagaaacaggtcttcaagcttggttatctgtttttgctcctgagattatctttttcatggaagtacctgtgacgttgaagatgctatatcgacacagaaaacgttgggcaaaaggtggaacagaagtctggctgacgaatttcaaaaaagtgatgctccatccttttaaacatattggaagaacgatcatcttcattgatcaaacattgagtattgtctggtcaatattcttttgtatttccgtaattctatttgctggattaatcgggcattatgtatatcaaggaaactacgaacagatttatattacttttacattcagttttgtgtgcatctggcttgaaatggtcccacgaattttccagttgctaccttcgctgattggtggatga

SEQ ID NO: 2904 - DNA (genomic), 645 bp, Enterococcus faecium; double-stranded, circular
  misc_feature (B) LOCATION 1...645
  hypothetical: NO
  anti-sense: NO
tttggagatattatggaaattcaacgtagaaccactaattttttacatttaggctctttttttgcaactttgacgatcttattttttctatgttattcataccttaagacctcacatgcgccttctagtgcattaggctggttgcttttggatcattctgatatcacagaagccgaagaaaatccgttttttttgattttgtcttctctttgcggcttactgttttctgtttatttcggtgcctatttttttcatcgacatcctggtacgttaaacgaagcttcaagcgtattgattgcatttaaaacgttttcttttttagcaattcttttttattcgtttaatcacaatacgcttttcttctttatcatgaatggtttagtcgtgattttatccatttttacttattttattttttcactcatttttagccaattgaaatgtccgctcttctttcgattagttcctgtcacctgttttatttacagcttgttttccttttttgtccttgctttaatgccactgaccaacccttcgacgatccaagtcgcaggaaatctgttggatatgctcttcatcgtcagtctaggtgtatttatgtggcaaagaaaaaacaaacaaaataaaaagcattttgaagcctga

SEQ ID NO: 2905 - DNA (genomic), 1539 bp, Enterococcus faecium; double-stranded, circular
  misc_feature (B) LOCATION 1...1539
  hypothetical: NO
  anti-sense: NO
gtggtggatatgttagacaaagaaactaaacaaaatctcgaacaatatttagcactgattgaatctcctattgttttttctgttagtttggataatagtgaaaatagtcaaaaactagctgaatttacgaaggaaatagcagaaatgtctcctaaaatctcttgggaaaaaagagattcgatgcgcacacctagtttttctatcaatccagttggcaaagaaagtggaatcgtttttgctggtatccccctcggtcatgaattttcctcttttttactggctatgttacaaattagtggacgggcaccgaaaatcagtgaatctttgagtcttaaaatcaaaaaaataacacaaacattgcattttgacagttatgttagcttgacttgtcataattgccccgacgttgtacaggcattgaatatattagctgtattaaatccaaatattactcatacgatgattgaaggtgggatgttccaaaaagaaatcgatgataaaaaaatcatggcagtgccaactgtgtttttaaatggagaagaatttagtagcggacgcatgacgatcgaacaaattgttgaaaaaatcactggccctttgattgaagaagagttgtttgaaaaagaaccttatgatgtattagtgattggcggtggaccagcagctagtagtgcagctatctatgcagcacgtaaaggaatccgtacaggacttgtcgctgattctttcggcggacaagtcgttgaaacactagggattgaaaatatgattggtacctcttacacagaaggtccaaaattgatgcagcaagtagaaagtcatgtgcgtagttaccctatcgacattatgatgaatcaacaggccgtttccttaaataaagagcaacattttattaatattggcttagctaacggtatatcacttaaagcaaaaaccgccatcatcgcgacaggtgcgcactggcgttctatcaatgtaccaggcgaaaaagagtttaaaaataaaggaattgcttattgcccacactgtgacggccctttatttaaaggaaaagagattgctgttatcggtggtggtaattctggtgttgaagcagcaatcgatttggctgggttagcaaaacatgtatatgttctagaattcttaccagaattaaaagcagatcaaatcttacaggataaactagtctctcttgcgaatgtcactgttatcaaacatgcagcgacgaaagaaatcagcggtacgaatcaggtagaatctctctcctatatcgatcgccgtacgatggagatgcatacactagctgtttcaggagtattcattctagtcggcttactccctaatacggattggctagatagaacgatcgaaatgaatccaagaaatgaaatagtgaccgagaaaaatggcgcaacgaatatccccggcgttttcgcagctggtgattgtacagatagtccatacaaacaaatcattgtttcaatgggttcaggagctactgcagctttaggagcattcgattatctgatgcgcacttga

SEQ ID NO: 2906 - DNA (genomic), 519 bp, Enterococcus faecium; double-stranded, circular
  misc_feature (B) LOCATION 1...519
  hypothetical: NO
  anti-sense: NO
ggtgaggatatgaaaaaagtaacaagagaagaagttgcatcaattttggtgaaagataagtatttttcaaaaggtaattactggttaaagatttggcaaacgttagtggctcttttaggatggatgatcgttgttcttccttttatatgggtctttttcccattaacgagaccagaaagagccaaggatttttccttgtacgcttttttatcagaaaagaaaatgctgtatttcttaatcggcttttttgtattgatttttttcagtttcctgattacctcatttgtattgactaggtggaacaatcgaaatctatacaaaaaagtaaataaatcttttgaatatgaagatgaaaaattgaaaaaaagacaagaattacttgaagaagtgtatacggaacgttttggaacaaaagaagagagagaaacggtccgtttttattctgtctccgaagagaaaaatctagatacgacattcattgcagatttgtataaagaaaatggggtggaactgaaatga

SEQ ID NO: 2907 - DNA (genomic), 804 bp, Enterococcus faecium; double-stranded, circular
  misc_feature (B) LOCATION 1...804
  hypothetical: NO
  anti-sense: NO
atgggggatattttaatggcaagaatattgtcagtagccaatcaaaaaggtggagtttctaaaactacgactagcgttaatttagcagcatgtttgaaatttgtttacggtaaaaatgtacttttagtggacattgatcctcagggaaatgctacagataatgtaggtttcgatatagatggaacaaaccaacctacaatttatgaagtattaaaaggggaggctgacattacagatgctattctggactataaaggaattgatgttttgccagccgacatagccctttcttctgcagagagggaatttactcaagtaggaagtgaacacaggcttaaaagagtacttcaaccaatcaaggacaactatgattatattataattgattgtccaccaagtttaggaatgcttacagtcaacgcatttactgtttctgatgaaattatcattccagttgaagctgcgtatttctcattaaaaggactaataaagttaagtgaaactattgaaacggtaaaagaatatacgaacgacaagcttgaagtacgaggagttctatttactaagtataataagcgttataacatttctaaagaaatgacgtctgcagcaaccgaaatttctagagtcattggtgcaaaaattttcaaaacttatattcgtaggacaataaccgttgacgaagcgcaagctgctggatcagatctaatcaattttaataaaccctcaacagctgaagatgactataaagcatttacagaagaatatttaaaagaagttggtgattttgatggcagaagataa

SEQ ID NO: 2908 - DNA (genomic), 1584 bp, Enterococcus faecium; double-stranded, circular
  misc_feature (B) LOCATION 1...1584
  hypothetical: NO
  anti-sense: NO
tttatctgtatcactataaaaatattcaaggaggaacttttatctataacgaattttaggaggaagagtatggaaatcaaaacgattattgaagcaatcgatgattggggaataaatgaacctgatcgagttgcttatcaggcggatgagacgcatacttttggtgaattgaaacaagcatcagacgcacttgcttattatttagaaaaaaaggtagaaggtgatggaccaattgtcgtttttggcaatttggagtttgaaatgattgtctcatttctaggggttgtcaaatctggccatgcctatttgccgattgaagagcatacacccaaggagcgtatcctgtcgatctttcgggtggctaaaccatctatggttatcagtatcggggactggatagaagatattccttcggttcctgtcataacaaaaaaagaatttcaagaaatcaagaagataccagtaggattttatcccagaaatagcgtaaaaggtacagaaaatttttatattatttttacttctggtactactggagaaccaaaaggcgtacaaatcagtcatgataatctagtcagctttgttcaatggacgatggaagactttgggatcaagcctggtatgcatttcttagcccaagcgccattttcttttgatttatcggtattttctatttatcctgcattagtttctggcggaatgctgaagccgttaaataaagcagttgttcaagactttcgtcaattattcgcgacattgccagccttgaagttgaatgtatgggtttctactccatcatttatggatatttgcttgatggaacctacattcaatggagaaaatgtgccggaattggacatgtttttattttgcggagaagaattgacgaaaaaaactgcagaaagtctacttgatcgattcccaaatgcacggatatataatacttacggtccaacagaagcaactgtagctatttcaagtattcagattgaccagcatgtactagatagttatgaccgactaccgattggctacgtaaaaaaagacacgaaagtttctattgtccaagaaggcaaacctgtttcaaaaggagaaacgggtgaaatcattattgcaggaccaagcgtatcaaaaggttacctgaacaatcccgaaaagacagctgctgcgttcttttgtcaaaatgacttagcaagttaccatacaggggatgcaggtagactagatgaagatgggcttttattttatgaaggacgtatggatcagcaggtcaaattacatggataccggattgaactcggggatatcgaacattatctgctccaagacaaccgaatcaaacaagctgtcgtcgtaccaaaataccaaggaacaaaagtacagcagctggttgcttttgtcgtattagaaaacaaaacgaaacagccggattttcagttgactaaatctatcaaagaacaattactagaagttgtgatggattatatgattcctcagaagttccattatgtcgatctgctgcctcagacagttaatggaaaaatcaatcgaaaaaaattaacagctgaggtgaatcctgaatga

SEQ ID NO: 2909 - DNA (genomic), 1227 bp, Enterococcus faecium; double-stranded, circular
  misc_feature (B) LOCATION 1...1227
  hypothetical: NO
  anti-sense: NO
ggggaatgtataacatacatggaaaagaaattatttaataaatattttattggaatcacattgatcaattttattgtctacctgatttattatctgttgatggtcatcatggcagtcattgcgcaagacaccttacacgccagcttgagccaagcaggttttgcttctgggatctatatcatcggaacattgctggcacgcttattcatggggaaacagttagaactatttggtcggaagtttaccttaagaggcggcgcgatcttctatctcctttcaacattagcatatctttatacgccaactatcggggcattgtatttagttcgattcttgaatggattcggctacggtacagtttctacagctacaaatgctattgttactgcatatatccctgcatctaaaaaaggggaaggcatcaattattatggattaagtactagtttagctgccgctgttgggccatttttaggaatgattttgctgaacatgactgattttcgtttcattatctggttttcaattgtactggtcttctttgttacgattgcctgccttgtctttcctgtaaaaaatattccattatctgaagaacaaaaaatatctcttcgctcatggaatatcaatagttttattgaaaagaaagcacttttcattacaggaatcgcctttttgatgggtctttcttattcaagtgttttatcatttttatcttcttatacaaaagtaatccacttagttgctgctgggtcatttttcttcgtcgtatatgctttggtcatcacatttacacgtccattgactggaaggattttcgatgtcaaaggagaacaatacgtgatgtatcctagctatttattcttaacagcaggattatttttactgagtgtaacgacgaatagtgtgacattgcttatctctggagcattagtcggcctaggttatggtacgtttatgtcaaatggacaggctgtttgtttaaaaatcgtccgcgaacatcgaatcagtattgctttatctacctactttattggtttagacctaggcttaggcgttggtccttatttgatggggatgctaaaatctcttacttcatttagaggattgtatgtgattgccggagtcattccattgatatgtacagcactctatcttgttaatggccgaaaacatagtcatgaagcagagggcgaattgattgaatcattgaaaaatgaaatttga

SEQ ID NO: 2910 - DNA (genomic), 537 bp, Enterococcus faecium; double-stranded, circular
  misc_feature (B) LOCATION 1...537
  hypothetical: NO
  anti-sense: NO
gatagatgtatggtaaatatttatatgtatatcaggagggttcctatggcaaaagatgctagcttcgacattgtatcagaagtcaatacagaagaagtaaaaaatgcgattcagcaaacaacaaaagaattgtccaatcgctttgacttcaaggattctacagtagaaatcaaattagagaacagcaatctagttgtattgagcgatgatgatttcaaaatcgaacagatcaaagatgtattatttggtaagctgatcaaaagaaatgtgccaatcaaaaatatccatttttccgaatcagaacacgctctaggtggcaaagctcgacaaactgccgatttggtcaacggaatcgatcgtgaaaacgcgaagaaaatcactacagctatcaaaaatgaaaaactgaaagtaaaagcacaaatccaagaagatcagattagagtgacaggtaagaaccgtgatgatctacaagctgtgattgctttattacgtaaacttgacttaccaatcgagttgcaattcactaactatcgttaa

SEQ ID NO: 2911 - DNA (genomic), 258 bp, Enterococcus faecium; double-stranded, circular
  misc_feature (B) LOCATION 1...258
  hypothetical: NO
  anti-sense: NO
cagagatgtattgattcctttattcttatcgtaccaaaaatcgtggagtatgaccaaaaggaaatgaaaataaaaattgagatattgacagtgatcaatagaatgcgtatactaattaagtacgaaaaggatatgatttgttttctaagactcacagaaaattctttcttggctgaaaacagaatagtcactaatcaaattgctccctttttctattttggtagaaataccgacgcagctcagcgttatcgagtttaa

SEQ ID NO: 2912 - DNA (genomic), 216 bp, Enterococcus faecium; double-stranded, circular
  misc_feature (B) LOCATION 1...216
  hypothetical: NO
  anti-sense: NO
tatccccgtatttacggcagcaaaaaaagaaaatcggaaagagtcgattcaagggtacgcgaagaaaacgacatattagacatgatctctcaaaaaaaaaactctcatctagtaatggataataaatcctctaagatgagagttttttgtcctaaaaagagctgcaccaacatcttctggcacagctctaacagggggcaatttatggaagtttga

SEQ ID NO: 2913 - DNA (genomic), 537 bp, Enterococcus faecium; double-stranded, circular
  misc_feature (B) LOCATION 1...537
  hypothetical: NO
  anti-sense: NO
gtgagccgtatcggaaataaagtcgttgttatccctgaaggagtaacagttactcaagacggaaacaacgttacagttaaaggaccaaaaggtgaattgactcgtactttttcagcagatatcaaaatgaatatcgaaggaaacgaagtaactttcactcgtccaaacgacagtaaagaaatgaaaacaattcatggaacaactcgtgcgaacttcaacaacatggttgtaggtgtcagcgaaggtttccaaaaagcgttagaactaatcggggttgggtaccgtgcacaattacaaggatcaaaacttgtattgaacgttggttactcacatccagtagaaatcacaccaccagctggagtaactgttgaagtaccagctaacacacaagtaattgttaaaggtgcgaacaaagaagaagttggcgaattagctgcaaacattcgtggaactcgtcctccagaaccttataaaggtaaaggtattcgttatgttggcgaatatgtacgccgtaaagaaggtaaaactggtaaataa

SEQ ID NO: 2914 - DNA (genomic), 585 bp, Enterococcus faecium; double-stranded, circular
  misc_feature (B) LOCATION 1...585
  hypothetical: NO
  anti-sense: NO
gcacaaagtataacacaagtacgaatgacacaaaatttaaaagtacaaaaagaggagaagttacggtcccagttggcacttacagttggacgatccaaacagacagtggagacagaagcattgaaaaaagcgattctggcaggccaagattttactcgttcacccattgtgcaaggtggcacaaccgctgatcatccattgatcgaagatacgtatatcgaagttgatctggagaaccagcatatgtggtattacaaagacggaaaagtggcccttgaaacagatatcgtttccggaaagccaactacacctacacctgctggagtcttctatgtttggaataaagaagaagatgcaactttaaaaggaacaaatgacgatggaacaccttacgagagtccggtaaactactggatgccgattgactggacaggtgttggtatccacgattcagactggcaacctgaatacggtggagacttatggaaaacccgcggttcacacggctgcatcaacaccccaccaagtgtaatgaaggaattattcgggatggtcgaaaaaggaacgcctgtattggtcttctaa

SEQ ID NO: 2915 - DNA (genomic), 1173 bp, Enterococcus faecium; double-stranded, circular
  misc_feature (B) LOCATION 1...1173
  hypothetical: NO
  anti-sense: NO
aatagaagtatcaaaggaccttggaggagatgtatgcaatcacgttttaaacaatcaaaattatttttctggacagtggagctagtactcacgatcatcggcgtgtactttattttacaaatgccgaatatttttagtccaatattgaaaatgctttcggcaatttttttaccattgcttgttgctggttttatctattatatgttcgatccaatcgttgtttttctcgaaaagcatcggatcccgagagtgttcggttttttattgacgtttttggtcgtaatcattttagttgttttaactgtcatgaatgtagtgcctcagttaatggaacagacaattcaattgacccagagcttgccaatgtatgcagatgaaacaagcaaatggttaaatgaattggcgcagcgggaagagtttaaaaatttcaatttggaagaacaattagcatcagcaaatttatctcttagtaatttgttcaatatcatattagtcagtttatctgcaagtgtctcaaaaatcatttcatttatgatgcaattttttattttgttatttaccgttccatttattttgctatttatgttcaaggatgggcacaaatttattgatgcgttgtctcacttctttccgaaagcgattcgtaaagagttacgccaaacggtaaaagaattaaacgaaacattatctgcctatatcagcagtacgatcttagatgctttgattattggtgtaatgagctttttggcaatgagaatattcgatcagccttatagcttgttgcttgcggtcatttgcggaatcacgaatattatcccgtatgtcggcccttttattggagcggtaccagcaatcattgtcggtttgtttatctctccatttcaagctttgtatatggcgttgtcgattttagtgatccaacaattagatggaaatttgatcaagccgttgttatttgggaaatcaatgaatatccatcctttgacgatcatcttggtattgattggagcaggaagtgtcgcaggaatattaggcatgctgatttgcatacctgtctatgcagtgattaagacgataatattaaatatccggaaaatctatttattgagaagaatggaacatgtttcggaaaagttagacagtccaaaagtgctggaagaaacaagtgaataa

SEQ ID NO: 2916 - DNA (genomic), 606 bp, Enterococcus faecium; double-stranded, circular
  misc_feature (B) LOCATION 1...606
  hypothetical: NO
  anti-sense: NO
gagcagagtatcatgcaaacatttccgttaaactatttttccgcattacgtacgccaactcaagtgtttgcgggacgcaaactattatcatggcctaaatttttcttgatatttgtatttttagtttccttgatggtcatgcctgtgactcttttttatgccaatcagatccaagcgattccattagaacaatttctatccgttcattcgctgatcgatgaacaaggaacccaaaaattttctgaacttgaattatctgaaactgggttacaagcatcgcaacaaacgatagctgtgacccctgaaattttggtaggtgtgtctttatctgagaaacaacaatccgatcatggaacttttattgattttgagaaggaacaatgggtgatccaacaaaaggataaatctggtatacgccgctatacgatgaattatagcccatctttccaaccagattctgtacgtacgcccgaagatttccaacgatttttagaaagagaattttatgccagtaatcgtccaacaatcattttatcttatagtttaagtcttggtcttgtcctatttgtcatgacgagtctcattttattcggggttcctttttct

SEQ ID NO: 2917 - DNA (genomic), 390 bp, Enterococcus faecium; double-stranded, circular
  misc_feature (B) LOCATION 1...390
  hypothetical: NO
  anti-sense: NO
aaaaagagtatgataaataaaaatcgtgttaaggagtgtcgtacgatgagcgaagcaaaccaagaacggtctggacaagaaatagaactaatcaaagaacgtattcttgctgccttggaaatggtgattgatcctgaattaggaatcgacatcgtcaatttaggcttgatttatgatatagaattcaatcctgaaaatggagaaacagtcattaagatgactctaacaactatgggctgtccattagcagatattttaacagaatctatccatgacgcattaaaagaagtgccagaagtaacgaaagcagaagtcaaactagtctggtatccagcatggacgacagataagatgagccgttatgcacggattgcgttggggatacgatag

SEQ ID NO: 2918 - DNA (genomic), 198 bp, Enterococcus faecium; double-stranded, circular
  misc_feature (B) LOCATION 1...198
  hypothetical: NO
  anti-sense: NO
agatggagtattatcgatgccaagattgttctgccacgatctgccgcaagagaagaatcgatgtacgcaaatatcgttgtggaagatgtcatggagaaatcaaatggattgagacaaaaagagaagactttaatgaagcacaaaaaatcagatgaaaggatagaaggcctttggaaaaaagtgagcagaggaatctaa

SEQ ID NO: 2919 - DNA (genomic), 318 bp, Enterococcus faecium; double-stranded, circular
  misc_feature (B) LOCATION 1...318
  hypothetical: NO
  anti-sense: NO
ataaggagtattcgccccgcaggtatgcgcccattttttgaagcgtcggctccatcagagaataggcgcgctcatccggggataccattgccagggctttcaccattttttcatagtgccccgcgcattgttccgggtcatctaacagcgggcggaataccttttttgccgcgtcaacatcccagtcgtgggggattgtcttgctggcatcgttggggtcgtaatattggaacgtatataaactccgagcaagctgcattttttcaaattccggcagatatgccttttccccgcggttcaaataacgaacccgtttaa

SEQ ID NO: 2920 - DNA (genomic), 1278 bp, Enterococcus faecium; double-stranded, circular
  misc_feature (B) LOCATION 1...1278
  hypothetical: NO
  anti-sense: NO
ggagttggtatcgtctttggcggtctgcttcaattgatctttggtgtagacgacaaagtcgttactcaatcaatggaatggatcgggattgtaggtcaaggatatgtatcatttttgcaaatgctagttatgcctttagtgtttatttcgatcattggtgcattcacaaaaatgaaagtttttgaaaagctagggaaaattagtgcgactgtattgacttctttacttggaacaacagctattgcagcattgatcggaattggctctacaatgctgttcggactccaaggagctaaattaacacaaggagctgcagaaacagcacgaatctctgaactggcaacacgtcaggaaacagttgaaaacttatcgattccacagcagattttatcctttatccctaaaaacgtttttgctgatttagcaggtagtcgtgcaacaagtacgattggagtcgttattttcgcggcatttgtcggaatcgcttatctaggcgtgaaaagaaaagcgccaaaagaagcagcattcttttcagatttagtcgacagtctgtataaaatcattatgcggatcgtgacgcttgttttgcgtttgacaccttatggagtatttgctttgatgacaaacgttttggcaacaagtgattttgcagctatcgtcaatttaggtaaatttgtcgttgcttcttacgtagcattgcttgctgttttgattgtccactcactgattttgattggtgcaaaagtcaatccaatcaactatttcaaaaaagcctttccggtatggagctccgcgtttacttcacgttcaagtgctggagctttgccattgaatatcgagactcagacaaaagctttaggagtagatgatgcaacagctaatttctcagcaagttttggtttgtctattggacaaaacggctgtgctggcgtttatccagctatgttggcaacgatcgtcgcaccagcagctggagtgaatgtctttagtttggaatttattttgatgcttgtggcaattgtaacaatcagttcttttggtgtanctggagtcggtgggggcgcaacatttgcttcactgatcgttttaggggcaatgaacttgccagcagcaatcgttgggttagttatctctgttgaaccattaatcgatatggcacgtacagcagtaaacgtcagcggtagcatggtagctggtatcgtgacaagtgcacgcatcaaagatttagatcgcgatgtcatcaatgatgattctaaagtgatcgatgtgaatgcatag

SEQ ID NO: 2921 - DNA (genomic), 588 bp, Enterococcus faecium; double-stranded, circular
  misc_feature (B) LOCATION 1...588
  hypothetical: NO
  anti-sense: NO
ttttatggtatccttttattattaactgacaaaggagagaatattttgaacactttgattgcaaaagacgtttttagattgcccgaaatgaatgcaagattgttgtcgacctctgctcttttattagcccttgatgtcatcttatacaagatagcgattggtcctgcttattttcaaatcacattcggatttttaagtatggcgcttatgggttatctatatggaccgatctgggctggtttgcttgaaatgttgtcgaacactttaaatttcacgatatttggttcaggaacgtttcaagctgcttttcttatcacggctttccttggtggatttattaatggcttatttttatatcataaaaagataaacctgccttccgtcatcgctgcccaattattgattatgatcccagtcagcctttttatcaattcttggctgatgtctgttttgtttggtgcagatttcaaagtaatttttctaggtagattcatcaggaatatgatccaaatccctattcaaataatggttgtttattcatttatcaaaactttagaggctagaaaagtgtttaaacgagctgtttga

SEQ ID NO: 2922 - DNA (genomic), 195 bp, Enterococcus faecium; double-stranded, circular
  misc_feature (B) LOCATION 1...195
  hypothetical: NO
  anti-sense: NO
tccaatggtatgaagattttgatgtatgtcctaaaatacaagtggatgggggataaattcgattttgtagaaaatccagaagatgcaaaaaaggtgatccgtcagatccaagaaaaattagctgaattggaaggaaagcctgctggaaaatattttacggataaccagcatgcaaaaggtcaagaattaggctaa

SEQ ID NO: 2923 - DNA (genomic), 1896 bp, Enterococcus faecium; double-stranded, circular
  misc_feature (B) LOCATION 1...1896
  hypothetical: NO
  anti-sense: NO
atgtgcggtattgtaggttttgttaacgacaaggacaacaaaaaaacaattattaatacaatgatggatcgaatcgttcaccgtggacctaatagttcaggggaatatatcgataaacacgttgctttaggatttagaagattaagtattattgacttagagggcggtactcagcctatttacaatgaagatcgaacaaagatcattatttttaatggcgaaatctataattatcagcctttgagagaagaattgattacagctggtcacgtttttcaaacacatgcagatacagaagtccttttgcatggttacgaagaatggggaacagaattattgcaaaaaatccgcggaatgtttgcttttgctatttgggataatgaaaaaaatgagttattcggtgcgagagaccattttgggatcaaaccatactattatgcagaaatgaacggaacatttatgtttggttcagaaatcaaaagttttttgcctcatcctgattttaataaagaattgaataaagaagcattgaaaccttatatgactttccaatattctccattgaacggtgaaaccttcttcaaaggtgtctatcgtttacctgaaggtcattattatacgtataaagacggaaaactggacattcaacaatattgggatgcagattttgaaacaaaagaaacgcattcccgacaagaatggatcgaaaaaatcgacgaaactgttcaagcttctattgaagcacacacaatcagcgatgtagaagttggttctttcttatccagcggggtcgattccagttatgtaacctctgtattgaaaccagatcattctttctcaattgggtttgatgataaaacctataatgaagcgattgaagccagaaaactaacagaattgttggacttagacaatacggcagctgtaatcgacggagacatgtcttttaaagcattcccattgatccagtatcacttagatgaaccagactcaaatccttcttgtgtgccgttgtactttttagcaaatctcgcttcacaaagtgtacgggtggttcaatcaggagaaggggcagatgaactatttgcgggataccaaacgtatggattccacacgaattcaaaatttatccgtgtgattgcgcaaggactgaaaaaattgccaaaagggacacgctataatttaggacgtaaaatcggaaaaatgaaaaatttccatggacgtatccatttatatgaatcacttgcgccagcaaaagaatattttatcgggcatgctcgagtgttcgaagaatcagaagcatcagaagtgttgacgccaaaatatcaaacagcgccatctgtgaatgagatcatgactgttcattacgagaaaacagaaggaatcaaagatgaagtcaataagatgcaatacgtcgatcttcatcaatggatgccaaaagatattttgttgaaggcagataagctttctatggctagttctctagaagttcgagtacctttactggatatcgaagtcatgaaattggctcaacaaataccaagtaagttcttgttgaatcaaaacaacacaaaagatattttcagacaagctgcgaacaaacatcttccagaagagtggtcgaatcgtgtgaaattaggattccctgtgccaatcaaagcttggttgaaagaagaacacggctacgaacaagtcaaagcactattcgaagcagattttgcaaaagaattttttgatcaagaaaaaattatgaagttgctagatgaccatcacgaaggacgtaaagaagaacaacgtaaaatctggacgatcttcagtttcttgacatggtataaagtttactttgtcgatgaaacgattccgcaagcagaagcaatcgactatgtgactgtttga

SEQ ID NO: 2924 - DNA (genomic), 477 bp, Enterococcus faecium; double-stranded, circular
  misc_feature (B) LOCATION 1...477
  hypothetical: NO
  anti-sense: NO
ccgacaggtataaccctgccggtctttttgtttttcgccgctacaggaaaactacagattgactacagggaaagtacagatacgcttgccataataacaatcgtaccagccacaaatcgtagttttattgcaaaggaggcattcaatcaaatggaaaaaagcaactatcattccaatgtgaatcatcacaaacggcatatgaaacaatctggggaaaaacgggcttttctatgggcgttcattatctcgttcacagtctgcacgctgtttttggggtggagattggtttccgtattggaggcaacacagctaccgcccatccctgcaactcatacaggcagcgggactggtgtagcggagaatccagaggaaaacactcttgccaccgccaaagaacagggagatgaacaggaatggagcctgattttagtgaacaggcagaacccccatccccgcccagtacgatgtggaacttga

SEQ ID NO: 2925 - DNA (genomic), 204 bp, Enterococcus faecium; double-stranded, circular
  misc_feature (B) LOCATION 1...204
  hypothetical: NO
  anti-sense: NO
aatcaaggtattattgggaatcccagcttaaatcatagatactgtaagggattttattctttatttaaaactttgcaacagaaccaacatgtttatcatacaatttcttcaattttctcgtttacctcaattcattctcaagtggaatcaactcatcatctaacattttacgccaggctcgcttcatttcttgtgggtatttaa

SEQ ID NO: 2926 - DNA (genomic), 360 bp, Enterococcus faecium; double-stranded, circular
  misc_feature (B) LOCATION 1...360
  hypothetical: NO
  anti-sense: NO
aatcaaggtattattgggaatcccagcttaaatcatagataccgtaagggattttattctttatttaaaactttgcaacagaaccgccattatcatcttcatctagctggaagagggtatcagcataaagatatggatttcaagtatcttttgaaaaaaacaggagggttgcgctatgcaccagccttgacgaagaaacagataaagatggagtattatcgatgccaagattgttctgccacgatctgccgcaagagaagaatcgatgtacgcaaatatcgttgtggaagatgtcatggagaaatcaaatggattgagacaaaaagagaagactttaatgaagcacaaaaaatcagatga

SEQ ID NO: 2927 - DNA (genomic), 456 bp, Enterococcus faecium; double-stranded, circular
  misc_feature (B) LOCATION 1...456
  hypothetical: NO
  anti-sense: NO
aatcaaggtattattgggaatcccagcttaaatcatagataccgtaagggattttattctttatttaaaactttgcaacagaaccatatcagtaatgaagatggcggcgagattgcgtttgaaggattagaagatggcgactacctgttgatggaaacgaaagcattaccagggtatcagctgccgtcggggtattggatcatttctgtcaataattcagaggaactgccggtggataaaatcgctatccaagggtatggcacccacgccccaccggccttttacagagatagcagaagtgccctgcatctaccgaactttaaccagtatacgctgccggctgccggtggcaaaggcatgatcgccagtatcatcttagggatcatggtgatgggttgcggcgtactctactacctgcatccgaagacgagaagaaaaagctcacaaagtaactag

SEQ ID NO: 2928 - DNA (genomic), 249 bp, Enterococcus faecium; double-stranded, circular
  misc_feature (B) LOCATION 1...249
  hypothetical: NO
  anti-sense: NO
aatcaaggtattattgggaatcccagcttaaatcatagataccgtaagggactttattctttatttaaaactttgcaacagaacctttttattttacagaagcactcgaaactgcatctactgcagtttcatcgtgtgtgctggcgctggttactgcatctgtttttccaccatgaacagatgcacttgaaaccgcatcttcatttccaacaagttgttgacccgtttgttgtaaataccactcaatga

SEQ ID NO: 2929 - DNA (genomic), 714 bp, Enterococcus faecium; double-stranded, circular
  misc_feature (B) LOCATION 1...714
  hypothetical: NO
  anti-sense: NO
aaacaaggtataataaaaaagataggtggtgaacgcatgtctgcaaaacaaaatgaacagcagaacgttgagcataaaacagaaattgctaagaaaaaatcatcagctgaacaggaaacaacagtcaccgaagaactgacagctgctttggaagaaatcgttgaggagcctaaagcagaaaaagtcaaaggcgagctagtgacactgttagatgacagtaattttttgataggtgaaagacattatcggcttgtgtccgattatcgtgaaggatttaatgcagaaaagcttggagaacgttacagtgatgtactagcccgatatgattatatcgtaggagattggggttatgaacaactacgcctaaaaggatttttccaagcggataatcgacgggcgcatccagatcagcgaatcgattccttggaagactatctttacgaatattgcaattttggttgtgcgtattttgtcatcgagagaatcggcggtaaaaaagaaaagacaactcagcgccgaaaaaagaaaaaaaaccataatcgtgcgtatatcgatgagaaaaaaggaccagtcgcatctaatcgcaaaaaaccggttattaaaaatcgaaaaacagagtcagcaaaaacctctgaaaaagtaaaaaaacaagaacaacctaaacaagtagaaaaaacaaaaacagcatttacgatcagaaaaagggaagagtag

SEQ ID NO: 2930 - DNA (genomic), 615 bp, Enterococcus faecium; double-stranded, circular
  misc_feature (B) LOCATION 1...615
  hypothetical: NO
  anti-sense: NO
caagaaggtatgaaaggggcgtttttaatgagcaaacgagtaatcattttaaattttcaagtagaaagccaggcatatcaggcattttcagaaatcaaaaagttacatgctgttcgttcgattaaaggagaacagatggcagttgtcagccatgatcctaatgggacacatcaattcaaaatagaagattttatcgactttaccggtaataacaaatcttctacgggtggattaatcggaatgttggttggtgtattaggtggtccgctagggattttattaggatggtttgccggaggaatgatcggtgcgacacaagatgccaaagaaataaaagatgcccagaccgtgttcgactttgtaggaaataaaatcggtgaaggagctacaggactgatcttgattgctgatgaagaggacaatcgcccactgaatcaattggtaatgatggaattaggcggagaaattactcgcttggattatgaagatgtcgaaaaagatgtgcatgatgcgaaagaagctgaaaatcatgcgaaagaagctgcacaaaagacttggaaggacaaacatccgcaaacttccaacgacaatgaaagttctggatcttcaaattaa

SEQ ID NO: 2931 - DNA (genomic), 918 bp, Enterococcus faecium; double-stranded, circular
  misc_feature (B) LOCATION 1...918
  hypothetical: NO
  anti-sense: NO
gaagaaggtatctacatgttattacgtgaaaaaatcaaagaaatctccttttctccttcagaaaatgaagtgatccagtttctcttaagcgattctccagcacttggcgaaatgaccatccaagcgattgctgagcgatgttatgtccacccctgtacactcatccgtgtagcaaaaaaaatgggttttgatggctgggtcagttttcgtaatgcttttttagctgaaacagcctatcttgaagggaattttcaagacgtagatgcgaatcttcctttttccaccacagacggtattatgacgatcgcaaataaaatggcttctttagaacagatgacgattcatgatacactttctctcattcatcatgaccaactgcaaaaagccaaacaactaatgcttcaagcaaaaaaaatcgtgattttcgccagtaactcgaatactttgatttctcaagatttcatgctgaaaatgaagcgcatcaaaatggatgtcacgattgtcaccacttttggtgaatcattctatgaagcgtacaattgcacgagtgatatgtgcgggattctgatttcttatacgggtgaaaacaatgtgatccttcgtaccgcagaaatattgaaacaaaatcatgttccaattttagctttgaccagtatcggtgattcaacgctatctgcaatgagtacagccgctttgcgacttacgacacgcgagcgactgtattcaaaaattggtaattttacgatcaatacatcaatttgttatcttctagacgtgttatatagttgtgtttttgcagaaaattatcaacagaatttagtccatctaatttctgtcggtcaaaaattcgataaacgccctatcagctcagccatcatgaaagagcctttcaattttgaaaataaagaagtggaataa

SEQ ID NO: 2932 - DNA (genomic), 1005 bp, Enterococcus faecium; double-stranded, circular
  misc_feature (B) LOCATION 1...1005
  hypothetical: NO
  anti-sense: NO
ataggaggtataaatatggtagggattatcctagcaagtcatggacaatttgctgaaggaatcttacaatccggttcaatgatctttggcgaacaagaaaacgtcaaagccgtgattttgaaaccaagtgaaggtccagatgacttgagagccaaattggaagaagcggttgcttcttttgataatcaagacgaagtgttattcttagttgatttatggggcggaacaccgttcaatcaatcaaacacattattcgaagagcacaaagataaatgggcaatcgtcagcggtttgaatttaccaatgttgattgaagcctacgcatcacgcttttcaatggaatctgctcatgaaattgcagcacacatcattgaaacagcaaaagacggtgtaaaagtaaaaccggaagaattagaaccggcagaagcaccgaaagcagcagttgaagacgcacaacctaaaggagcacttccagaaggaactgtggtcggagacggaaaaatcaaatatgtattagcacgtgttgactcacgtctgttacatggacaagttgcgacagcttggacaaaagcagtgcaaccaaaccgtattatcgttgtttcagatgcagtatcaaaggatgatctgcgtaagagactaatcgaacaagctgctcctccaggtgtaaaagcaaatgttattcctattagcaaaatgatcgaagtagcaaaagaccctcgttttggaaataccaaagcattgcttttatttgaaaatcctgaagacgtattgacagctgttgaaggtggcgtagacatcaaagaattaaatgttgggtcaatggcgcattcggtcggtaaagtcgttgtaagtaaagtattgtctatgggacaagaagacgttgaagcgtttgagaagcttgaacaaaaaggtgtgaaattcgatgtacgtaaagtacctaatgattcacgcgataacatggatgatattttgaaaaaagcaaaagctgaattagcaaaagcgtaa

SEQ ID NO: 2933 - DNA (genomic), 1779 bp, Enterococcus faecium; double-stranded, circular
  misc_feature (B) LOCATION 1...1779
  hypothetical: NO
  anti-sense: NO
aaatttatcttgggaggcactccattggaaacaacattaaggaaatatatcgaagtagcaagtaaaaaaaagcctgctgacctagtgatcaagcatgctaagatcgtcaacgtctttacgaaagaaatcatggaaaaagatgtagcaatctgcgaaggaatgatcgtaggaatcggtgaatacgaaggaaaaagcgtacataatgctaatgggcaatatctagtgccaggattcatcgatggccatgtgcatatcgaaagctcacttttatcaccaagcgaattttcaaaagtatccttgcttcatggagttactactgtagtgacagatccccatgaaataggaaacattgctgggagtacaggtcttgagtttatgatagaagatgcaagacaaacactcatgaatatcttttttatgctaccttcttgtgtacctgtaaccccttttgagaccaatggtgcaaatttaaatgcaaaaaaattagccccttttttacaaaaacccgaagttttaggcttagctgaagtcatgaactatcaagcagtagcaaataatgaaacagacatcctagaaaagatccaattgatgcaccagcataagaaaaaaattgacgggcatgcagctggtatcggcatggaagagttaaatgtttatcctgcagcaggtattcggacggatcatgaagctacaactgcaaaagaagctaaagaacgtttggatcttggtatgtatttaatggttcgagaagggaccgttgcaaaagatctggcatcgctactaccggcgatcacacctgaaaattcaagaagatgcttctttgtcaccgatgataaactgatcaatgatttagtaaaagaaggatcaatcgatcatatcgtccgtcaagctattgcacttggaatcgatccattacaagccattcagatggcaacattgaatgcagcagaatgttttgatttgaaaacactaggtgcgattgcccctgggtatcaagctgatttcttcttaacagacgatcttaccaagctgccaattcatgaagttttctataagggaacattagttgttcaatctgggcaactccaagaccatttatttgctgatcattcaaattcatatacgtgttgtctgccaaaactaaacgctcaaccattaaatccacattcgttagagctgcttctttcttcttcacaagcccatgtgatcgaaattatcccgaatagtctagtgactaaagatttggtagaaaaagtggaccgacaaggcgaacgattcattccttcaatcgaaaaagaccaattaaagattgcggtgatcgagcgtcaccatcaaacgggaaacattggattaggcatagtgaaaggatttcagctgaaacaaggagcgatagcgacaacgattgcccatgactcgcataatctagttgtcgttgggacaaacgacgaggatatgctgtatgctgctaatcttttgattcaaaaaggtggcgggatgaccgttgtcaacaaacagcaggaaatagcttgtgtttctcttcctataggcggaatcatgacacaggaacctttttcgatcgtctatgaacagttgaatgaattaataactaaagcacatcaactaggagcagctaaaacctttgatccttttttgacactttctttcttaacattatctgtcatacccgaattgaagatcaccgacaaaggattattttcattttctcgcttccaattgattccaccttgtggaaaaaccgatgaaataaatacattttaa

SEQ ID NO: 2934 - DNA (genomic), 189 bp, Enterococcus faecium; double-stranded, circular
  misc_feature (B) LOCATION 1...189
  hypothetical: NO
  anti-sense: NO
ttatctatcttattttacgtcggggacatcgctttctatgacgatcaattctgtatggtatgcatttttgatcacgtttttcacgctgatcatcagttacccgactgcttattttttaacaaaactgaagcacaagcaattatggctgatgctgattattttgcctacatgggtgaatctgctgcttaa

SEQ ID NO: 2935 - DNA (genomic), 423 bp, Enterococcus faecium; double-stranded, circular
  misc_feature (B) LOCATION 1...423
  hypothetical: NO
  anti-sense: NO
cacgagattttcctatatagattgaatgcaaaatctgaaaggaggatacacaacgtgatccaagcagaaagtcgtttaaaagtcgctgataactcaggcgcacgtgaaattttgacgatcaaagtccttggtggatctggtcgtaaaactgctaacatcggtgatgtgatcgttgctacggttaaacaagcaacgccaggtggggttgtcaaaaaaggtgacgtcgttaaagccgttatcgttcgaacaaaatcaggagctcgtcgtacagacggttcatatattaaatttgatgaaaatgctgcagtgattattcgtgatgataaaagccctcgtggaacacgtatctttgggccagttgcacgtgaactacgtgaaaacaacttcatgaagatcgtttcactagcaccagaagttttataa

SEQ ID NO: 2936 - DNA (genomic), 1098 bp, Enterococcus faecium; double-stranded, circular
  misc_feature (B) LOCATION 1...1098
  hypothetical: NO
  anti-sense: NO
agggagatttttatgattgaagtatctgcaccaggcaaactctatattgccggagaatatgcagttgttgaaacaggccatccagcagttatcgctgcagtcgatcaattcgtgacagtcactgtagaatctgcacgaaaagtcggaagtatccaatctgcacaatatagtgggatgcctgtacgttggacaagacgcaacggagaattagttttagatattcgggaaaatccttttcattatatccttgctgctattcgcttgactgaaaagtatgcacaagaaaaaaacattcttttatccttttatgatctgaaagtaacaagtgagttagacagttcaaatggccggaaatatggattgggttctagcggtgccgtgaccgttgcaacggtcaaagccttgaatgttttttacgcgttgaatttatctcagttggagattttcaagattgcagcactagccaatttagcagttcaagataatggttcctgcggcgacatcgctgctagctgttatggtggctggatcgctttctcaaccttcgaccatccttggctccaagaacaagaaactcagcattctatcagtgagttacttgccctggattggccaggtctatccattgagccattgattgctcctgaagatttacgtttattgattggttggacgggtagccctgcctctacttctgatttggtcgatcaagttcaccgttcgagagaagataaaatggtggcttatcagcttttcttaaaaaatagtacagaatgtgtcaacgaaatgatcaaagggtttaaagaaaataatgtaacgttgatccaacagatgattcgaaaaaaccgacaattactgcatgatttatctgcaatcactggggtcgtcatcgaaacgcctgctttgaacaaattgtgtaatttagctgaacagtatgaaggagccgcaaaatcttctggtgcaggtgggggcgattgcggaatcgtaattgttgaccagaaatctggcattcttcctttaatgagtgcatgggaaaaagcagaaatcactccactgccgttacatgtctatagcgatcaaagaaaggaaaaccgatga

SEQ ID NO: 2937 - DNA (genomic), 396 bp, Enterococcus faecium; double-stranded, circular
  misc_feature (B) LOCATION 1...396
  hypothetical: NO
  anti-sense: NO
gaaaatatctttaccaccattcctaaaaaaaattcaaaatctttcagagaagctgttaaaggaatttttaagttcacagatattaacttagcgcgtgaggctaaaaatcgattgattcatgattatatcgatcaaccaaaatattcaaaagcttgcgcatcattggatgatggattcgaagacgcctttcaatataccgtacaaggaaattcccacaatcgactaaagagtaccaatctaattgaacgactgaatcaagaagtacgcagaagagaaaagattattcgcatcttccccaatcaaacatcagccaatcgcttaattggagccgttcttatggacctacatgatgaatggatttattcttcaagaaaatacatcaattttgataagtag

SEQ ID NO: 2938 - DNA (genomic), 1605 bp, Enterococcus faecium; double-stranded, circular
  misc_feature (B) LOCATION 1...1605
  hypothetical: NO
  anti-sense: NO
gagtgtatctttttgggtgcagaattaaatcaaaaattatttagtgcggcagataatctccgtagcaaaatggatgcgtcagaatataaaaattatttattgggactgattttctataaatatttatccgaccgtttgttggaacaagtggttcttttagcagatgaatccttagaggaatatgatacggtaagcaaacaaacgatgttgtatcgcgaattactttcagatgaagaatcaaaagaagatctgattgcaacaatcgttgatattttggggtatgcgatttcgccagagtatcttttcaacgtcttagcggatcaagcaaaacaagcaacgttccaattgaatgatctaaacaaagcctttgtgcaattggcatctacctacaatcaatttaatgggttatttgatgatgtggatctccaatcaaaaaaactaggaacagatgagcaacaacgaaatgtgacgattaccgaagtcattaagaaattgaatgacgtggaagttttaggtcacgatggggacgtgatcggggatgcttatgaatttctgatcagtcaatttgcttcagaagcagggaagaaagccggagaattttacacgcctcatatggtttctgatatgatggcacaaatcgtgacgttggatcaaaaagaacgacgattctttagtgtttttgatccaaccatgggttcaggttcattgatgttaaatgtgcgtaactacttaactcacccagataacgttaaatatcatgggcaagaattaaatacaacgacatacaatctagcaaaaatgaacttgattttacatggggtagatgccgaagaaatgaatctccgcaatggggatacgttgaataaggattggccaacagatgaaccttacacatttgatgcagtagtaatgaacccaccttattcggctaattggtcagcagatacgaccttcttagacgattctcggtttaatcgttatggaaaattagcgccaaaatccaaagcagattttgcgtttcttcttcatggtttctatcatttgaaggaaacagggactatggccatcgtcttgccacacggagttttattccgtggcgctgcagaaggggtcattcgtcaaaaattactagaagacggcagtatttatgctgtgatcggtatgcctgcgaacttgttcttcgggacatcgattccaacgacggtgattgtattgaaaaagaaccgccaaactcgagacgtattattcattgacgctagtcgagaatttgtcaaaggaaaaaatcagaataaattatcggaagaaaacattcaaaaaatcctcgaaacctatgctgaaagaaaagatgtcgagaaatacgctcatttggcaaactttgatgaaatcaaagaaaatgactataacttaaatattccacgctatgtagatacgtttgaagaagaagaaccaattgatatggttcatgtcggaaatgacatcaagaagatacgacaagaacagcaagtgctagaaaaagaacttttagaagctatctcttccctgcaaacaacacctgaaaatgaagcgtggttacaaggtgcgctggaggtgttcaaacatgagtaa

SEQ ID NO: 2939 - DNA (genomic), 1608 bp, Enterococcus faecium; double-stranded, circular
  misc_feature (B) LOCATION 1...1608
  hypothetical: NO
  anti-sense: NO
gagtgtatctttttgggtgcagaattaaatcaaaaattatttagtgcggcagataatctccgtagcaaaatggatgcgtcagaatataaaaattatttgttggggttgattttctataaatatttatccgatcgtttgttggaacaagtggttcttttagcagatgaatccttagaggaatatgatacggtaagcaaacaaacaatgttgtatcgtgaattactttcagatgaagaatcaaaagaagatctgattgccacaatcgttgatattttgggatatgcaattgcaccagagtatcttttcaacgtcttagcggatcaagcaaaacaagcaacgtttcaattgaatgatttaaataaagcctttgtgcaattggcatctacctacaatcaatttaatgggttatttgatgatgtggatctccaatcaaaaaaactaggaacagatgagcaacaacgaaacgtgacgattaccgaagtcattaagaaattgaatgacgtggaagttttaggtcacgatggggacgtgatcggggatgcgtatgaatttttgatcagtcaatttgcttcagaagcagggaagaaagccggagaattttatacgcctcatatggtttctgatatgatggcacaaatcgtgacactggatcaaaaagaacgacgattctttagtgtttttgatccaacgatgggttcaggttcattgatgttaaacgtacgtaactacttaactcacccagataacgttaaatatcatgggcaagaattaaatacaacgacatacaatctagcaaaaatgaacttgattttacatggtgtcgacgccgaagaaatgaatctccgcaatggggatacgttgaataaggactggccaacagatgagccttacacatttgatgcagtagtgatgaacccaccttattcggctaattggtcagcagatacgaccttcttagatgattctcggtttaatcgctacgggaaattagcgccaaaatccaaagcagattttgcgtttcttcttcatggtttctatcatttgaaggaaacagggactatggctatcgtcttgccacatggagttttattccgtggtgctgcagaagggggcattcgtcaaaaattactagaagacggcagtatttatgctgtgatcggtatgcctgcgaacttgttctttggtacatcgattccaacgacggtgattgtattgaagaagaatcgtcaaactcgagatgtattattcattgatgctagtcgtgaatttgtcaaagggaaaaatcagaataaattatcggaagaaaacattcaaaaaatcctcgaaacctacgctgaaagaaaagatgttgagaaatacgctcatttggcaacctttgatgaaatcaaagaaaatgactataacttaaatatcccacgctatgtagatacgtttgaagaagaagaaccaattgatatggttcatgtcggaaatgacatcaagaagatacgacaagaacagcatgtgctagaaaaagaacttttagaagctatctcttccctgcaaacaacacctgaaaatgaagcgtggttacaaggcgcgttggaggtgttcaaacatgagcaataa

SEQ ID NO: 2940 - DNA (genomic), 291 bp, Enterococcus faecium; double-stranded, circular
  misc_feature (B) LOCATION 1...291
  hypothetical: NO
  anti-sense: NO
aggagtatctttactaaaccaactttactaggtggaatgaacggtgtcggtgaagcaggacctgaagcagttttacctttgaaaagatctgttttgcaagaaattggtgatcgtatcttgagtagcacatcagtttcatttagggcacaaacgattcaacctgtgaataactacgaattcaatttcacaattgatggtaacgcagatgaggttactatgaagcaaacaactcaacaaatcattgatagcattacaaaaattcaaaatgataatgcttcggcatggcgttaa

SEQ ID NO: 2941 - DNA (genomic), 540 bp, Enterococcus faecium; double-stranded, circular
  misc_feature (B) LOCATION 1...540
  hypothetical: NO
  anti-sense: NO
gctataatcttctccatagatcaaaaaggagcggtttttatcatgtggacagaaaaacagaaaaaagatgcatacgaaattctattattacagcaacaaggattattagaagcagaagataactggttagcaaatttagcaaattcatctgcattgttgaatgaaacattacctgagaccgtctttgcaggatactatttatttgatggtaatgaattgattttaggaccgttccaagggcgagtttcctgcacacgtatcaagatgggaaaaggagtttgtggagagtcagctgaaaaacaagcgacattgatcgttgacgatgtcaaaaaacatgaaaactatatttcctgtgattcagccgcacaatcagaaatcgttgtaccaatggtaaaagagggtcatttaatcggtgttttagatatcgattgcggagtaacgaaagggtacaatgaaatcgatcaagcatttctagaaaaatatgtagatcttttattagcaaattttaatataaatgccttttcatttattaataactaa

SEQ ID NO: 2942 - DNA (genomic), 333 bp, Enterococcus faecium; double-stranded, circular
  misc_feature (B) LOCATION 1...333
  hypothetical: NO
  anti-sense: NO
cagtttttcataatggacaacacgcaggcttcttcttttgcagctacatccacaactgtcatttcattttttgtcaatgttcctgtcttatctgaacagatcactgtcatagaacctaatgtttctaccgaaggaagtcctttgatgatcgccttttcttttgccatttcatgtactccaacggatagaatcatggtcaaaacagctggcaatccttcgggtaccattgacaccaccaaagcaatcgtagccgaaagaaggatatgccaatccataccatatcgaaatgtcgtaaaaataactaagaataggctcaaacaaagaatgccttga

SEQ ID NO: 2943 - DNA (genomic), 783 bp, Enterococcus faecium; double-stranded, circular
  misc_feature (B) LOCATION 1...783
  hypothetical: NO
  anti-sense: NO
aggaatttcatactttattcatattcattttttatactttttatagaggtgaaaagtatgaaaatgatccgctatgctactgctcgattaatttattacaaaaagcagacaatactctattgtttattttcaagcttttctgcttttttattgatagcatgcctgactctttaccatttgcaatcggctttagcgaatcaagtccaagatcggctttcatttatcggtgcttctgcatctacggcgcttcttccggctttagaattagctagccgattttatctaaaaggcatattcagtttattttttctgtttgccttcttttttatctttttcttttactattcactcaggcaaaaccagcaagaattgatgaattggcgcctgactggtctttctaaagccaaactgttcctttttattttttggcagctgttctttcctctctttctttgttgtatcttggttttattgtggatcgtcagcttccagtcggtttatgaaacactgcttcaaaggatcaattttcttgtcttaaagactgctgagctgccagatatccgtgatatcttgacttcagtaagcggacttacgattccgatggatcagcagactttctttactattgattttcaaaatgatctgtttttcacagatattcttagaggctttgcccaaacacttgttggacttagcgggtgctgtctgattctcggcctattgccattcactttttttatccatcacttgcaaagcaggaggtctaaacgtaatgaaacctga

SEQ ID NO: 2944 - DNA (genomic), 249 bp, Enterococcus faecium; double-stranded, circular
  misc_feature (B) LOCATION 1...249
  hypothetical: NO
  anti-sense: NO
tgcttcttcatggatgtcttcgaatccagaagaagtgtggcaaatttatttggaaatgaaagaggtggcggaaggatgagcagacatctaatgctccatataccagacggaacaaaggcaattgcaattagtattgttgctgaacgaaaagatggtggtttggcgttgaccacaaaaggtattgataccaaacagattttagaaggcagagatgtcgagatagagatcgatgaggaggaagtggaatga

SEQ ID NO: 2945 - DNA (genomic), 747 bp, Enterococcus faecium; double-stranded, circular
  misc_feature (B) LOCATION 1...747
  hypothetical: NO
  anti-sense: NO
tttggaatcttctctattggaaattctggattcagtaaagggggaagaagaaaaatgacattgcttgtaaaacaagaattatttaaattgatcaagaaaaagtcaactgctgttttatctgttctattagttgttttgctcataggaacagcacttctagccaaaaaatacacgacgatcattgatccagttgaaatgactgctcagctttttagtgccacatcttggattgtctttatcatgattgcagctgcaagcacgatcatttcgatggaagcacaatatggtacattgaaaaatctcctttatcgaaagtattctcgaggagaaatattagtaagcaaatggatcacattagttatttattctgtttatttataccttttagctattattgtcactgtgttgatgaaactgattcttttcccttcgatttccttcacggagaaggtttctactggtcaaacactgatccaaagcttgttcacttatactttgggtagttatatcggtttatggctgattttaagtttagtgttgatgattgcttgctttatcaatagttccggcgcatccatcttcagcaggaatcgtcttttattttgcttcgtcaatcatatctggtatccttattgcactcatccaaaaatgggagtggatcaaatggaatccgatcagtatgttgaatctgcaaaaccaaattggaaacgaagagatcatgaagcaattgactcatctttctactaa

SEQ ID NO: 2946 - DNA (genomic), 345 bp, Enterococcus faecium; double-stranded, circular
  misc_feature (B) LOCATION 1...345
  hypothetical: NO
  anti-sense: NO
ataccattcatcggtggcgaaaaaaatgtggcagaaacattagctcctttaaccactaaaaaaatcgatacattgattttgggatgcacccattatccattattacgccccatcattcaaaatgtaatgggagaaaatgttcaactgatcgattctggagcagaaacagtaggtgaagtatctatgctgttagattatttcaatttgagcaattcaccgcaaaatggtcggacattatgccagttttatacaactggctctgccaaacttttcgaggaaatagctgaagactggcttggaatcggacacttaaatgtagaacatatcgaattgggaggaaaataa

SEQ ID NO: 2947 - DNA (genomic), 1014 bp, Enterococcus faecium; double-stranded, circular
  misc_feature (B) LOCATION 1...1014
  hypothetical: NO
  anti-sense: NO
aaaccgttcattatgatgtcaaattcgtcagtaattgatgcaatgtgttataataattcagttaaatcaaaaatgaaatggagaaaagacatggacgggttattacctttatggaaagaacgcggaatgacaagtcatgattgcgtattcaaattaagaaaaatcttacatacgaaaaaaatcggacatgggggtacgcttgacccagacgtagacggtgtgttgcccatttgtattggaaaagccacaaaagttatcgaatatttgacagattctgggaaaatctatgtaggcgagataactctaggtttcagtacaacgacggaagatcgatccggagaacgggtagaaacaaaaccagtagatatgtctttatctgaaaaaaaaatagatgaagtgatggcttcatttattggtgagatcacccagataccaccaatgtactcagcggtaaaagtcaacggtaagcggttatatgaatatgcccgcaataatgaaacagtggagcgtcctgttagaaaggctcagatttaccgttttatccggacaagtgaattgacaagagacgaagtgacaggaaccatttcttggcgcttcgaagtagaatgcgggaaaggaacctatgtccgcacattagctgtagatacaggcaagaaacttggttaccctgcgcacatgtctgatctgacccgaacagcaagtgccggtatgtcccagaaggatgctctgacattagaagaagtagctcaagctgtgaaaaatgggacaatcgatgattgtttgctgccaatagaaaaaggagtggaacggttcaaacgagtagatattactgatgaagtatggcagaaagtaaaaaacggtatgagacttgattatactgtatttgcgctcccagaaatgccgtcagaagaaattgctttgttttataaaggaaaagttgtcagtatttatcagccaaacccgaaagaaaaaaacaaattaaaacctagtaaagtattgagaaatgaggaataa

SEQ ID NO: 2948 - DNA (genomic), 858 bp, Enterococcus faecium; double-stranded, circular
  misc_feature (B) LOCATION 1...858
  hypothetical: NO
  anti-sense: NO
ggaattctcatgagcgtctccataagactacaaatcaaaacaatgtacaacgacttcagcccaaaagaacaggctatcgccgattatattttagaaaatccaagcaaagtaagtcatagtcctattagcaatttagcaagtgaactgggcattgctgactctactttttttcaatttacaaaaaaacttggttataatggatttaaagattttaaaatggccatgttgatccaagaaaatgatctatctgctatttctatccacgaaaatattcagaaaacagatactgagctcactatggcgcaaaaggtgttcgagtctagtatttcaactttaaatgacacaaaaaagttgttacaacaaaaggatctaaaaaaagcggctactattatcaatgaatctaaacgtgtctattttttcggtgttggcggttcagagattgtagcaactgacgcttatcataaatttttgcgttcccctatcgcaacttctcacagcacggattaccatattcaattgatggaagcttctttattgacggaaaaagactgtgctgttttgatttctcacacagggcaatcaaaagaaacaatccatattgctgaaaccgtaagaaaaactggagcaaaaacaatcgttattactagccaagctaattcttcccttgctaaacttggcgatgtcgtttttatttctatttctgaagaaacagaattccgatctgaagctttagcttcccgtatttctcaactaagcattttggactctctatatgtgattttgatgttttacaacgaaaaagaatcacgtcgttctatcgctaaagttcgacatactatttctgaaatcaaagaatag

SEQ ID NO: 2949 - DNA (genomic), 183 bp, Enterococcus faecium; double-stranded, circular
  misc_feature (B) LOCATION 1...183
  hypothetical: NO
  anti-sense: NO
aactatctcatgaataaaaagattttagctgtaattatttcaataatagttttaatcactatgttcttcatatttaggctaattttcaatataagcttacaaaaaagtattctttatctaattcctatagcatttatcttagcaatttttagaagtatttacggaaataaaaactctaaatag

SEQ ID NO: 2950 - DNA (genomic), 231 bp, Enterococcus faecium; double-stranded, circular
  misc_feature (B) LOCATION 1...231
  hypothetical: NO
  anti-sense: NO
catcatctcatcgtccgagttttagcactatacaacgtaaagaaaacattcttagctattggaaaaagccttaatccgacagtttctgttttacccattggcgactttcgacgtttctgggcaacagcctatgtttgtataggagcctcacctaacaaggttattactatattctatttacgagttcatgatagacttttcctaatgattaggcaatggaatttgaaatga

SEQ ID NO: 2951 - DNA (genomic), 471 bp, Enterococcus faecium; double-stranded, circular
  misc_feature (B) LOCATION 1...471
  hypothetical: NO
  anti-sense: NO
ctgtttatcatttatggaagaaggcgaaaaagaatgaggctattcattgatggagatggttctccagtaaaagaagatgtcataaaattaggagaatcctatggtcttgacgtggttatcgtgaccagtgtggaccattatacgaccaaagaatacgctaatcatgtccaaatcgtctacgtagaccgcggagctgatagtgcggattataaaatcgtcggtatggttaagaagaatgactttttgatcacgcaagattatggtttagcttcacttgtattgccgaagggtgtgcgagtgttccatcactctggaaaagaatttgacgaagcgaatatcggcacgcttctagaacaacgttatcatagtggaaagttaagaaaagctggcataaggacaaagggtccaaaaccctttacggagaaagatcatatgtcttttcgtcaagcgttaaaaaaggcaattgactaa

SEQ ID NO: 2952 - DNA (genomic), 201 bp, Enterococcus faecium; double-stranded, circular
  misc_feature (B) LOCATION 1...201
  hypothetical: NO
  anti-sense: NO
ctggctatcattactctggaggttgaacatactcataatgtcgcccaatttgaaatagataccggcaaaggtcacaatttgcagaaaagcaaccatgaaaaatggataggttgccgaaatattgaaaaacatcgtggagatgctaaatgcagtcgtaatcaccaaagtaacacccgctcgcatcataatcgtattgaataa

SEQ ID NO: 2953 - DNA (genomic), 1047 bp, Enterococcus faecium; double-stranded, circular
  misc_feature (B) LOCATION 1...1047
  hypothetical: NO
  anti-sense: NO
gaaaggatcttgaaaatgaagattacagaaaaagattttggccaaggttatcacttgataaccttggagaacaaaaacaagctagcactttctatctctgatttaggtgctagaatcgtcagtttaaaatcaaatgatcgagaattagttttgggatttgacaccgctgaagaatatatcgaaaaagatccgtatatcggtgcttctatcggtcgcaccgcagggagaatcgaaaatggccgcttttctctcaatggaaaaacttaccaattagccacagatccaaaaactggacataatctgcatggtggtgctcctggatttgaattaaaaaaatggtcttatgtcattttgaatggcgaaaatgaagcttctgtcatttttactactacaagtcccgacggagaacatggttttccaggtacaatggatgtggaaatccgctatactttgacaaaagataatatctggcgagtgacctctcgcggcaccagtgaccaagatactttattcaatccgacaaatcatgtttacttcaacttgacgggagatgcttctcagtcaatcgatcaacatgagctttggctcaatagcgaagcttatgctcctttgcgaacagatagtattcctataggggtaaaagaaaatgctgcaggaagtgctttcgattttcaaatacctaaaaaattagcgtccgtttttgctagtgatttggatcaaaaaaatcttgttgacggaatcgatcatccatttttcttaaaagaaaccggcttgggtaaagaagccgctcgcttgactagccccgataaaagaatccaagtagatattgctacagatgcttctagtgtggttattttcactgcaaatttcggcacagaaacaccagaaatgcgcaaccgaaaactggcacatcacggtggcatcacatttgagactcaaacagctccaggtgcagagcgcttctcagcatttggttcgattcatttaaaagccggatcagtatttgaaacagtaacagaattcaaaatcaaaacaagaaaggaataa

SEQ ID NO: 2954 - DNA (genomic), 360 bp, Enterococcus faecium; double-stranded, circular
  misc_feature (B) LOCATION 1...360
  hypothetical: NO
  anti-sense: NO
gagaaaatcattttggagataggagataaaaagttgaataaagtaaatatgaataagaagtttgtcattataggtatcgttgtattggctattataggtataattttttcaagaatgacgggttcatctggactagagaagtcatctgtaccattggtaactcagattttacaagaacagtataacttaaatcggacatgtgatgatgtgacgatcactcatgataatggtgataacacgtaccgggctaaagctacgttagacaatggaagtgctatcaatataaatgtcgagtactatccaaaaaaagaccgtgtatatgtagagataccatatactgaggtgttaatgttaaattga

SEQ ID NO: 2955 - DNA (genomic), 1092 bp, Enterococcus faecium; double-stranded, circular
  misc_feature (B) LOCATION 1...1092
  hypothetical: NO
  anti-sense: NO
acggaaatcatattatcgcaatccgacagaagatgcgatcattatgagcagaaagttaaaaacggagacgatgaaatgaatgaagaattgattctggcaattgaatcaagttgtgatgaaacgagtgtagcggtcgttagaaatggaacagagatcttatctaacatcgttgcttcccaaataaacagtcataaacgttttggcggagtggtgcctgaagtagctagccgccatcatgtagaacaaataaccttatgcttggaagatgcactggtagaagctggtgtatcggcagaagatttatcggcagtcgctgtcacttatgggcctggactcgtcggctctttgttgattggtatttctgcagctaaggcttttgcttgggcacaccaattgcctctgattcctgtgaaccatatggcaggtcacatttatgccgcacgtctggtcaaaccattccagtttccattgatggcacttcttgttagcggaggacatacagaattagtctatatgcaagaagatggatcatatgaaatcattggggagacaagagatgacgcagcaggagaagcttatgacaaagttggaagagtattaggtctttcttatccaagtggaaaagaaatcgatcagctagctcatcaaggaaaagataattatcattttccacgagcgatgatccatgaagataattatgatttcagttttagtggattaaaaagtgcatttatcaatttggtgcataatgcacaacagcgtggagaagatctagacaaaaatgatttagcagctagctttcaagcaagtgtgattgatgtattgattactaaaacacttcgagcttgtcaaaattatccagtcaagcaactggttgtagctggaggtgtagcggccaatcaagggttgcgtgaaggattgcaagctgctctgtcagctaaactccctgaagtagaattagtgattccgcctctgagactttgtggagataatgctgcaatgattggagcagcagcacatgtggaaatgcaaaaaagaaattttgccagctatcagttgaatgctgatccaagcttggttttatctgaataa

SEQ ID NO: 2956 - DNA (genomic), 366 bp, Enterococcus faecium; double-stranded, circular
  misc_feature (B) LOCATION 1...366
  hypothetical: NO
  anti-sense: NO
gaggaaatcatcatagatagtaaagaacaattaaaaattgcgattgaagcagcagattcaaaacgggcagaagacattatcgctttagacgttcgaaatgtttccttgttggcagattatttcatgatctgttcagcaaatagcgaacgtcaaatcaacgcaattacagaagaaatcattgataaagaagaagaaaacaaatatgaagtaaaacgtattgaaggaaaagaaggcggaaaatgggtattgatcgatcttggagatgtgatcgtacatgttttccatgcgccagaacgaaatttctataatctggaaaaactatggtcagatgctccgctagtcgatcttagtgaatggttggattaa

SEQ ID NO: 2957 - DNA (genomic), 627 bp, Enterococcus faecium; double-stranded, circular
  misc_feature (B) LOCATION 1...627
  hypothetical: NO
  anti-sense: NO
gaattgatcatggcgaaaaaaaagtggaaaaagcaaaagcgcaagaatatccgttggccagcagtggttgccggtgtagcagtgatactcttagcctttgttttttccttgaagaatctgtcttctccttttactgataatcagcaagaaaatgaagcgcaatcccatcagcaatttattgaacggcttgttccgcatgcccaagaactacaagatggttatggagtgcttcctagtatcattttaggacaagctatattagaatcaaattggggaaaaagtaccttggctagcaaatacaataatcttttcgggatcaaggcttatggggatcagaagaaagtaagcctggaaacaaaggaatttgttaacgaagaatggataactatccaaggagacttcaaagtgtatgattcatgggaacagtccatggatgaccatacacaactgttcgtccaaggagtagattggaatcctgcgctgtatgaaaaagtgattacggccaccaactatcaggaagccgcacaagcattgcaagatgcaggttatgcgacagaccccggttatgcgcaaaaaatcatccaggtcatcgagacgtatcaattgaatcagtatgaccggagatag

SEQ ID NO: 2958 - DNA (genomic), 663 bp, Enterococcus faecium; double-stranded, circular
  misc_feature (B) LOCATION 1...663
  hypothetical: NO
  anti-sense: NO
gaggagatcatgaagtataatgcagtgatttttgacatggatggtttgctgttcgacacagagttagtgtattacgaagccacacaagtagtagcagacaagatgggttttccttatgataaagacctgtatttaaaattcttaggtgtttcagatgaagaagtatgggcgaattatcatatgattttctcggaatttggcaaaacaagtgtacaaagattcatagatgattcataccaggaaacgcttgaacgtttttcgcaaggagcggtacaaatgaagcccggtgtgttggaactcctctcttttttagaagaacatcagattcccaaagttgtcgcttccagtaaccaacgagcagtcattgaacttttattgaagaagaacaatctgtttgaacgatttgagacgattgtttctgcagaaaatgttcaacgagcaaaaccagacccagaaattttcttgttagctaatcagaagctaggtacagcgaagaaagaaacattgattttagaagattcacaaaatggtattttagcagcttctgcggctgagatcccggtagtcatggtaccagatctgcttccaccatcccaagaattgatcaaaaaaacagctggggttgtttcttctttacatgaaatccctgcattgttaaaataa

SEQ ID NO: 2959 - DNA (genomic), 684 bp, Enterococcus faecium; double-stranded, circular
  misc_feature (B) LOCATION 1...684
  hypothetical: NO
  anti-sense: NO
caatgtgtcatcttgaaagaaaggagaatccatatgccgacacagacatttttccatttgcctaaagaaaaacaaaaaagactaatcgaggctgcgagaatcgagttttctagagtacccttaaaagaagcttcgattgctaatatcgtcaaattagcggatatccctagaggcagtttctatcagtattttgaagataaagaggatctttatttttattactttgagacaatgagacgtgacagctctaaagatatgttacaactaatgaaagaatccgatggtgatctattcaaaggattcgaatcctatttttctaaaatgatttatgagattttggaaggcgagaatgcttctttttatcgtaacttgtttatgaacatggattaccgtgcctcaagaaaagtcgctcctcatacgagtcgccaaaaaacgcctcacgatccacataaagaacacaaacaagatgcaaaagagttgcttgaattgatcgatcggacgaagctgaaagtaaaaaatgatcatgaattggaattactgatccaattagtgatgaatactgtatttacaacaattgcgcattcgtatcgcttattttcaacatctgaagattactcagtagagcaagcaatcagtgaattcaatttgaaactttcttggctgaaaaacggagtatataaatag

SEQ ID NO: 2960 - DNA (genomic), 345 bp, Enterococcus faecium; double-stranded, circular
  misc_feature (B) LOCATION 1...345
  hypothetical: NO
  anti-sense: NO
ctttccgtcatgaaatttgcaaacagtgcagcaaagaagctagggaagattgcttctgttcggactttcccgattgttaacacttctaatccaaacaatgttccagctaaaggtgtgccaaatacagaactgaaaccggcactgatcccgctgataatcaaaatctcccgttctgctttatccaatcggaataaatgcgctatattatcagctaacgctccccccatttggactgctgttccttcacggccaacagatcccccaaataaatgggtagtgatggttccaaacaaggtcaatggaatgagccgcaaagggatcttttcttctcctccattcccttga

SEQ ID NO: 2961 - DNA (genomic), 1168 bp, Enterococcus faecium; double-stranded, circular
  misc_feature (B) LOCATION 1...1168
  hypothetical: NO
  anti-sense: NO
acacaagtcatatcaaggctctttccaacaaggaaaggagcagacaccatgagagaaaaaagacgggataacaaaggtcgtatcctgcatactggagagagccaacgaacagacggaaaatacttatataaatatgtagacgcatttggaaacacaaaatatgtgtatgcttggagattgacacccacagacccgacaccaaagggaaaacgggaaaaaccctcacttcgagaactggaacagcagataagacgggatattgaggacggtatcgacagcgcaggcaagaaaatgacgcttagccgactgtatgccaaacagaacgcacaaagggcaaatgtgaagaaaagcacacaaaaacaacgggaacaactcatgcggttattgaaagaggacaaattaggtgctaggagcattgatacaatcaagccctctgacgctaaagaatgggcgttacgcatgaaagacaagggcttttcctacaataccattaacaaccataaacgctcgttaaaagcgtcattctatatcgccatacaagacgattgcgtaaggaaaaatccctttgatttcaaattaagtgaagtcctagaaaatgataccaaagagaaagtcgcattgacagaggaacaggaacaagccttactctcattcatcaagacggacaatgtgtatcacaaatattatgatgatatgctgatattgttaaaaacaggacttcgtatctcggaactgtgcggactgacagtagccgatattgatttcaagaatgaagttgtgattatcgaccaccagttattaaagaacaaggaacagggctattatattgaaacgcctaaaacaaagagcggaataaggcaagtgccattaagcagagaaacgatacaggcatttcaacgggttatgaaaaaacgcccaaaggcagaaccatttgtgatagacggacggagcaattttctgtttgtcaatcataagggtaagcccaaagttgcgattgattacaacgccttatttgtccgaatggtaaagaaatacaacaagcaccacaaggacaatcccttgccacatatcacaccgcatacgctacgccatacattttgcacaaggggggcaagcaggnacatgatcgncgagaggagcagnacatcacctatggttgcgaaaagaa

SEQ ID NO: 2962 - DNA (genomic), 594 bp, Enterococcus faecium; double-stranded, circular
  misc_feature (B) LOCATION 1...594
  hypothetical: NO
  anti-sense: NO
cagctttccatgcgaaacatcgcaaacagaattcatgttcaagcacctgctttatattggtatttcaaaaacaaacaacagctcttgcaaaaaatggctgaaacaatggaagaagaattagcgcttccagatccaactttgccttggaatgaacagttgctgcagtatatggaaaattactatgacctttatacacgtttcccttgtggggcagaattagaaatcaatactgtgcccgcttttccgagtcgattagaacatttggagcaaatgatccaattacttgttcgtgaaggattttcagtcacccaaagtcatcaggccattgcctctctccacaatttattgattggacagttaatggatcagcagcatgaacagcagcttcgacaaaaaattatggacggaaatgaatttttgaaagaaacagttctatttatgcgtaattatgtagttgaaaatcaattagagggaattaaagaaagtatgcagtcccatgcagaattgaatgaaaaagcactctttctaacgagtgcacaaacctatattgaaggcttatgccaaccaaataaaagaagagaaaacgagcagtaa

SEQ ID NO: 2963 - DNA (genomic), 441 bp, Enterococcus faecium; double-stranded, circular
  misc_feature (B) LOCATION 1...441
  hypothetical: NO
  anti-sense: NO
aggtattccattagatgtcatcaatatgcaagactatggcatgatgaacggagaaaaagttcttgcacaagcagaaaatctaatgaaataaatcaagtatgcagttgggggtataacaacgtggaagatcaacaaaatctagaagccatcatggggttaatcatgtttggcggtaatgcaaagagcgatgcaatggaagcgattgcggctgctaaaatcggtgattttgagttagcggataggaaaatcgctgatgcagaagaatcacttatacaagcgcatcatgcacaaacagacatgttgacacaagaagcacaaggaaatcatatgcaagtgacattattgactgttcacagtcaagatcacttaatgacatctattgcgtttactgatttagcaaaagaaatcatcgaactttatcgtcgcgtatacagcgaataa

SEQ ID NO: 2964 - DNA (genomic), 402 bp, Enterococcus faecium; double-stranded, circular
  misc_feature (B) LOCATION 1...402
  hypothetical: NO
  anti-sense: NO
tcttacttttttatccaggggaaaggagtgcagaaaatgaaacatgtgaaggcgttggtagtgaaggcaatcatgatctgggcgattctgtgggtcgtgctgacaggtttatacggtgttagctttatggattcaacgattgttggggtaattattgtagtcatgatctatgtgctaggggatctgttgatcttacgtaaagtagggaacatcgcagcgacgatcgcagatgctggttcagctgcagttatcttgtggctctatctatattttatgaatgatacagtcgatatttggatgaaagtattgattcctgctctattgatcggtgtggcagaatggttcttccacaagtggttgctaagtcaaggcatcgtaccagatgaacggaaaatggaataa

SEQ ID NO: 2965 - DNA (genomic), 903 bp, Enterococcus faecium; double-stranded, circular
  misc_feature (B) LOCATION 1...903
  hypothetical: NO
  anti-sense: NO
gcgaaccccatacctatgcggaaaccgctgtcacactggaatgtggcggcgctgtcttttccgcaaaaggcaaaacggaaaccgccgcaggctggacggctatggagcagggctttccatgccacactgaaaaagaaaccgaagcagcccgaaccctccccgccacttcctgcactcaccaagggccagaagctgaccgccgggggtgcatccatcaaagagggcgcgacctccccaccggcccattttaccgaggacacgcttctctccgcaatggaacacgccagtgcaaaggagtttgcgaaactggaagatgtggaacacaaaggacttggcactccggccacccgtgccggcgtgattgaaaagctggtgcgctccggctttgtggaacggaagaaaaagcagcttttccccacggaaaaaggcacggaacttatcaaggtaatgcctgatacgctgaaatccgtcaagctgaccgctgaatgggaggaacggctgggcgcggtggagcgcggggaactctccccggaggactttatggcgggcattaccgccatgctcaccgaactggtaaaaagctatcagggcgtgaccgtggcatctgccgccctgtctgcatccgggcgcacggtaattggtatctgcccccgctgcggcaaaaacgtggtggagggcaaaaagagctttttctgcgagggctggaacgctgcgcccgcctgcgactttgccctgtggaagaacgaccgcttttttaccagcaagcacaaggaactgacccgcaaggctgccgccgccctgctgaaaaaagggcgcgttgccatgaccggcctgttttccgagaaaaaaggcgtcctttatgatgcaattgttgtgatggaggacaccggcgagaaatttgtt

SEQ ID NO: 2966 - DNA (genomic), 221 bp, Enterococcus faecium; double-stranded, circular
  misc_feature (B) LOCATION 1...221
  hypothetical: NO
  anti-sense: NO
gcgaacccatggtgaagaggtttgcatggttcttaactgcgggtttcttggaccattttcagcaatcggtccatcttgcacgaacaaggaaccgaaagaaaaaaccagaattttcctcgctctcgtctgccagctacggtatgtacagcttttggctgatcattgccggaatactaattgctctttctgctattttcatgcttttttctttgttaggataa

SEQ ID NO: 2967 - DNA (genomic), 939 bp, Enterococcus faecium; double-stranded, circular
  misc_feature (B) LOCATION 1...939
  hypothetical: NO
  anti-sense: NO
atgaaaaccataaatctaataaaagtatttatagcatcaccaggtgatatagcagcaaagaggaatgaagtagaagaaaccatatatagatggaatatagaaaatacagataatacaaaagtaattttgatgccaattcgatgggaaacgaatgcgattcctacttatataaataatagctctgggcaaagtgttattaataaacaaattgtagaaaatagtgatatattattagcgatttttggccataagttgggttctccagttgataattatagatcgggaactatagcagaaattgattacttttataaaaatagcaaaggcgaggtaggggtttttttcttagatgaaccagttccacaagttttggctgaagagtatatagaagttaagaagtacagggactctttagaagataagggtttttatggaacatatagcaaagacaatatcagaaggtttctcacaaaaaaagtgaattatttaattgagaaagcacaaaataatttagaatcaaaacgctttgatttagattctatttcttacaagacaccttcagtaattaacaaaaaagttaccggaactgataaagattttgatgacaacttagatatttttgatccaatagaatttgacaatgatgaaagattgctgctaatatatgcgtttatggatgaaaattctatcttttcaactgataattcaacttatagaaaagtagttcaatgggaaagtgataacaatttaaggagttacttgagtgatagagtatttgatgtactagaaaaattaagtaaatcgggaattttaaaggaagaatacgattcttcttttgatgagtatccatcacgctatattttgatttcagaggactataagaaatttaaaaggtattttttaaaaaacgccgattgtaaaattaagctagacaactaa

SEQ ID NO: 2968 - DNA (genomic), 531 bp, Enterococcus faecium; double-stranded, circular
  misc_feature (B) LOCATION 1...531
  hypothetical: NO
  anti-sense: NO
caacgaaccattaaactttatttaagaaagggccaaattatgcgctatcctatattgatccaccctaatgataaattaaaaagaactgctcagccaatcgatgtaatcacggacgagacaatcgctttattagacaatttatatgagacaatgattgcgaatgacggaatagggatcgctgctcctcaagtaggacaaaacaagagaattgctgtgatcgaagtagatgaaggcgagaaatttgaactgattaacccagaaatcatcgaagcaaaaggtgaaagccttgacgtagaaggttgtctcagtattccgcatgtctatggaacggtcaagcgagcagatgaagtgaccgtgcgttattatgatcgagacggagaagagatagaagtgacggcttttggctatttagcccgtgccttccagcatgaaatcgatcacttagacggtatcttgttcattgagaaaatgatacagcagatcccggaagaagaacttgaagaatatatggaggaacatcttgatgactaa

SEQ ID NO: 2969 - DNA (genomic), 243 bp, Enterococcus faecium; double-stranded, circular
  misc_feature (B) LOCATION 1...243
  hypothetical: NO
  anti-sense: NO
ggtatgaccatgatgacccaaacgaaattaccattgatcggtataggtgttaccttgataggtatcccagtctattattcaaaaaaaagaaaacacgctcagaagagtaaaatatttcaacaacagacagaaaaagtacgaactaggtcctctagatcttcgtgctttttctatttcaataaaacaagttcttctattttgatttttgctacttctgcaagtagtgcttatgtgctaaagtaa

SEQ ID NO: 2970 - DNA (genomic), 366 bp, Enterococcus faecium; double-stranded, circular
  misc_feature (B) LOCATION 1...366
  hypothetical: NO
  anti-sense: NO
ggagtgaccatgatgaatacgcaagctaagacatttgttcgttcacaattatttcctgaagaaatgcctcaattcttagagaagaaaaagcaagtagggatcttgggcggaacattcaatcccgttcaccttgcacatttagtgatggctgaacaagctggccggaatttaggtcttgaccgcgtatttttgatgccttcttatcagccacctcatgttgatgagaaacagacgattgatgcaaaacatcgactcaacatgttggaattagcggtggaagacaatccttttttgcagattgaaacgattgaattagctcgtggtgggaaaagttacacctatgatactatgaaggaattgacgcgg

SEQ ID NO: 2971 - DNA (genomic), 468 bp, Enterococcus faecium; double-stranded, circular
  misc_feature (B) LOCATION 1...468
  hypothetical: NO
  anti-sense: NO
tcaaatgccattgcagaatcaaattcaatttctgatattaacctgatttactcaggacaacaattaacaatcccaacagaaggctctgcacaagcagctgctgaacctcaagcagccgttcaagaagcaccagtccaagctgaacaacctgttgtacaagaaacggttcaaacggaaaaacaagcagcgcctgttgctgaaacacaacctgctcctgctgtaacagaaactgctgctactccagcaagcacaagctctgcaaaagaatggatcgcacaaaaagaatcaagcggttcttacacagcaacgaacggacgttacatcggacgttaccaattagattcttcttacttaaatggtgactactctgctgcaaaccaagaaagagtagcagaacaatatgttacttcacgttatggttcttgggaagcggcgaaagcattctgggaagcaaacggttggtactaa

SEQ ID NO: 2972 - DNA (genomic), 270 bp, Enterococcus faecium; double-stranded, circular
  misc_feature (B) LOCATION 1...270
  hypothetical: NO
  anti-sense: NO
atctcagccatgattgctgaacaagaacgtactgaatcgaaacgacgccaggcacaaggaattaaaatcgctaaagcaaacggcgtctataaaggtcgtcctaagttatacagtgcagacaccaaagatcctcaacgtcgccttgtctataggagtatcgttcaggatcttgagaatggggttgctatctcaaagattgcaacagactacaatgtgactaggcaaacaatttaccgaataaaaaaagaaatcgaccaactaattgtatga

SEQ ID NO: 2973 - DNA (genomic), 1647 bp, Enterococcus faecium; double-stranded, circular
  misc_feature (B) LOCATION 1...1647
  hypothetical: NO
  anti-sense: NO
ggaggagccatgagtacaaaagagagtctcgaattaaacgaaatcacaagtggaaatccactgttatccagtattcgatcgattgtagaaacgacattttacggtaataatgttcatgaagtttttgataggaagacagcttatcaactagcaaaagggagtccaggaacgatcatcacagatttaacaatctcacatgctgaagaactagatttaccagctgatgttaggacactagtattcaatgatggaagcattgtgggaagaacagcaagtgctcggcggatctttgaggacttagacaaggaacaaagcaaatacgagaaaattttaagagaagctgtgtatcaaagtcgcaagcgccagttttaccatacaaaagtaatcgttggcctatctgaagaattttctgtgcaaagtcatttgctgattccagaaggatttgagaacaatttgtattcttatttgctgaattttcagccagcgaattcgaagatcttagagacttatcaaaagtctgtttcctttgatgagggagatctttatatcttttgtgatcccgaatggacacatgaaacatttccaaatggactcattttgtttgatgctctccataatacagcggctgtgctaggattacgttactttggagaattaaaaaaagcgactttgacgcttgcttgggcattgggaaatcgcaatggctttattgcctgccacggtgggatgaaacaatatgctagtaatgaccagacctatacgatggctgtatttgggttgtccggttctggaaaatcaacgattaccttagcaaaacatacggaaggtcactctgtttcgatcttgcatgacgatgctttcgttatttctcgaaaaaatggttttgctactgccttggaaccttcttactttgataaaacacaagactatccgtctgatgatccggccatttcttctttccttacttgtcagaatgtgggcgtgacatgtacaagtaaaggagaaaaagtcctagtaacaggagatatacgaaacggaaatgggcggacagtcaaatcacgttatgcgacacccgaccgagtcgatcatcttagcgaaaagatcgatgctgttttttggatcatgaaagatgattcgcttccgccaattatcaagatcaatgacccagttttagcagcgtcttttggtgcaacattagcaacaaaacgatcagacgcggaaaatatcactacaaaaagacagctagatgagctagtcattgaaccatttgctaatcctttccgtgtctatcctcttagggaagactatcaagcttttcgagagttgtttttgaaacagcaaacagcctgctatgtcctgaatactggatatttcgatgataaaaaaatcaaacctgaaacgacattgtcaatcgttgaaagaatcgtgcaacaaacggcagaattcaagtcgtttggtccatttgaagacatccactatttacctataccagattttcctgtttcttttgaggatacgtcctataaaaatctggtgaaacaacgacttgatattcgtttacgattcattgaagctcagataggaaaagatctcttgccagatgaagcaaaagaaagtttggagaatttgattcagaaattgaactaa

SEQ ID NO: 2974 - DNA (genomic), 642 bp, Enterococcus faecium; double-stranded, circular
  misc_feature (B) LOCATION 1...642
  hypothetical: NO
  anti-sense: NO
aaaaaatacatcagaagaaaaaaatctaaaattataaaatgtgatactcatactaaaataggagtttcaagtgatggaaaatacgattgctatttaagcacaaatagcggagctgaaagtaatcttcttgatgaattaaaaagaactgagattcaaattatagataaaaaagaacgtcctaaaaatggttttgtgctatcagaaaaaactgatttagaaaatacagaagcatttaacaaagaatcggttaaagatttacgtaaactaccaacaaaggacataaatggcaaggattttacaagtaaagattttgagaagtatgatcttactatggtaaatgtatttgcaacttggtgtacagcttgtgtaaaggaaattcctgatttggttgaggttcagaatgaaatgaaaagcaagggtgtaaatatcgttggagttgttacagatcctgttgatgataacggtgaaaacaaggaagcaattgaaaagtcaaagttaatacatgaaaagacaaaggcttcatatcctttcttaatgccagatggaatggcaacactttttttgacaaaaattataaggtgttgtgaatgctgcggtgttatggctccgattgcccttgacaatgagcatcctcggatctga

SEQ ID NO: 2975 - DNA (genomic), 927 bp, Enterococcus faecium; double-stranded, circular
  misc_feature (B) LOCATION 1...927
  hypothetical: NO
  anti-sense: NO
gaggcccacatgattatctcgacaattacagaagctattggttccacaccgctttatcgctttgacaatcagcactattctatgcctaaaggttctgctatttatgcaaaactagaatatttaaatcctggaggaagtatcaaagatagattgggcagttatttgatcaaagaaggatttgcccaaggaaaaatcaatgaaaaaacgacgatcatcgaaccaactgccggaaatacaggaattgggatcgctctggccgcactcacatacaaattaagaacggtttttgttgttccagagaagtttagcttagaaaaacaacaattgatgaaagcattgggagcaaagatcatccattctcctagtgagcaaggaatcatcggtgccatcagcaaaagtaaaaaacttgcagaggagatatcaaacagctatctgcctcttcaatttgaaaataaagataatcctgctgcttactatcatacgttagggccagaaatctttcatgaaatcaaagaaaatatccatagttttgtagcaggaattgggagtggtggaacctttgctggaacttctacctttttgaaagaaaaatatcccgacattcgaataatcggtgtacaaccagagggctctgtgttaaatggtggtgatccagcccctcacgaaattgagggtatcggtgtagaattcattccgccgtttctttctcccctttcaatcaatcagatcgagacaatctctgatgtagaagggtttaactatactaggcagttagcacgagaacaaggaatattagttggaagttcgattggtgcggcttttgcagcagcattaagagaaattcgtcgtttaccacctggtcatcgtgtcgttacgatttttccagacgcagcagaccgctatttatcaaaaaacatttacttatag

SEQ ID NO: 2976 - DNA (genomic), 309 bp, Enterococcus faecium; double-stranded, circular
  misc_feature (B) LOCATION 1...309
  hypothetical: NO
  anti-sense: NO
ataagacacattcagcggaacagttcctgcttatcagcagaaaactgttctgctttttcatttttcattgatctattcttcttttattttcctagcatttcatttgtgatgtatgcaataacatgttatcttttattatatgaatcgttgaggagtccgttacatgattacgttggtgagagttttgttttgggtgcctgcggtcgcactggtcgcaagtattgtttatcttatgaattggaacaaagaacggttttatttagctattttgactcttccggctatctactttatgtggaaagtttttaa

SEQ ID NO: 2977 - DNA (genomic), 948 bp, Enterococcus faecium; double-stranded, circular
  misc_feature (B) LOCATION 1...948
  hypothetical: NO
  anti-sense: NO
caaaggcacatgctgtgtatattcatacggtgtggggagtggggtttagatttgattaagtggctgttgcttctcgttgttatctttatgggaagttttattttcttcctgcaaagggaaatcaagagattaactaagaaaatcgccactctttctgaacgacaagaatatggtggtcgtctttcagtcgaatttcgagaaaagaatctaatggacctagtagatgcactgaatacatgggtggatgaaaatgaacaaaaaggacaagcatttcaagaaatggaagaaaacatcagactatcgatcgtcggcctttctcatgatctcagaactcctttgactgctattaacggttatgtacaattactggaacaggtagaggatacggagaaacgggagaagtatttaacgatcatcaaacaatctgttgcaagattactcagtatgacggatcagttttatgatcttgctcgaatagagacgaagcaaaaagaaatggatctccatacgctttctttttctaaagaggtggaagaagtatttttctctttttatgaacaattttctgagaaaaatatcgaggtagcgttcgctgaacactcgataaatacaactgtattagcagatccgctcatgttgctgcgagtgctgcaaaatatcatacagaatttattgcgttatgcagatggacaagcaaaggtgacattttcaaaagaggattcattcattcgattaacagtggccaatcctatcaaaccaggagcgcaaacctctgttgaaaaagtcttccagcgtttttataccgaaaataccagccgcacaaatacggaatctagcggaatcgggctttacctgtcaaaaaaattggtggaaggaatgggaggagagatgaccgctagattagacgggggcatcttctccatctccgtcaagttgcggagggtttaa

SEQ ID NO: 2978 - DNA (genomic), 1347 bp, Enterococcus faecium; double-stranded, circular
  misc_feature (B) LOCATION 1...1347
  hypothetical: NO
  anti-sense: NO
gaggacaacatggctaacgataaaattacgattcatggtgcacgtgcccataacttgaaaaatatagatgtaacgattccacgagataaattcgtggtcgttacaggtttgtccggttctggaaaaagttccctagcatttgatacgctgtacgctgaagggcagcggagatacgtagagagcctttctgcttatgctcgtcagtttttaggacaaatggataagccggacgtagatagcatcgacggattgagtccggcgatttctattgatcagaaaacaacaagtaaaaatcctcggtcgacagtaggtactgtgacggaaatcaatgactatttacgcttgttgtttgcacgtgtaggacatccgatttgtcccaacgatcatatcgagattaccagtcaatcagtagatcaaatggcagatcaagtaatggctttgcctgagcgcacaaagatccaagtgttggcaccgatcgtggtaaagaaaaaaggacaacataaaaaaatattcgaacgaatccaaaaagagggatacgtccgcgttcgagtcgatggtgagatctatgatttaagtgaagtgcctgagctggagaaaaacaaaaaacatgatatcgcgatcgtcatcgaccggatcattgtgaaagaagggattcgttctcgcctatttgattctttagaggcggccctgcgattagcagacggctatgctctggttgacgtgatcggtgaagaagaaatgttgtttagcgaacactatgcctgtccttattgcggatttactgttggcgaactagaaccaagactgttctcattcaatgcgccttttggagcttgtccagactgtgatggtttaggtgtcaaattagaagtcgatcaagatttagtgattccagatagaacgaagacacttagtcaaggtgctatcgttccatggaatccaatcagctctcagtattatcctcaaatgttagcgcaggcttgtgaaagtttcggtatcgatttagatacaccattcgaagaattaccggaagagcatcaggagatcatcttgaatgggacagatgatcttttccatttccattatgaaaatgattttggtggcgttcgcgatgtaaaaacgactttcgaaggggtattgaagaatatcgagcgtcgttatcatgatacgaacagtgatttcacgcgtgagcaaatgcgtctttatatgacagaattaacttgtcagacatgtaaaggttatcgattgaatccccaagctctatctgttcaaatcaatggaacgaatatcgggcaaacaaatgagttgtctattccaaaaagcagtagatttcttcttcaaacttaa

SEQ ID NO: 2979 - DNA (genomic), 1284 bp, Enterococcus faecium; double-stranded, circular
  misc_feature (B) LOCATION 1...1284
  hypothetical: NO
  anti-sense: NO
tggctaaacatcgagtgtataaacaattggtcactaattatgagaatgcaaatgattggaggcttgacaatgaaaaatttttataaaaaaaaatttgctttaactgatcagggcgcagaagctttaactaaagcttctatttctagtttttttgtatactgcattaatatggtaccagcattcattataatgatgctgatagacgaattagttttagaaaatgcaaagccccgttggctttattttgcagtatcgtttgttactttgcttttcatgtattggttgttagatagggagtatgaaaacttatataatagtacttataaagaaagtgcgcatttaagagtgcaaattgcagacgatttgtcaaatttaccattatcctatttttcaaaacataatttatcagatttatctcaaactatcatgtctgacgttgaaggtattgagcatgcgatgagtcatgcaatacctaaagccggcggtatggctctgtttttcccttttatttcagtgatgcttttggttggtaatgtcaaaatgggattagctgttattttgccaacgttatttagttttgtcttaatcttgttatcaaagaaatcccaaacgaaagccaatactaaatattacgatactttgagagaaaactcggaagaatttcaagaaactattgaattgcagcaagagattaatagctttaatctatctaaaaaagttcaagacagacttttcaaaaaaatggaagagagtgaaaggattcatttaaaggtagaattaagtactttttcagtcatggccttatcctctattttctcatatgttagtttagcagtagtcattctagtaggtgttcacttactgttaacgggtgaagtgactatactctacgtcgttggttacttactagccgcaataaaaataaaggattccttcgattctatgaaagaagcagtgcttgaaatattttatttagctcctaaaatacagcgaattagagctatgaaggaaaccagtatccaagagggatcagatagtcctctgaaatcttttgacattgagttgcgagatgtctctttctcatatgataacaataccccaattttagatcatatctcttttacggctaaacaaggagaagtgactgcgttagtaggtgctagtggttccgggaaaactagtatcttgaaattagtgtctagactgtatgattatgatgaaggctgtattttaattgatgggtatgatattaaacgtgtatctccagcttctttgtttagctaa

SEQ ID NO: 2980 - DNA (genomic), 723 bp, Enterococcus faecium; double-stranded, circular
  misc_feature (B) LOCATION 1...723
  hypothetical: NO
  anti-sense: NO
tcaataaacatgaaaacaagatctgacgtatcttcaaacaaaacaaagaaaacaaattactggaaattcgccttccttatccttcttggggtagtacttggttcgaccgtatttttaggcagccgtatttttgctaatcgggaaccagaactcccagaaataccagctcttacggaaagacaaggagatcctgtcttaacgatcaattcaaataaagaaaaagtcaatcaaatcatcagctttttccttagtgagtatcaaaaagatagtgatattgaatataaattttatttggaaaatgaagcactactcaatggtactttcgaagtactaggttttcctatcgatttctatttatattttgatccgtatgtgatggaaaacggaaatgtccaactaaaagctagaagtctttctatcggaacattgagtttgccaatcaaagatgtgatgaatatgatcaagagaaactataaattaccagattggatcgaagtcaatacagatgatctgactatcatgcttaggttggatcaattccgaatgcaaaacgggatgtatattaaagcagataaaatcgacttagtaaatgatgacattcggtttagtctatatttgccaaaagatacctctgatgcttcaaacaactcaaataccaacaaaactagcaccagcagtactgaaagcaagacaaaagaaaataaaaaatcatcggatgagtag

SEQ ID NO: 2981 - DNA (genomic), 1008 bp, Enterococcus faecium; double-stranded, circular
  misc_feature (B) LOCATION 1...1008
  hypothetical: NO
  anti-sense: NO
gcagcaaacattcacaaaactaaggaggggcttatggaaagtgtaaagaaacaagaaccatttcaactgacgctatcgaaaaaagaagaaaagctcagaagacgaaaaaaaataattgcaggaatcaaaacgaataaatttttatatgtgatgattctgccgggagtcctttatttcttgatttttaggtatcttcctatggggggactcgttattgcttttcaagattatcaaccatttttaggaataatgggaagtccttgggtcggtttcaaacatttcattcgtttgtttacagaaccgacattctttacattattaagaaatacgttgatcttgttcggattaaatatcttcgtgttttttccgatgccaatcattttgtctttactattaaatgaagtaacgaacaaacgattgaaaaacgggattcaaacgatcatttacatccctcacttcatgtcttgggtaatcattgtttcgattacttatgtatttttgaatgttgacggaggggtattgaatgaattccttgcaacaatgggatttgaaaaaatcagttttctaacatcccctgaatggacacgcacagtatatatcggacaagtgatctggaaagagttgggctggtctacgatcatctacctttcagcgataactgcagtcgatacacagttgtatgaagctgcagaaatggatggagcaggacgcttacgcaaaacatggcatgttacattgccggcaattcgtccagtaatcattaccttgctgattctaaaaatcggtcagacattagacttagggttcgagcatatgtacttgttattgaattcattgaatcgaagcgttgcagaaattttcgacacctatatttatacagctggattgaagaatggacagttaagtttcagtacagcaatgggattgtttaaaggggtcgtaggattgtttatggtaattttagctaataagattgccaaaaagctaggagaagacggcgtttactaa

SEQ ID NO: 2982 - DNA (genomic), 447 bp, Enterococcus faecium; double-stranded, circular
  misc_feature (B) LOCATION 1...447
  hypothetical: NO
  anti-sense: NO
atgaaaaacatttggaaatatggacgtactggcggagagtacgcaggaaaagtattggacgacatgcttgtatccgttccttacacagatcagccaccgcttgaaggaattcgtgctgatggcgaaccgttaacaatcgctgatcaaatgtttgatcctaaattgaatcaatggattattttagcgaacgcactagatcacaacgatttaaacaatctcaaagcaatgtatgagtcgttagaaaatgagaacggcgatttaaaacagatcaatgccaaactcatgctaagcgatgtagcaattaaacaggaaaatactgcattgaaagaaaaagcggatagtttagcacaaatcaattcaaaaatgatgcttgcttcgttacaaaatagcaaagacatttcagaaattaaagagcaactaaatccagcttcaaagggaggtgagtag

SEQ ID NO: 2983 - DNA (genomic), 939 bp, Enterococcus faecium; double-stranded, circular
  misc_feature (B) LOCATION 1...939
  hypothetical: NO
  anti-sense: NO
ggaggaaacattatgatcatcaaatcagaacgtatcagcttaaagcatttattgaccgttgaggcacttactgatcaagaagttatgggcttgatccgcagagggcaggaattcaagcaaggtgctaattggactccgcaaaagcgccagtactttgctacaaacctctttttcgaaaatagtactcgcacacataaaagcttcgatgtagcggagaaaaaactagggctagaagtgattgaatttgaagcaagcacaagctctgtccaaaaaggggaaacactatacgatacagtactgacgatgtcagcattaggcgtagacgtagcggttatccgtcatggtgatgagaactattatgacgaactgatacaaagtaaaacaatccagtgttcgattatcaatggaggagacggaagcggacagcatccaacccaatgcttgcttgatttgatgaccatttatgaagaatttggtcattttgaaggtctgaaagttgccatcgtaggtgatatcactcactctcgcgtagctaaatccaatatgcagatgttaaaacgtctaggcgcacaagtattcttctcaggtcctagagaatggtacgacgatgaattcgaagtgtacggacattatatgccattggatgaactactagatcaagttgatgtcatgatgatgcttcgggtgcaacacgaacgccatgatggaaaagaaagtttctcaaaagaaggctaccatcaggaacatgggttaacagttgagcgtgcgaagaagttgcaaaaacatgcaatcattatgcacccagcaccagttaaccgtgatgtagaattagctgattcattagtggaaggattacagtcgcggatcgttcagcaaatgagcaatggagtattcgtcagaatggcaatcttagaagcagtgctaaatggaaaagcgtaa

SEQ ID NO: 2984 - DNA (genomic), 450 bp, Enterococcus faecium; double-stranded, circular
  misc_feature (B) LOCATION 1...450
  hypothetical: NO
  anti-sense: NO
tccatgaacattttatatatatcgatttcaggaaatacgcgtgcctttgccaaacatctagcagaatatgctgaaaaaatgcatgcagaagatcctgtcaatcctgaagttactttaaaagaaatccatgaaaatagtgattttacgaaagaaacagaaccattttttactttcgttcctacttatttagacggcggaaatggtttagataacggtgatacagaaatcttgaccgaaacgatgcgtgaatatctggaacatgaagacaatcataaactttgtcttggtgtagtcggtagcggaaataaaaacttcaataatcagtattgtctaacagccaaacaatatgcacaaacatttggctttcctttcttggcagattatgaattacggggaacaccatctgatgtgacacgaatttatcagattttagcagaaaacaataaataa

SEQ ID NO: 2985 - DNA (genomic), 2328 bp, Enterococcus faecium; double-stranded, circular
  misc_feature (B) LOCATION 1...2328
  hypothetical: NO
  anti-sense: NO
aaagcgaacatttccgtaaaaaaacgtataactgcacggattttgggacaattatcaaacagatatttgtcccgattcccgttttaccgaaaaaagaaagggggatcgattcctgtgacaaaagaagaaattttaacgggacccggtgtcataaagctcgttagtcaatacatgggtcccgaacatgtagcatttgttgagaaagcatgcgaatacgcgactgctgcacatgacggacagtttagaaaatcaggcgaaccctacattattcatcctatccaagtcgcaggtatattagcagatttaaaaatggatccccatacagtggctacaggcttcttacatgatgttgttgaagatacagaaatcactttagaagatctgagagaagaatttggcgatgacgttgctatgttagtggacggcgtaaccaaattagggaaaataaaatataaatcccacgaagagcagctagcagaaaaccaccgaaagatgctgctagcaatggctcaagatttacgagttatcatggtcaaattagctgatagactacataacatgcgtacgttgaagcacctgcgagaagataagcaaagaaggatcgctcaggaaactttagaaatctatgcgcctcttgcacatcgtctagggatcagccggatcaaatgggaattagaagatacagcacttcgttatctaaatccaaaacagtattaccgtatcgtccacttgatgcagacgaagagagaagaacgtgaaaaatacgtaagtggtactgttgaagatattcgaatagcgacagaagagctggggatttttgcagaaatctatggacggccaaaacacatttattcaatctatcgtaaaatgaaagatcagaaaaagcagttcaacgaaatttatgacttgctagctattcgagtgatcgtagattcaatcaaggattgttatgctgtattaggagcaatccacacaaaatggaaaccaatgcccggcagatttaaggattatattgccatgccaaaagctaatatgtaccaatctttgcatactaccgtgatcggtccggcaggaaatccggtagaaattcaaatccgaacacaggaaatgcatgaaatcgctgaattcggggttgctgcacactgggcctataaagaaggaaaaaatgaaaaagtagaaccagatggtatgacgaaacaattaagctggttccatgagatactcgaacttcaagacgaaagctatgatgcttctgaatttatggaaggcgtaaaaggagatatctttagtgataaagtctacgtcttcacaccaaaaggagacgttactgagttaccaaaaggatccggaccattggactttgcatacagtatccatacagatatcggtaacaaaaccactggtgcaaaagtaaatggcaaaatggtgcagcttgattacaaattgaaaaacggagatatcattgagatcatgacttctccaaattcatttggcccaagtcgcgactggttgaaattagttgctactagcaaagcaagaaataagatcaaacgtttcttcaaagcccaagatcgagaagaaaatgtgatcaaaggccacgaatccgtggtcaaatgtattacagatctaggatttacgcctaaagatattttgacgaagaacaaactgcaagaagcactcgatcgttttaattatcaaacagaagatgatctctatgcagctgtagggtatggagaagttagccccttgacgatggccaatcgtctgactgaaaaagaacgtaaagaacaaaaaatcgagcagcaaaagcaagaagcagaagaaatcatgaatcagccgaaaaaagaacctgacaaaatgaaagtacgtcatgaaggtggcgttgtcattcaaggggtagaaaacttactaattcgtatcagtcgctgctgtaatccgattcctggtgatgatatcgttggttatatcactaaaggcagagggatatccattcatcgtcgagattgtccgaatgttcagcctgacaaaccaaatgtagcagaacgtttgattgaagtcgaatgggaagatacatcgaatacacgaaaagagtatgatgcagatttggaaatttacggctataatcgttcaggcttattgaatgatgtacttcaaacagtcaatgcgctaacgaaaaatctcaacagcgttgaagcacggacgaataaagataaaatggcgacgatccatttgacggttggtatccagaatttatcccacctaaagagtatcgtggataaaatcaaagcagtacctgatgtctacagtgtacgccggacgaatggatag

SEQ ID NO: 2986 - DNA (genomic), 1896 bp, Enterococcus faecium; double-stranded, circular
  misc_feature (B) LOCATION 1...1896
  hypothetical: NO
  anti-sense: NO
ggagggaacatgttgaaagaattaaaagtaactgacctcaaaaaaacttatggtgaaaaagatttgtttgaccagatttcttttttggtccacgaaaaagaccgtatcgggttgattgggacgaacgggacgggtaaaacaagtctcttaaatattattgccggtatcgatagcagcgacggtgatcggcaaacagtgttttatccaactgattaccgtattggttatctttctcaagcagctgaattttccgatgaattaactgttctccaagcagtctttcaaggaaacagccccttgatccaaactgttcgagcatatgaggaagcattgatcgaactaggggaaaacggagaagaccctgatgtgcaaaaacgttatgctaaagcagaagaacaaatgaataaagaagatgcttggactacagataccaacgcaaagattattttgcaaaaattaggaatcagtgaattagataaaaaaatcagtactttatcaggtggtcagaaaaaacgagttagtctggcgcaagtgttgattgatgaacccgatttactattactagacgaaccaacaaaccatttagattatgaagcgatcgagtggttggaaaactatttgaaacaataccgtggcgcactattgatggttacccacgatcgttattttctagatagagtagcaaaccgaatcttcgaactttcatttggaaaattatacgagtataaaggaaattatgaagcttacgtcttagaaaaagcagaacgtgatcgtgtagaagtagaacaagaagaaaagcgcaagcggctttataaacaggaattagcttggatgagggctggcgtacaggcacgtggcaccaagcagcaagcacggatcaaccgtttcgaagatctaaaggagaacttgtaccaagtaaaccaagaagatgatttagagctgaacctagcgacacaacgtttagggaaaaaagtactggaaatcaaagatggcagttaccgtataaatgaccaaacactgctagaacatttagatttattgattcaatctcgggaaagactaggtattactggtaaaaatggtgcgggaaaatcgacattgcttaatattctagctggcagaattcccctggatagcggtacaatgtctatcggtgaaacggttcatcttgcgtattatacacaagaaaatgaagaaatggcaccagataaacggatgattgcttacttacaagaagctgctgaagaagcaaaaacagcagatggcagtcaaatcggagtagcagaattacttgaacgatttttatttccaagatttatgcatgggacactgataggcaaactttcaggcggagaaaaacgccggttatttttgttgaaactgctgattcagcaacctaatgttttattattggatgaaccgaccaatgatttggacatagcaacattgacgattttggaagattattttagaagttttccaggtgctgtgatcactgtttcccatgaccgttatttcttggacaaggtagcagataagttattagtattccaaggaaacggaaaacaagaactttattacggaaacatgtccagttatttactgaagcaaaaagagacccagcagcctgctgaaaaagcgaaaccaaaaatacagagcaaggaacctgctgaaaagaagaaattatcttacatggaacaaaaagaatgggaaacgattgaagatgagattgcagaacttgaagaaaaaatctcattgctccaagaagagatgaatcatcaaggagataatttcactcgattacaagaattgcaaaacgacgtatctgaaacagaagcacaacttgaagaaaaaatggcacggtgggaatacttgagtgaatgggtagaagattan

SEQ ID NO: 2987 - DNA (genomic), 549 bp, Enterococcus faecium; double-stranded, circular
  misc_feature (B) LOCATION 1...549
  hypothetical: NO
  anti-sense: NO
ttggctgacatcaaaggacttgatatttttgggaacaataaaggactcgccaaaataaaaaaagaagcagaagcaaagaaaaagcagcaagcaattacaccatctgaaaataagcaattagaagtgcaccaagttcaagaaataaaaacttcctccaatgttgaaagacagagtagaggaagaacaaaaaaagttggcgcaccaatcagaaagtttgataaggtttattccaccaagcatcctttaaaactgtcgactttgttaaatgcgacttccagagttttagtagaaaagtatgagactaatatgacaagagatgaattgcttagaaaagctttagatgagtatattaaacagaatcttacgcaagaagataagcaagatttgtttaatgacgtggtgaaagaactagacttgttcagagaaaaatatccaattgttccagaattagatgatcgtggagaaataataagaactaccagtcagataaaacaagataccgaagactcactgcgcaaagggtggggaatgaataataaagttagataa

SEQ ID NO: 2988 - DNA (genomic), 1251 bp, Enterococcus faecium; double-stranded, circular
  misc_feature (B) LOCATION 1...1251
  hypothetical: NO
  anti-sense: NO
agtagagacattcatgtaagaatcgagaacagattcaacaaggaggaattttttatggatcataaaccgactgaaacaaaagatgttacaccagttaacgatacacttgaagatttattgaacaacccgttttcaactccaacagatacgctgaccacttcacaacaagcggagattgatcagctccaagagcaacagacagctgctcgtttaattgacaaactaccggcggaacgccaagaacaagctaaacagctagcagcaaaaatcgatgctaatgatgcacagtctgtcatcagctacggatcggctgcccaagcaaaattaagtgaattctcacaatcgatgttgaatcatgtgcaagcacaagatattggtcctgtaggagattccttaactgaactgatgtatcgtctccaagaagccaatcctgacgaactgcgtgccggagaagggaacatcttccagcgtgtcttcgggaaggtcaaacaatcgatctatgaagtgacagcaaaatatcaaaagattggtgcacaaattgacaagatttcagtgaaattagataaagaaaaagacggtctgctaaaagataatctgatgttagaacagctttaccagaaaaacaaagactactttgatgcactgaatatttatatcgctgctggagaattgaaaatggaagaacttcaaacaacgatcattccagaagcgatgaaaagagcagaagaaactggcgatcagatggatgttcagattgccaatgattacacgcaattcctagatcgtctggataaacgtacgcatgatcttcgcttagctagacagatcacgatccagcaagcaccacaaatccgtttgatccaaaacacaaatcaggccttggctgaaaagatccaagcatctatcgctacagccattccgctgtggaaaaaccaagtcgtgatcgcattgaccttgcttcgtcaaaaagatgcagtaactgctcaacgccaagtctctgaaacaacaaacgacttattgaagaaaaattcagaaatgctgaaaatctcagccatcgaaacagcgaaagaaaatgaacgtggaatcgtggatatcgagacccttcaaaccactcaaaatgatttgatcgaaacaatccaagagacattgcgtatccaaaaagaaggaaaagaaaaacgtcgtcatgcagaagtagagcttggacacatggaagaagatctgaaacaaaaactgttggatttaacccaatag

SEQ ID NO: 2989 - DNA (genomic), 951 bp, Enterococcus faecium; double-stranded, circular
  misc_feature (B) LOCATION 1...951
  hypothetical: NO
  anti-sense: NO
cgattctgcattattctaaggaggaaaaaaatgaaaaaaaagaaagtggagagagtccaagtccgctctttcaataagacggctaattttttctctaatataatgattgcactctttgctatttcctgtattttgccatttatatttgttatcgccatctcttttaccgatgagtccatattgtcgactcacgggtacagtttttggccagaaaagttcagtatatttggttatacgtacttgttcgaccagatgcaggataaaattttccaagcgcttttcgtcactgtacttgttactgttttaggtacactgatcaatagcacggctacttctttatatgcttatgcgatttcacggtcaaactttccattccgtcgtttttttaccgttttttgtttgattacgatgttgttctcaccagggatggtggccaattatcttgttatgacaaatcttcttcagttaaaagatacgatttgggcattgatcttgccaatggctgtcagtcccttcaatattattgtgatgcgcacattctttaaacgttcggtctctgattcgattattgaatcggcacggatcgatggagctagcgaactgcgaatatttgttcagatcgttttaccgttagctgttccaggtattgcgacaatcagtttatttgccgcattgggttactggaatgactggttcaatgctttactatacatccaagatgataagctagttccactacagtatcttttgatgaaaatccaaagtaatattcaatatctgacacaaaattcaggagcaggaagccaattgacaggcggattagcctcagttccaggagaatctgccagaatggcgatcgtagtcatctcgacgttgcctattgcgatcagctatccatttttccagaagcattttgtcaaaggtctaacaatcggcggagtaaaagaataa

SEQ ID NO: 2990 - DNA (genomic), 1449 bp, Enterococcus faecium; double-stranded, circular
  misc_feature (B) LOCATION 1...1449
  hypothetical: NO
  anti-sense: NO
ctgtcatgcatttattcgtacaggcgaaatgaacacttacgccaatattatattagtgagtggagtggtcttctaatggaaacgacaatgaatcctgaacagatggtactgtccgagcagatgcatatgctgattgaacagttgggaggaaaagaaaatattgattctgtccttccatgtgcgactcggcttcgtatcaaattgaaaaaacagccagtagccaatgcagaaaaattaaaacagcaaatcccttccattaagtatttcattttactcgatagatatgcagaaataatcatggatcagggattggctcctgcttacaaggaattgacgcgtcaaatcgatcattcagctccgaaagaaaagctaaatccgatcgaaaaactatttggtttgatatcggaaatctttacgccgatcattccgctgtttgccggttctggtatattaaaaggtctggttgttttagcgactacgattggctggcttagtgaaacaagcggaacttatcatattttgtctgctgcgtcgaatgccgtcttttattttctgccaatctttcttgctttttctgctgccaaaacgtttaaagtgaatggatatattgcggctgtcattgctgcagcactgattgaaccgaatctgacctctttactttcagacagtggcaaagcagctactgattttctggggattcctgtagtactgatgcagtatacgtctactgtcatgccggcgattttaggtattttcttttattcttttgttgaaaaattcctcaaaaaatatattcgcgaaaatatgcaattagtatttgtacctttactttcattagttatcacggttcctttgacgttaatggtattcgggcctgcgggtgtttaccttggcgaaggtttagctgccgcaattacttggatgatggatattaacggaccgatcagtggcgcaatcatcgctggtggttggaatattttggtaatatttggtatccaatgggctgtaaaccctgtcatgatcagtaatatctctgcttatgggttcgaccgaatcgttccgttgacaggagcagccaattttggaatggctggtgcagctttaggtgtatttctgcgaagtaaacgttcaaaaacccgttcgatctccggttctgcttttgcttcgattttacttgcgggagtgaccgaaccaactgtttacggaattgcgatcccattgaaaaaaccatttgttgctgcttgcattggtgcagctgctggtggagctgtaatgggatttgcccaagtgaaagcgatcgcttttgtatttggtagtctgaccacattgcctgcattcatttccggtacttttttctggtacttagcaggactggctgttagtctagtcgtagcaatgatcactactctcgttagcgggtttgatgaagacctaatgtcttatgaatag

SEQ ID NO: 2991 - DNA (genomic), 1080 bp, Enterococcus faecium; double-stranded, circular
  misc_feature (B) LOCATION 1...1080
  hypothetical: NO
  anti-sense: NO
cccggacgcatcacggaagcaaaactaccggtattattagtaggtatgcggggatcaancgaaaaagatacattagctatccgacaattagttgaaaagacagcattgcctgttgtagagacattccaagcagcaggagtgatctcacgtgaattagaagcgcatttctttggtcgtgtgggattgtttagaaaccaaccaggcgatatgcttttgaaacgaagcgacctagtcatcgcaattggctatgatccaatcgaatatgaagcaagaaactggaacgcagaaaaagatgcgcggatcattgtgatcgatgaagcaccagctgaaatcgatccgtttatgcagcctgaaagagagttgattggcgatatctcagctactcttgatttattgacaggttcattagagcctcaacaagtgtcagaagatgcgaaagaatatttagcttctcttcaagcaaaactaacggagcgggatattgtccaatcaaaaggagaagcaggtattttgcatcctttagaagtcatcaacacacttcaatcaaaactaacagatgatatgaccgttactgtagatgtagggagtcattatatttggatggcacgccactttagaagttatgaaccccgacatctgttattcagtaatggtatgcaaacgcttggtgtagcattaccatgggcaatttctgctgcactggtacgtccaaatacacaaatcgtatcagtttccggagatggcggatttttattctctgcccaagatttagaaacggccgtacgtaaaaaattgaatatcgttcatttgatttggaatgatggacgctacaatatggtagagtttcaagaaaaaatgaaatatcaacgggcgtcaggtgtagactttggtccagttgattttgtgaaatatgcagaagcttttggtgctaaagggatccgagctacaagtgtagaggaattagaaaaagctttagaagaaggttttgcgacagaaggacccgtaattattgatattccgatcgattaccgtgataatgagaaattgggagaaacaatcttaccagatcaattctattaa

SEQ ID NO: 2992 - DNA (genomic), 537 bp, Enterococcus faecium; double-stranded, circular
  misc_feature (B) LOCATION 1...537
  hypothetical: NO
  anti-sense: NO
ggagacagcatgttttcaaattacaaaccaacatggatggtagaagccatctatcagattacacctgcccaattaaagaatctaggcatcaaagcagtattgaccgatttagacaatacgttgattgcatggaataatccagatggaacagaagagttgcttacttggattttagaaatgaaaaatgcaggaatccctgttgttgttgtttcaaacaataattcaaaacgtgtcgcgcgagcgattgaaaaatttgatcttttgtatgttgcacgagcaatgaaacctttagcaagagggatcaacatagcaaagaaacaattggatttagcagatgatgagatagtaatggtaggcgatcagattatgactgatatacgtggagccaatcgtgcagggatacgtagcatccttgtaaaacccattatcgcaacagatagttggaagacacaatttaatcgtttttgggaaaaaagaattatggcctatctattagcaaaacaccctgatatgggctggcgaggtggaatcgaatga

SEQ ID NO: 2993 - DNA (genomic), 276 bp, Enterococcus faecium; double-stranded, circular
  misc_feature (B) LOCATION 1...276
  hypothetical: NO
  anti-sense: NO
aaacctggcatgggaactggctttatagacagagtgctagtgcaagtaaaggaagaaaggaagatcaccatgaaatacaatttattagaccataagcgaatgtgggtagagaaattagaggaagacttagaacagttggaattgttaggtcataataagacttcaacggtgtataaagaaggactaaaacgaacgaaaaaagcacaaaaagaactagcaacactggaaagtagggttcagaaaaaagaagtagacttaacacacacttacctttag

SEQ ID NO: 2994 - DNA (genomic), 243 bp, Enterococcus faecium; double-stranded, circular
  misc_feature (B) LOCATION 1...243
  hypothetical: NO
  anti-sense: NO
atgaatggcattcggagtttatctgaattcggtaacccgagatgggcccctagtccaaacagtgctctacctccatcattctcaattccgaggctagccctaaagctatttcggagagaaccagctatctccaagttcgtttggaatttctccgctacccacacctcatccccgcacttttcaacgtacgtgggttcggtcctccagtgcgttttaccgcaccttcaacctggacatgggtag

SEQ ID NO: 2995 - DNA (genomic), 243 bp, Enterococcus faecium; double-stranded, circular; identical to SEQ ID NO: 2994
  misc_feature (B) LOCATION 1...243
  hypothetical: NO
  anti-sense: NO

SEQ ID NO: 2996 - DNA (genomic), 234 bp, Enterococcus faecium; double-stranded, circular
  misc_feature (B) LOCATION 1...234
  hypothetical: NO
  anti-sense: NO
aaaataggcattaattcatttaattcggtcacaacacgttaccttttaaatcattatactgtatctcatacattattatcaataaactattataaaaatgcaaaaaatgctttatcaatctattttgtaattggtcataatatcattgaaatcataccctgtatcgatttttcctatgaatctcgtctatttgtgattgacgaaaaagaggcaagacagacactggaatggtaa

SEQ ID NO: 2997 - DNA (genomic), 1119 bp, Enterococcus faecium; double-stranded, circular
  misc_feature (B) LOCATION 1...1119
  hypothetical: NO
  anti-sense: NO
agagaaggcattgagatggaaaaaacatatcaagcaggtacaaatgaaggaatagtagattttatcaatatggaagatttagaaatcgcggcttcacaagtgattccagctggtggttatggttacatcagcagtggtgctggcgacttatttacttatcaagaaaatgaacgggcattcaatcatcgtttgattattcctcatgtattaagagatgtagaattacccgatacaactacacattttgacgaagaaatgctgactgcaccaatcatcatggcaccagttgctgctcatggattagctcatgtgaaggcggagaaagcttctgcaaaaggtgtagcagattttgggacgatctatacagcaagttcttacgcttcttgtactttagaagagataagagaagcaggcggggagaaagcaccgcaatggtttcaattttatatgagcaaagataatggaatcaatttggatattcttgaagtggccaagcgtaatggagcaaaagcaatcgtattgacagcggatgcaacagttggcggaaaccgtgaaacagaccgcagaaacgggtttaccttcccgctgccaatgccgatcgttcaggcttatcaatcaggagtaggccaaacgatggatgctgtatataaatcttccaaacaaaaacttagtccaaaagatgtagaatttatcgctgctcattctgatttgccagtctacgtgaaaggtgttcaatcagaagaagatgtctatcgatcattagaatctggtgctggtggaatttgggtatctaaccatggtggccgtcaattagatggggggcctgctgcgtttgattcgttgcaatatgtggcagaagcagtagataaacgtgtaccaatcgtgtttgacagcggtgtacgacgtggacaacatgttttcaaagcaatcgcatcaggtgccgatcttgttgctattggcagacccgttatttatggattgtctttaggaggaagtacaggagtccatcaagtgtttgatttctttaaaacagaattggaaatggtcatgcaattagctggaacacaaacagtagaagatatcaaaaaaataaaattgcgtgagaatcgttttatttaa

SEQ ID NO: 2998 - DNA (genomic), 1356 bp, Enterococcus faecium; double-stranded, circular
  misc_feature (B) LOCATION 1...1356
  hypothetical: NO
  anti-sense: NO
agtggaggcattataaatatgtatgatattttgacatttggcgcatcaattgatgaattgaatactgaagcaatacaacaagccattgatgctgcagcaagtgacggaggcgggaccgtagttgttccagcaggtgaatttctaacaggagctttatttttaaaaagcaatgtcgaacttcatttaagcgcaggagcggttctgaaattctctgacgatccaaaagattatcctgttgttcattcacgttgggaaggagtccatcgaaaagtttatgcttcctgtatctatgctcaaaatgtagagaacatctctgtcactggtttcggtacattagatggaaatggaaaaaaatggtggcatacttttagaaatgaaccagataatctcgcttatcctcgtcctaaattgatgagtttccataactgtcatcgaattactgtgaaagatattaaattgatccagtcaccaagttggacgatcaacccgattctttgcagtaatgcaacgtttgataacttgacgatcttgaacccagcggattcaccaaatacagacggaattgatccagaatcatgcaaaaatgtgcgtattagtaattgccatattgacgtgggagatgactgtattgcaatcaaggcagggactgaagatacgtacgaaaggatcgcttgcgaaaatatcacgatcacaaattgcacgatggtccatggacatggcggtgtcgtattaggaagtgaaatgagtggtagtattcgtaatattaccatttcaaattgtatcttccaagaaactgatcgaggaatacgattgaaatctagacgaggtcgaggcgggatcgttgaagatattcgagtatccaatatagtcatggataatgtgatgtgtccatttatactgaatctttattatttctgtggtccgcgagggaaagaaccgtatgtatgggaaaaaaaggcttatccgatagatgaacggacaccagcattcagaaggatccatttttcgaatatcacggcaaggaatgtccatgcttctgcaggttttatttatggattagcggaacaattcatacaagaaatcacatttgacaatatcgatgtctcgatggcccaagatgcagttcccggtgttcctgctatgatgacaggaatagaggaaatgagcagacaaggattttatattggctttgcgggtaaggtttcctttaaccagatgtcgattgaaaatcacgagggaccagcatttctattagaaaatactaaagaaatcagtattgagaaattccaatcaaatcaatcagaaaatatggatgaactggttgttcgtaaaaactttgcttatgcagttgaatga

SEQ ID NO: 2999 - DNA (genomic), 528 bp, Enterococcus faecium; double-stranded, circular
  misc_feature (B) LOCATION 1...528
  hypothetical: NO
  anti-sense: NO
gaaggaggcatagtaatgactgatatattgacaatcaaaaatggcagaaaagtcgtaaacaatggaatgaatgaagagaaagtactattggatgaaattaaccttacaatcagagaaggggacttcatcactgtccttggcgggaatggtgctggaaaaagcacactgttcaatacgatcgctggtacgcttcaactcagtcaaggatcgatctcttttaaagatcagctgatcacaaaagattcagaagaaaaaagagcacgattcctttctcgagttttccaagaccccaagatgggaacggctcctcggatgacagtagcagaaaatttgctacttgcacaaaaaagaggtcaaaaacggaaattccgtttacgtaacttgaaaaatcaaaaagaagattttttcagactatgtcaagaagtcggtaatggcctagagcaacacttggatactccaccgggtgaattattctggtggtcaacgccaagcattaagcttgctgatggcgacgatcacagctcctga

SEQ ID NO: 3000 - DNA (genomic), 201 bp, Enterococcus faecium; double-stranded, circular
  misc_feature (B) LOCATION 1...201
  hypothetical: NO
  anti-sense: NO
atatttttaatttttggcatcgttccattcctccctgtacttgagaaaagctactttaatagtaccgcgcttgtactgtttattccgcaacttgaatgtgaaaaagatgttcaattactcgggatggcaccacaccaacttggcgattattataaaaatcaataccttcaatccttgcaagatatgccttgctctctttaa

SEQ ID NO: 3001 - DNA (genomic), 516 bp, Enterococcus faecium; double-stranded, circular
  misc_feature (B) LOCATION 1...516
  hypothetical: NO
  anti-sense: NO
atgattttaatacatgatttatttcacaagagaggaatcaatatgcagaccttagcgcaggcaaagcagaatttcgtttatcaagtcgaacgaatcgaaacagaagaaaaaacaaaacgccatttgcaaaatatcgggatcgttgccggaagtaaaatcgtcgtcgtcaatttatcaggcaacaatgccattttactggtaaaaagtcatcgagtggcagtaagtcgggaaatactaggtcaaatctttgtcaataaaaagactgcttcctctgaaagctggacttctcttgatcaattaaaagcaggagagactgggatcgtcgtagcaatccacggacaaggcgcagtgaagcgacggttaatggatatgggattgacgcgaaatgtaaaaatagttatccgaaaactagcccctctgggagatccaatcgaactgacagtgcgagggtatgaactgacgttacgaaagtcagaggccgaactaatcttgatacaaagggaggaaaaagaatga

SEQ ID NO: 3002 - DNA (genomic), 1890 bp, Enterococcus faecium; double-stranded, circular
  misc_feature (B) LOCATION 1...1890
  hypothetical: NO
  anti-sense: NO
gtctatttaataacaatgaatgttgaaacagatgaagttcaaggatctggtaagaacgtgggaaaatccgttatggaggtgccacgcttgaacacaaaaatacgttactgggaatattatgatctacaagaaacattcgatcagctatttactcaaagtagaaacgggaaaaagttttatcaattatatgagttaatcatttctgaaaataatattcttttagcataccgtactatcaaggcaaacaaggggtcttcgacaccaggaacggattccttcacaattgataactataaggaaatgaaccaagcagagtttatccatcttattctcagtcatttagaaaattacaaaccaaaatccataaagcgagtaatgatacctaaacccaatggtgagaaacgcccattaggaattccatgcatgattgatcgaatgatccaacagatgttcaagcagatactggagccaatatgtgaagctaagttttatgaacatagctacggtttcagaccattgagaagtgcaaagcatgctctaggtcgcattatgtatctcataaacatcagtaaaatgcactatgcagtagacattgatatcaaaggtttctttgataatgtaaaccaccgtttactgataaaacaattatggaatataggaatttgtgacaaacaagtcttagctattctttcaaaatctctgaaatcacccattcaaggagaaggtatcccgagcaaaggaacgatccaaggaggtatcatttctccactattatctaatgttgttctaaacgacttagaccattgggtctcaaagcagtggcatacctttgaaacaaagtatccctatactaaaggttacaataaatttcgtgctctaagagatacaaatctaaagcaaggctatattgtcaggtacgcagatgactttaaaatcatgactaatgattatccgacagcattaaaatggttccacgctgtcaagctttacctaaaagacagacttaaattagatatttccaatgagaagtctaaaatcgtcaatttgcgtaaatgtaagtcggaatttttaggattcgctatttgcgtgaaacaaaaagggaaaaaatgggtttgtaattcacgtatttctaacaaaaaaaaggatcagattaaagaagagattaaacaaagaatcaaagatattcaaaagagtcctacagcacaaaatgctctcctgtttaatgctctcgtgctcggtgttcataattatttcaggtatgccactcatattaatttagatttgaataggatgaactacgttctttcattcactacttacaaccgattatcaaattgtagtacaagatgttaccccaacaaagcttccccaacttacaaaaagttttactcaacaacgatgaaaacgtataaagtagctggagtctatttgtaccctctttgcgacgtatctacaaaaacaatttacggatttaatacggaggatacaccgtttactccgtttggtcgtcaaagattggagcacaaaagcctacagtctcttgtgttccaagaattaagaaaattgatggaatcgaaaataccgaatagaacggttgagtatttagatagtagaatatctcgttactcaatgaaatcaggcaagtgtgagattacaaaacaatttttgccagcaaaagccgttcactgtcatcactatttgccaaaaagtcttggtggagacgacaaattcgataacttgagaattattcataaggatatccatcttctgatccatacaacaaataaaatgataatcgatcactacgtgcatgaactgaaactggtgccagagcaaatagcaaaaatcaacctttatcgaaagatgtgtaatctgcaaaacattcaatag

SEQ ID NO: 3003 - DNA (genomic), 600 bp, Enterococcus faecium; double-stranded, circular
  misc_feature (B) LOCATION 1...600
  hypothetical: NO
  anti-sense: NO
ggatatttaatggaacaatttggaatgattactgcaacagccagcgtccttcctgaaaagattattactaataatgatctttccaagatgatggatacctctgatgaatggatttcgtcaaggacgggtattcgtgaacgaagatgtgtaacaaatcaggagacttctgatttatgcattttagtggcggaaaaattgataaaacagaaaaatctaaaccctaaagatttggattttattttagtagcaacaatgtcgcccgattacacgacaccatctgtagcagcacaagtacaagggaaattgggagcaactcatgctatcgcttttgatatcagtgctgcgtgctcaggatttgtttatgcgttaagcatggctgaaaaaatgatccgctgcggctcaactaagggactggtgattggtggtgaaacactatctaagctaatcgattggtctgatcgtacgactgctgtgttgtttggcgatggaacaggtgggattctcttagaagcgaatccacagaaaaaattgctgaaagaaaaattagcagctgacggtaccagaagtagctcattgaccgctgggctaccagcaaaataa

SEQ ID NO: 3004 - DNA (genomic), 1326 bp, Enterococcus faecium; double-stranded, circular
  misc_feature (B) LOCATION 1...1326
  hypothetical: NO
  anti-sense: NO
gaggacttaattatgtccatgtttttagatcaagtaacgatcgatgtgaaagctggcaagggcggagacggaatggttgcatttcgtcgcgaaaaatacgttcctgacggcggaccggctggcggagacggtggtcgtggcggcgatgtcatcttgatcgtcgatgaagggttacgtacattgatggattttcggttcaatcgccatttcaaagcgcagccaggtgaaaatgggatgagtaaagggatgcacggtcgtggttcagaacatacctatgttaaagtaccacaaggaaccactgtccgagatgcggagactggtgctcttttaggagatttaattgaaaatggtcaaacactagttgtggcaaaaggtggacgcggtggacgagggaatatccgttttgcctctcctcggaatcctgcaccggaaattgctgaaaacggtgaaccaggacaagagcgaaaaatcgaactagaattgaaagtattggcagacgttggacttgtaggttttccatctgtcgggaaatcgactttactatccgttatttcatctgctcgtccaaaaatcggcgcttatcatttcacgacgctcgtacctaatctaggaatggttactacaagtgatggcagaagttttgccgcagcagacttgccaggcttgattgaaggagcttcgcaaggtgttgggctgggtacacaattccttcgtcatatcgaaagaacacgagtaattttacatgtgatcgatatgagtgggatggaaggacgagatccttatgaagactatcttgccatcaacaaagaattatctacttataacttacgcttgctagagcgtccgcaaatcatcgtggcaaacaaaatggatatgccggatgcaccggaaaatctagtgaaattcaaagaacagctgaacaaggaaaaagaagatgaatttgctgatgacatcccagtatttccaatttctggagtgactcgacaaggattggacgcgttattgaatgctacagcagatttgttagaagtaacgccagaattcccattgtacgaagaagaactggaagaagaaactgtacactatggattcaatccagaaggtcctgagttccaaatcgatcgtgattcagatgcaacgtggatcttatctggtgagaagatcgaaaaattattccaaatgacgaatttcgatcatgatgaaacagtgatgcgttttgctcgtcaattacgtggtatgggtgtggatgaagctcttcgggcacgcggtgcgaaagatggcgaccttgtacgtatcggtgagtttgaatttgaatttgtcgaatag

SEQ ID NO: 3005 - DNA (genomic), 429 bp, Enterococcus faecium; double-stranded, circular
  misc_feature (B) LOCATION 1...429
  hypothetical: NO
  anti-sense: NO
aggctattaattttttcaaaggagaagctcatggcagaactcaaacaagaatggatcaacacagctattgaagcgttagataaagcctatgttccttattcccattttccggtaggcgcttgtctcgtaacggaatcaggcaagatttatcaaggcatcaacattgagaatgcatcatttggattaacgaattgtgccgagcgcacagcttttttcaaagcagtatctgaaggagaaaaaacatttacgcatctagtcgtagcggggcacacccccgatcctatctctccttgtggtgcatgtcgacaagtaatggcagaattctgttcccctgatatgccggttacgctagtaggagacaatggtgtgacgaaggcaacgaccgttcgtgcactgctgccttatgcatttactgaaaaagatctataa

SEQ ID NO: 3006 - DNA (genomic), 1122 bp, Enterococcus faecium; double-stranded, circular
  misc_feature (B) LOCATION 1...1122
  hypothetical: NO
  anti-sense: NO
tacacattaatatttacttgtaagttggaacaacgatatggggggagcaagcaaatgagtaaaactgtcaatgaagtaacaaaagaaaagtggttagtagaaacatttcctgagtggggcacatacttgaatgaagaaatcgaaacagaagtagtggatcctggaacttttgctatgtggtggctgggctgtacgggaatttggctgaaaagtcatgaaggaacgaatattttatgtgatctatggtgtgggacgggaaaacgtagtcatgggaatggcatgatgaaaaaaggccatcagatgatgcgtatgagtggcgttcaaaatatgcagcctaatttacgtactcagcctttcgtaatcgatccttttgcgataaaaaatgtagacgctttaatcgttacacatatccattccgatcatctagatatccatacagccgcagcagttcatcaaaattgtcctgaagcaacattcattgggccaaaagaagtggttcgcacgtggcaaaaatggggaattcctgaagaaaaaacgattacagtaaagccaggtgatgcagtcaaaatcaaagacatcaatgtagtagctttagaagcgtttgatcggacagcgttggtcacttgtgaagatccagaagaggtattaaaaggaaaaatgcctcaggagatggatcaaattgcagtaaactatttattcgaaacatcaggagggaatctttatcatgcaggagattcacattactccaatttatttgccaaacatggtaatgaacacaaaatcgatgtctgtttaggggcctatggtgaaaacccacgagggataacagacaaagttacttctgttgatatgctgcgcatggcggagtcattgaatgcaaaagtagtgattcctgtccactacgatatttggtctaattttatggctgatccaaaagagatcactgaaatttggaaattcaaaaaggatcgcctgaagtatggatttaaaccttatatctggcaagtaggcgggaaattcatctatccgacaaacaaagatgatcttgagtttaatttttatcgaggatttgaagatgtcttctcgattgaaaatgatacaccgtttccgtcgtttttataa

SEQ ID NO: 3007 - DNA (genomic), 453 bp, Enterococcus faecium; double-stranded, circular
  misc_feature (B) LOCATION 1...453
  hypothetical: NO
  anti-sense: NO
catttactaatccataacggaggaaatcaaatgaaaaaaatctatttcttatgtacgggcaattcatgccgcagtcaaatagcagaaggctacgcgcgtaaatacttgtctccttcaatgtttgagataagaagtgcggggatcgagacacatggcttgaatccaagagctataaaaatcatggcagaagacggcatcgatatttccaaacagacgtctgatttgattgatagagattactttactcaggcagacttgatcattacactttgtggtgatgccaaagacaagtgccctgccgttccaaacaatcacgaacaccttcactgggacctaaaagatcctgcacaagctgtcgggagcgaagaagaaatattaacggaattcagaaaagtcagagaaggaatcaaaagaaaagttttagacttaaatcaacgtacatcgatcgtataa

SEQ ID NO: 3008 - DNA (genomic), 768 bp, Enterococcus faecium; double-stranded, circular
  misc_feature (B) LOCATION 1...768
  hypothetical: NO
  anti-sense: NO
ggtatactaattttaggaggtgtggtcaatatgataaaacgtccaccaataaattatttagaacgaaaaaagatactcggaacaaaaataaaagctataagagagagtaaaaatatttttacacaaccagcatttggtcttatgattaacaacggtcaattaattgacaaaaagactatctacgaatgggagaagggaacctatttaccaataccagagcgattctcccgaattgctgatttgggaaatatgagtatagaggagttagtttgtggcaatgtagaagaatatattttgggaattattctttatagagatagcattgtactagatggtataacatttccagataaaaacctgttccagcatcttcgtcaacagttcccaccagtacactctaatttagatacatggctggatagatattccaaattagaaccagagatgcaagaatttattgctaacaagacttgtaataaagttaaaaatgaaaaaattagtcttttcaatatcttaaaaatagaagaattattcatcaatgctattgtagaagaatttgacaataacattcttttcctcactagcagtatagaagaactactagaaagaatggtagatgaatggctacctattcaattgaaagacatgtcttatcccgaagaagctgtgagagaaattactgataatataaacaagctagaacaaacgatttcatcaattgggaaaaaatacactaagaaaaaaatgaagggaggtgataccatctag

SEQ ID NO: 3009 - DNA (genomic), 186 bp, Enterococcus faecium; double-stranded, circular
  misc_feature (B) LOCATION 1...186
  hypothetical: NO
  anti-sense: NO
atgaaactaattttcgttctttatgccatgcacaccataattccaagacagccaatgaaagacaaagacgagaaaagagtaccctttgagttaagggggcatagtgtgaaacttactgacaatcgatgcctactcattttggtacaaataaccgttgtgaaaaggcataagggtaattacaaataa

SEQ ID NO: 3010 - DNA (genomic), 897 bp, Enterococcus faecium; double-stranded, circular
  misc_feature (B) LOCATION 1...897
  hypothetical: NO
  anti-sense: NO
gacaagctaattttgaaccagtcctttcaatccgtaccggcgggtgagaccagtaaatctttagaacaagcagctgagttatacgattttttagcagataatgattttacccgcagcgatgggatacttgcacttggtggaggaatggtgggtgatctagcagcattcgtggcctcgacgttcatgcgtgggatccatttcgttcaaattccgactacgctacttgcacaagtagattctagtattggcgggaagacagcagtcaatacaaacaaagcgaaaaaccttgtcggaacatttagccagccagctggtgtattgattgatcctgaggttctaaaaactttgccggtacgtcgtttacgagaaggaatcgctgaaatcatcaaatcagcagctatagcagatgcaacgctttggaaacagctgaacgagctgaaagacgaaaaagatcttctggaacatgctgttccaatcattactgctacgttggaaatcaaacgaaaagtagtggaagaagatgtctttgaccaaggaaatcgacttattttaaattttggtcatacaattggccatgcaattgaaaatacagcaggatatggggtagtcagtcatggagaaggagtagctattggaatggtagccatcacttctcatgcagaaaaaatcggcttgtctccaactggatcgacagctgctttagaaaggatacttcaaaaattccatctgccgattacgtacgatctaagtcatccagatgaattattccacgcgataacccatgataagaaagcaagaggaagccaattgaatatcatcttgctagaaaagattgggcaagcaaaaatcgttcctgttcccacagagacattcaaagattacttaggaggactgtaa

SEQ ID NO: 3011 - DNA (genomic), 492 bp, Enterococcus faecium; double-stranded, circular
  misc_feature (B) LOCATION 1...492
  hypothetical: NO
  anti-sense: NO
atagttataataaacctcagaataaatttgaactatatatattataaaagtttaaaattacgggaggctctacaaatgaacggttttgaaaagagagcacaagagaaaaagaaagagattttacaagcagcttttgacttgatgaacacagacataggaaccgctggagtgacaatggataaggtagctgagaacgctcaggtaagtaaagcgacgatttttaaatattttggcagcaaggaagggctgatttatgaagtattttttgcatttatgaatgatttagggcaagaagcgaaagcgttgattgcggaaaatcttccatttgaagaaacactgattgccatgagtgaaaacaaaatccgttatctcaatcgagtgaacaaacaattttatatcgatttgatgacatactatacaaaaaaagaaaaaaaagaattttctgatccgcgatggatgcgtataccaagaaagtttcagtatcatgcttga

SEQ ID NO: 3012 - DNA (genomic), 1083 bp, Enterococcus faecium; double-stranded, circular
  misc_feature (B) LOCATION 1...1083
  hypothetical: NO
  anti-sense: NO
atgaacataattaggaggagaaagatgaacttatttgacatttttcgatcgactttgacagatatgtcgattgtcagtgcaatcacttcaacagtttttattatattattagggtttgtttgtagaaaaaaggggattttttctgaatctgttggaaaaattctatcgaaagtcgtcttaacagtggctttgccagcactggcatttcgagctttcatgcaagatatcaatacagaattactgatgcaaggaatcaatgtcttgatttggggattagttatttatattattcttattctagtttcaaaaccttttttcttaagctataaaggggataagcaaacaacgttgcgtgtcctgacgatctttggttctacgacctttttcggaacgcctatcgtcagtgcgatttatggtcctgtcggcgtgatgtattcctcaattttcaatattggctaccgaatctttttgtattcttatggatacataaaaatgagtggcttgaagatggaagctaaaaatatcaaagcgatgttcgtcaatccaatcattatcgctacttttgccggccttttcatttggctgttccaagggtatctgccacaagtgtcagttacaggtgcagaaggagagataagccaagtagcgtttttgcgaattgaccagactgcaccgtggctatttcagccgatggattatttagctggtttaagttcaccattggcgtggctagcaatcggcgcaacattaggtgaagtaagcttcaaaaaagctgcatctgaaaaaacttcatggtattacagtctagtcaaagtggtatttgtacctgcattgaatatcgtgattctagcagttttgacggcaacgaatattctaccagtcaattttgaagcactggcaacaatcgttatcatgatggctacaccagctgcaacagtggcagcagcctatgctatcagttttgatagggaggcacttttagcctccaatgcatccttactgtcaactatttttgctgtggtactgacacctgtatggatcgttgtattacaaatgattcatggcatagctttattttcataa

SEQ ID NO: 3013 - DNA (genomic), 666 bp, Enterococcus faecium; double-stranded, circular
  misc_feature (B) LOCATION 1...666
  hypothetical: NO
  anti-sense: NO
gagaaaataatggatatattagaaataaagaatgtagcatatagttatgcaaattctaaagaaaaagttttgtcaggagtaaatcaaaaatttgaacttgggaagttttatgcgatagtaggaaagtcaggaacaggaaaatctacacttctttccttacttgctggacttgataaacctcaaacaggaaaaatattgtttaagaatgaagatatacaaaataaaggatatagtaatcatagaaaaaataatatatctttagtatttcaaaactataatttaatagattatttatcaccaattgaaaatattagattagtaaataaatcagcagatgaaagtatcttgtttgaactaggtttagataaaaaacaaataaaaagaaatgttatgaaattatctggtggacagcaacaaagagtagctattgctagagcattggtatcagatgctccaataatactagctgatgagcctactggtaatctagacagtgttactgctggagaaataattaatatattaaagacattagctaaagatagaaataaatgtgtaatagttgtaacacatagtaaggaagtagcagattctgcggatatcattttagaactaagtggtaaaaagttgaaaaaagtaaataaaatgaatttggaggttgaataa

SEQ ID NO: 3014 - DNA (genomic), 2619 bp, Enterococcus faecium; double-stranded, circular
  misc_feature (B) LOCATION 1...2619
  hypothetical: NO
  anti-sense: NO
ggtgaaataatgcgtgttagagaaacaacgagacgaaaagacaaacgattcaatttagaaaagaataggtatctttctcatttctatcgctatactccttcaggagaagagctaccagaaaaacatgacaaacgtatttctcaaaagattttttatagtggcttagcttatcttcctttaaactatgttgttacaagaataccagaagcatttcatcgatttgagattattccaggaagtttacaaggagtgaatatttttcagttacaagaaatgccgcagttattccattttgattcaactggtttttggaatcctttgaccccaacaacaagtttaggcacacgtttagttgtttctacgatttgtgttgttccagctgtacttatgggattgaaaatggacatgtggtttcgtcctctagcagatgggcaaaaaggagataaccgattaaaaacgttaaaggaaatccaacaaatttatccgcaaataccagaatcaaagggaggttttcctggttatggcggaataccaattactcattataaaaagtactggtatattcagacggatacagtaaatacttgtattgttggtacttcccgttcagggaaaggacagatagaagttttagcaaccattgacaatttgtctcgtgcagaaagacaaagttcaatggttgttaatgatccaaaaacagaattatatgttgctagtaaagatgaactagaagctagagggtatgatgtgtatgcatttaatatcaccgatccactgcaatcaatgagtgataatccattggcactcatcgtgaaatactggaagcgaggagacatagacacagcgacacagttaaccaatactttcacgaatacgatttattatgatgccaacgcttcagacaataaatactttaacgaaaatgcgcaaaaagctgtcaatgcgcttatttttgcgttattggaacaagcggatcagacaggggattactccaaattaacaccgaataatctcgtcgaacttctttctgagattggtggttttaattaccaagatcctgataatgaattcaagcagctcaatgctttagatgaatttatgaatcagttaccacctggaaacatagcaaaaaaacaatatggggcaacaaaaattggttctgataaagcgaaaggcaacattctatcgacagcgatcacaggactaaatccatttacactgacgaaaattgcgaaaatgacttctcaatcaaccattgattataagtccattggttttccgaagtatttggatctcaaactacacgagagtctgttaaaccagcgaattgttgtagagttttatcatcaaggaaaaaaatttcatgaggaacgtgtcaaagtaggctatagaggtttttgtgaaattaactttgattgtcatttagaacagggagatcatgtttgcttaaaatacgatcatcgaggaaaagaatatgttgcttggtatgagttttctcaaagagtattgaaagacgaagagggaaatatcgtttatcgaaaaaaacgaggagaaacccatttgccagaattagaaaaagaagccgttctaacattagatgaggataaaagtaacttattagtagagtctattcggatgcactataccgataaaccaatggctatttttatgctcacacctgattatgatccatctaaccatatcattgttagtatttttcttagtcagttgtataaagaattatctacgcaatgtgttaagactaaaggagataaatgtcaccgtaggattcattttattttagatgaatttgggaatatgccaccaatggataatatggaaggaatcatgacagtcacagctggtagaaacatgttgtgggatttgtttatccaatcctatcagcaactttatgcgaagtatggggaacaaaacgcagcgattatcaaagaaaattgtcagacacatatttatattatgtcgacagacgataataccatagaagaattttccaaaaaagtggggaataagacggttgaacaagagaacagtaccatcaattcattaggtatgaatactcatatcaatcgcaatgttgattcagatcgcatcttaactcctgaaagaatttctacttttttagaaggtgaaacgattgtactcgctcctttaaaacgacaagatttgaaaggtcataaaatacggccgtatcctatttttaatcatggggaaacgaatcttccttatgcttatcaatatattgaagatttcaatccatcgtgggatatcaatgatatagacatacattgtacacatgcggacttggatcttaaggctttacaaattgattacgattattttctacctgatatctatgcacgtcgactttatcacaatatgcacgatcaaatagaagaggaagctaaagaaaacatttttattaaaatcgttcaatctttagacaactcaacggcacaaaagttacttattcaattttatgaagagaagcaaatagatcgtttgcaagaataccttgaaaaattgcgtcaaaatgaagaaattacagaggttataaggaaacgacttttgctagaagctgaaaaggcggtgaaagaatga

SEQ ID NO: 3015 - DNA (genomic), 324 bp, Enterococcus faecium; double-stranded, circular
  misc_feature (B) LOCATION 1...324
  hypothetical: NO
  anti-sense: NO
gaggaaataataatggaatcgacacaaaataaagcaatcgaaaaagtattatcaacaattcttacagaagacacagcggcagaattagcaaacttggaaggcaaagcgctagaagaaacgtttgaatgtttgtacgaacaaatggactatcaaaaattgctaccacaagaaccaacggtaagcggagtattgcgtggcttgaacgatttagtacaagcagagtttaaagaacgactttctattgaagagtatcaagaaattttgtatcagcaagttgagttgttagcgagcttgctagggcttgaactggaggacgttgaatga

SEQ ID NO: 3016 - DNA (genomic), 702 bp, Enterococcus faecium; double-stranded, circular
  misc_feature (B) LOCATION 1...702
  hypothetical: NO
  anti-sense: NO
aggagaataattgtaatggagagattgcagaaagtaattgcccacgctggcatcatttctcgtcgaaaagcagaagaattcatccttgcaggacgtgtaaaagtaaacggacaagttgtaagggaattagggataaaagttgggaaacatgacactgtggaagtggatgaagtcccaatttatcaagaagaatacggttactatttattgtacaaacctaaaggagttatttctgctgttgcagatgacaaaggaagaaaagttgttacggatcttttgccgatggtaaaagaacgtatctatcctgtaggtcgactggattacgatacttcggggatcttgctactgacaaatgatggagattttgctcagcgcctgacacatccaaaacatgaagtggataaagtttacgttgcaaaggtaaaagggatcgctacaaaatcgatgcttgcacctttgacaaaaggaataaagatcgaaggacgaaaaacatctccagctaaattccaaattttatcagtggatcctaagacaaaccacagtatcgtggaattgacgatccacgaaggacgtaatcatcaagtgaaaaatatgcttcaagcagttggtcttcctgtgcaaaaactaaaacgtgaaaaatacggagatctgactttacaaggcctacgtcctggggattaccgtgaactgaacaaaaaagaa

SEQ ID NO: 3017 - DNA (genomic), 318 bp, Enterococcus faecium; double-stranded, circular
  misc_feature (B) LOCATION 1...318
  hypothetical: NO
  anti-sense: NO
ggagtgataataatgaatgatttttctaaagacgcaaaaatttttaaggctctttgtgatacaaaaagacttacgattttagattacttaaagagcggagaaaaatgtgcgtgtgttctgattgaaaacatgaacataggacaatcggctttatcctaccacatgaaaatactttgcgactctggtattgttaatgcaagacaagagggaaaatggactcattacagcctaagtaaaagtggaagtgaatatgcgtcaaaacgattgttagaactaacaacaccaaatgctgaaaatcaatcaatttgttgcaaataa

SEQ ID NO: 3018 - DNA (genomic), 561 bp, Enterococcus faecium; double-stranded, circular
  misc_feature (B) LOCATION 1...561
  hypothetical: NO
  anti-sense: NO
atgcggataatatcaggaaattatggcgggcgccgtttaaaaagtttagcaggggcgaacaccagaccaactacagataaagtaaaagaatccatattcaatatgattggaccatattttgatggagagacagtattggatctgtttgcaggaagcggtggtttagctatcgaagcagtatctagaggctgcagtcatgcggtatgcgtagacaaaaattaccaagcgctaaaaatcatcaaagaaaacatcgaaattacgaaagaaccagagaaatttaccacaataaaacttgatgcggacaaagcaatcgaacggctagcagcggagaaacaacaattcgactacttgtttcttgatccgccatatgcaaaacaaaaaataatcgatcaaatccataaaatggaagaactgggacttttttctaaaaccgcagttatcgtatgcgaaacggataaaacagtcgaattgccagaaactgtggctggattccatcaaataagaaaacagatttatggcataacggccgtaactatctatagaaaagagggaaatcaatga

SEQ ID NO: 3019 - DNA (genomic), 837 bp, Enterococcus faecium; double-stranded, circular
  misc_feature (B) LOCATION 1...837
  hypothetical: NO
  anti-sense: NO
attggtgtaatcttctctgtctgttacaatctttcttgcagcgaaagcaataattacagaaatttttctgatttttttcgcttcgtagaaaaagagaggagttttttgatgccaactggagttttgatcaatgtaggttccgttttgtttggcggactaattggcggattagtaggaaataaattaagtgaacattttaaagcacagctgacgatggtttttggtgtgtgttcgatggggatgggaatctattccattgcgccgatgaaaaatatgccggctgttatttttgctttagtgataggaacagcgattggtttgattgttcatttaggtaatgggataaataagggggctgcgctgatgcaagtacctatttctaaaatcttccctagtgaaaagcttggtatgacccacgatgaatttatcagcacattagtgacggtcattgttctattttgtgcaagtggtacggggatctatggaagtttagattctgggatgacaggagacagtacgattttgatttctaaatctgtccttgattttttcacagcagctatttttgcgtgtaatttagggtatgtcgtttctgtgatagcaattccccaattcattattttttatattttgttcttattggcaaaatttatttatccattgactacaccagacatgatcttagattttaaagcttgcggcggattcttgatggtcgctaccggttttagaatgatcaacgtgaaaatgttcccagtagctgacatgatacctgcaatgatcgttatcatgccactgagctggatgtggacaaattggattatgccactgttataa

SEQ ID NO: 3020 - DNA (genomic), 198 bp, Enterococcus faecium; double-stranded, circular
  misc_feature (B) LOCATION 1...198
  hypothetical: NO
  anti-sense: NO
gccatcgtaattccgtatttatttgagacgctccaaacagagtctccggctttaactgtatatttcgttcctgaagctgtattagaagaacttgagctggacgaactagagccacttgtattcccagtatttgagccagtatttgctccagcattagaagaaccgccatttgatacgattagctgttgtcctggataa

SEQ ID NO: 3021 - DNA (genomic), 3084 bp, Enterococcus faecium; double-stranded, circular
  misc_feature (B) LOCATION 1...3084
  hypothetical: NO
  anti-sense: NO
gggggagtaatagtgaggaacaaatttcataaactgttaagtatgtttctagttatgcttattgtgatcaatcaatttgggaacataacggttctagctgagtctttagcagaacagccagagcgttcgctgacgatcgaagttgatcaagaggaggctgctttgggtgagcagttccagttgcgagtcagaggaacaccagacctgctaaatgcattggtcattgataagagtgaggatttgattgaaggggaagtgaagcaactcaatgattacgaacgtctgattacttattcttcccagcattcaggtaaatacgaattgaccgcaagaagcggtgatattcaatcaaatacggtctcaatagaaatcagtgtaccagaagaaagcacaagtgagtcttttaatgtaccagaagaaagcacaagtgaatcttttaatataccagaagaaagcttaagtgaatcttttaatgaagccagatcatctgagccatctataacgcaggaatctcagattgaaagacaagaggagctcttgaattatgacatcggcatctctgctgagcgccccactttgccgagcaggcatacacaaacgttaaagggatacattcaaggaggcgctggcgatattcttgaagaatatggggagatggtcgtacgagttcctagagcatcgattggcttaattgagttcattagagtggaggtcgctgatgattcacctttaaagccactggcattttaccaagaaggcacagacgttgtttttccatttacctttgattatgaaggattaaatgaagccgctcagtcgtatacattcagtatcacgtttgaagttgctttctttcaatcaggcggtactgagccaaataatgactttcaagtgagtcttacttatgctgagcgagcagcaaacacggaattttcaattacgcctattccttcatcaagacccattttttcgaaattatactatggctctagagaaatcgacagccaaggaaatcttgggaatctgctgattgacgggcaagacgtgaccaacagtaataaatttattttgcaggtaaattatgaaggatcacgaaaagacggtgtagtggttaccgatgtactaccgcaaggaacaactttggcaccgaatccgactacatggagttccactggaaatagagaacctatttcaggtggggttcggatcgcagaagtaacgaatccaggtgaagcaaacgttagaactcattatgtttccgaggaatttgtggacaaagtatcttttaataaggaaacgaatacacttgttgtggactttggtaatctagcagagggtcaatcgtattttattgaatatgctcttgaagtgaccgatgtcgacttgttcaatgaaggaagacaagaggatgggttttctcggaatcgagcgagtatgacctacaataatcaggtaatgagccgagactaccgcttgagaatccctgaaagtaatcttccggcaatctctttaagaaaaagtgtggacaaaaatgttatcaatctcaatgaaaatgaactaacgtatactctgcatgtctcgatgttttctggaacaagaaatacgcttgttattgaagatgttttggaagaaggcatggaatttgtgtcatttctatcagatattccctctttcattgatgccgaagtcaataatggaatagttcgtttcagtgcgaataatacgattggtggtccgacaagttttaccctctcttttaaggtcaatgtagaggcgtatgcggtcggcgatcaaattttaaactttgcaacgcttgtgaatagtgacaatcgattgaatacgagtactgtaagaacaaggaaaatcgatgggcgtattaaagtaattaaaactgatgagaatggccaaaggctggcaggagcaaaatttgaaattttatcaagcgattcacaagtgatacaagaaggtataacggcagaaaacggagaatttttaagtgaaccgcttcctgtaggtagctatcaagtccgagaaacagaagcaccggaagggtatcttttagatgcgacggtacatgatgtttttataaatgaatactccatagaagaagtgacgttaaccattgaaaacatccttgatacgggtggtgttgaactaattaaacatgctgaaggcagtggtgaagtccttcaaggagctgtttttgagttacagaaccgagaaggagaaacgctacaaaccggtttaactacaggagaagatggaaaactggcaattgacggtttagcaccaggagcatatcagctggtagaaactcaagcgccaatagggtatgaattagatgcgacaccaatcgagtttgagatcgaaagaagtcagacagcggtggtagaattgacgaaagaaaaccgacttacaccaggcggtgtcgtgttgacaaagatcgatgaccaaagcggggaaatcctgcaaggagctgtttttgagttacagaaccgagaaggagaaacgctacaaaccggtctaactacaggagaagatggaaaactggcaattgacggtttagcaccaggaacatatcagctggtagaaacccaagcgccaatagggtatgaattagatgcgacaccaatcgagtttgagatcgaaagaagtcagacagcggtggtagaattgacgaaagaaaaccgacttacaccaggcggtgtcgtgttgacaaagatcgatgaccaaagcggggaaatcctgcaaggagctgtttttgagttacagaaccgagaaggagaaacgctacaaaccggtctaactacaggagaagatggaaaactggcaattgacggtttagcaccaggagcatatcagctggtagaaactcaagcgccaatagggtatgaattagatgcgacaccaatcgagtttgagatcgaaagaagtcagacagcggtggtagaattaacgaaagaaaaccgacttacaccaggcggtgtcgtgttgacaaagatcgatgaccaaagcggggaaatcctgcaggagctgtttttgagttacagaaccgagaaggagaaacgctacaaaccggtctaa

SEQ ID NO: 3022 - DNA (genomic), 189 bp, Enterococcus faecium; double-stranded, circular
  misc_feature (B) LOCATION 1...189
  hypothetical: NO
  anti-sense: NO
gaagtggtaataaaccaagaagttgtcatatttttaagtttacataataatattattgataattctaaaaaacaaaacgcaactgatttttcagttgcgtttcgcctgtattattcaaatcaaatatggattggtaaacctaatgctaattccgaagcatccatgacgatttcgccaagagatggatga

SEQ ID NO: 3023 - DNA (genomic), 255 bp, Enterococcus faecium; double-stranded, circular
  misc_feature (B) LOCATION 1...255
  hypothetical: NO
  anti-sense: NO
ttgccggtaatgttggtacaccggaagccgtccgtgaattggaaaatgcgggcgcagatgcaacaaaagtcgggattggtccaggaaaagtatgtattacaaaaatcaagacaggctttgggactggaggctggcaactggcagctcttagatggtgtgcgaaagcagctcgcaagccgatcatcgctgacggtgggatcagaacacatggcgatattgcaaaatctgtccgttttggtgcgacaatggtcatga

SEQ ID NO: 3024 - DNA (genomic), 606 bp, Enterococcus faecium; double-stranded, circular
  misc_feature (B) LOCATION 1...606
  hypothetical: NO
  anti-sense: NO
ttgcaatcctttggtggcgcaaaagtttctgataaaatcggcgtaatcgaaaacttgattcctaaagcagataaaatcttgatcggtggcggaatgacttacacattctacgaagcaaaaggaatcaagatcggtaactctctagtagaagctgataaagtggaactagcaaaagaattaatcgaaaaagcaggcgacaaacttgtcttgccaatcgacaatgtctgtgcaccagaattttcaaatgatgttgaaacacaagtaatcgaaggagacattcctgatggtttgatggctttagacatcggcccagcatcagtaaaattatttgctgatacattacaaggtgcaaaaacagttgtttggaacggacctatgggtgtatttgaaatgagtaactttgctaaaggtacaatcggtgtttgtgaagcaatcgctaacttagaaggcgcaacaacaatcatcggtggcggagactcagccgcagcagcagaacaattaggatttgctgacaaattcacacacatctcaacaggtggcggcgcaagcttggaattgcttgaaggtaaagaattaccaggactagcagcaatcaacgataaataa

SEQ ID NO: 3025 - DNA (genomic), 315 bp, Enterococcus faecium; double-stranded, circular
  misc_feature (B) LOCATION 1...315
  hypothetical: NO
  anti-sense: NO
aaaaattcaattgcaactagagtcactaaaattttcgatagtatcgtcatatcttcttcctcttttctgatgagttttatttttttgctccttataattgtactcgataaggatgtttttttattttatttgcctttgaaaacaaacaatattggcacaaaaaacaaagaaaaaccgttagaaacctcagtttctaacggttttttagcgtcacaggagggattcgaacccccgaccgtccgcttagaaggcggatgctctatccagctgagctactatgacaagaatcagcggaacatcaataattatagataa

SEQ ID NO: 3026 - DNA (genomic), 3552 bp, Enterococcus faecium; double-stranded, circular
  misc_feature (B) LOCATION 1...3552
  hypothetical: NO
  anti-sense: NO
atcgattcaattgaggaaggaggaaaaggaatggatattattcaattagtcggaaaagatccgcaagtaaaagaatgggtcagcaatttagaagaaaaaatgcctagacaactaatcacaggattagcgggctcagcgaaaacacttctatttgctcgagcgtttaagaaaacaaataaaaacatgattattctgatgccaaatttgtattatgcgaatcagttagcagaagatctgcaacatgtgattccgcaagatcagatccatttatttccagtggatgaagtgctttctgctgaaatggccttttcttctccagaagcgcgaggcgagagagttgcaacgcttaacgcacttcaagaaaaaaaagcaggtatctatttgttgccagtcgcatctttgcacaaacgactgccgaataagaaaacttggctacaggcgcaattgaattggcatattggtgatgagatagacgtggaaaatcttcctcgccaattgactttgatgggctatgtacgagaagagatggtcgcaaaaccgggagaattcagtattcgaggaagcattatcgatatttacccgttaacgacaacctatcctgttcgtgtagaactatttgatgtagagatagattctatgcggtattttgaagcagaaacacaacgctcaatcgaaaaaacggaagaaatctgggtttccccaacgagtgaacaagtctacggaccagaggatctagaacatggaatagagcaaatgcaaaaaatgctagaaaaacggcttgctgcgaccacagaagaagcagaccgcgagtttttgcaagattacttcggtcagctgacttcaagctggcaagcaggtgtcccgacagaagaagcaaaattctactcagatcttctttaccaagaatctgtgacgatcttggattatttcccttcaaatagtttactagtcgttgatgattatcagcgaatcatggaaacaaatcgggaaatcgaaagggaagcggcagaatggcagactcaaaaaatcagcgaattgcgggtgttttctgagcagacattttcagcagatatacaaaaaatcgtgcagaaggaaaagttcaccacaacctttttctcactcttccaaaaagggatgggaaatcttcgtttccaagcaatccataattttcaatatcggacgatgcaacagttcttcggacaaatgccattgctgaaaacagaaatggaccgttggcgcaagcaaaaacagactgttgtgatctttattccgacaaaggacagaatacgcaaagcagaacaaatgcttcgagatgaagacatattagtagtagaaacagaaaaaaatgcattgatcagaggacaggtacaattagttgaaggagctttgcaggctggttttgaacttcctcaagaaaaaatagtagctatcacagaaaaagaaattttccaaaaaacgacgaaaaaacaaacgagacgtcaaacagtaacaaacgcagagcgattgaaaagctataatgagttaaaagcaggagattacgttgtccatgccaatcatggtatcgggaaatacattgggatggaaacgctagaagtagatggcgttcaccaagactatatgactattttgtatcaaaacgacgacaaactgtttattcctgttactcaactgaatctgatccaaaaatatgtcgcctctgaagccaaagcgcctcgcatcaataagctaggcggaagtgaatggacgaaaaccaagcgaaaagtctcttcaaaaatcgaggatatcgctgacgatctaatcaaattatatgccgcaagagagtcagaaaaaggatatgcttttggacctgatgacgcctaccaaaaagaattcgaaaatgccttcccctactctgaaactgatgaccagttgagaagtgcagcggagatcaaacgggatatggaaaaagaaaaaccaatggatcgactactcgtaggtgatgttggttatgggaaaacagaagtagcgcttcgagcggcctttaaagcgataaaggaaagcaaacaagtagcctttttagttccaacaacgatcttggcacagcagcactatgaaacgatgctggaaagatttgaaggtttccccgtaaatatcgggctattaagtcgtttcagaacaagaaagcaacaaaaagaaaccatcgaacaactgcgtacaggtcaagttgatattgttgtaggaacccaccgaattttgtcaaaagatattgaatttagcgatttgggtctactgatcattgacgaagaacaacgttttggtgtaaaacataaggaacgattgaaacagttacgtgcacaagtggatgttttgactctgactgcaacaccgattccgagaactttgcatatgtcgatgttaggcgtgcgggatctttcagtaatcgaaacaccgcctgcgaatcgttatccgatccaaacgtatgttatggaaaaaaatcctggggctattcgcgaagcaatccatcgagaaatgggacgaggtggacaagtattctatttatataatcgggtagaaacgatcgaacaaaaagtagaagaaatccaagaactcgttccggaagcacggatcggttatgctcatgggcaaatgacagaggcgcaattagaaaatacgctttttgaatttattgaaggtcaatatgatgttcttgtcactacaaccatcattgaaacaggagtagatatcccgaacgcaaatacgttgttcgttgagaacgctgattatatgggattatccacgttataccaattgcgagggcgggtaggaagaagcagccgtgtcgcatatgcttactttatgtatgagcagcagaagatccttaacgaagtcagtgaaaaacgtcttcaggcaatcaaagattttacagaactgggatctggattcaagattgcgatgcgggatctttccattcgcggtgcaggtaatctcttaggtgctcagcagcatggatttattgatgcagtcggtttcgatatgtattctcaaatgctaagcgaagctgtttctcgtaaacaaggaaagaatagtcaagtggagaagaccactgttgagatcgacctcggtgtcgatgcgtatctacctgaaacatacgtggcagatcaacggcagaaaatcgagatctataaacgaattcgtgaacttgattcgcaagaaatgctagatgaactagaagatgatctgctcgaccgttttggagaatatccagaagaagtagcacatctcttgacaattgggcagatcaaaatggatggcgatcgagcgctcctagaaacgataaggaaacaggaggcgcatatagtctttactctaagtaaagttggaacaaaacgctatagtgtggaacagttattcgaagcactgacagcgacaaaactaaaagccagtctaggcgttgaaaaagaacagatggtgatacgcttgacgatccccaaccaaatggaagaagcagtatggcttcaggaaatccaaaagtttgtcaaagcgttgcgtgagcaaaaatatctgtcagcgtag

SEQ ID NO: 3027 - DNA (genomic), 600 bp, Enterococcus faecium; double-stranded, circular
  misc_feature (B) LOCATION 1...600
  hypothetical: NO
  anti-sense: NO
gagatatcaatgacacaagaaataaaaaaactacccgttatatttttaggtcttttctttatcacagttggattgaattggttcttgctccctcacgatatagcttccgccggagtgggcgccatcggacatttagttgaaacggccttttctatccaacgctcagttactgtttggagcatcaatcttatgatgctgcttctagccgctgtcctattaggaaaatcagtattttttaagactgtagcgggaagtctgctttttcctgttgttttagagattgttccaaaagtggaaatgatctcctcacatttcttttcactgatttcaggaagtcttttgttcagtcttggggtttacacattgtacacagtcggggcctcaaatggcggtataacgataccgccgattattttccacaaattttttcggcttccaatgccgcaaggacttttacttaccaatagtcttatcgtctttttgaattattatgtttttggattgttggagacactattcgttctcctatctattacagtcagttcattgtttatgaaaatactcatccgcttgtcccctgtgtcaagaaaatttgaataa

SEQ ID NO: 3028 - DNA (genomic), 234 bp, Enterococcus faecium; double-stranded, circular
  misc_feature (B) LOCATION 1...234
  hypothetical: NO
  anti-sense: NO
tatgtatcaattatccgaattgttcacacttttgaaataattaaaaaaaacgagggaatttacaaatgtaaactccctcgcaaagattgtattaacgacaaccagcgttctattttaggatgggtttcaaaattggaatgttgtaatagtatttccctttttcaaggtaaaaacttactaaattctaatcaattactttggccaaaaagtaatttttcttaccttttcgaataa

SEQ ID NO: 3029 - DNA (genomic), 417 bp, Enterococcus faecium; double-stranded, circular
  misc_feature (B) LOCATION 1...417
  hypothetical: NO
  anti-sense: NO
gagaaatcaatgtcttatagagtacaattaataatttcagaagatgtagaaagtcagcaatttggcactaatgttattaataaagtaattaatccagctctttctattaatgcgcctttaattcctactgctttatcattttctgtaacagctgtggtgtctgagatagaggatacagaaaagataaaaatagtagaaattgaagttttaaacaagaatgaaaaacaaattttttctacgggtgaagtatcggtaagcttgcctcctcaagttaacgatataaactttaatataaacgccagaaatgtcttggttgaagaagcaggagagcattatgctgttgttaaatttaatggaactgagattggaaggcaaatctttgatatcaaggtcaacaaaccagtggaaaaaaattaa

SEQ ID NO: 3030 - DNA (genomic), 1050 bp, Enterococcus faecium; double-stranded, circular
  misc_feature (B) LOCATION 1...1050
  hypothetical: NO
  anti-sense: NO
ggtgaatcaatcatggcaaaagaattgaaatttgcagaagacgcacgcgcagctatgttacgcggggtagataaattagcagatacagtgaaagtaacattaggacctaaaggccgaaatgtcgtactagaaaaatcttacggctctccattgatcacaaatgatggtgtgacgatcgcaaaagaaatcgaattagaagatcattttgaaaacatgggtgcaaaacttgtatcagaagtagcatcaaaaacaaatgatattgcaggagacggtacaacgacagcaactgttctgacacaagcaatcgttcgcgaaggtttaaaaaacgtaactgcaggtgctaatcctctaggcattcgtcgcgggatcgaattggcaacaaaagcagcagtcgaagaattgcataatatctcaactgttgttgattcaaaagaagccattgcacaagtagcagctgtttcttcgggttctgataaagttggacatttgattgctgatgcaatggaaaaagttggaaacgacggtgtcatcacaatcgaagaatcaaaagggatcgaaacagaactagatgttgtagaaggtatgcagtttgatcgtggttacttatcacaatatatggtaacagataacgacaaaatggaagctgttctagaaaacccatatatcttgatcacagacaaaaaaatctctaacatccaagatattctgccattgttagaacaaatcttgcaacaatcacgtccattgttgattattgctgacgatgtagatggtgaagcattgccaactcttgtattgaacaaaatccgtggaacattcaacgtagtagctgtaaaagctcctggtttcggcgatcgtcgtaaagcaatgcttgaagatatcgctattttgacaggtggtacagtaattactgacgatctaggtttagaattgaaagatgtaacaatcgaaaacttaggaaatgcttctaaagttgttgtagataaagacaatacaacgatcgtagaaggttctggagaaaaagaacaatcgaagctcgtgtgcaattga

SEQ ID NO: 3031 - DNA (genomic), 393 bp, Enterococcus faecium; double-stranded, circular
  misc_feature (B) LOCATION 1...393
  hypothetical: NO
  anti-sense: NO
agcgaatcaataagaaagagatggaagcagatgctaacgaaaaaagaactaatcgatcacatcaatgaaacatacaatttgtctccagaatatatttttaaaaaatttcctgattattgcgtattcagacatcaaaaaagcaaaaaatggtttggggtcctgatgtctgttccagaagaaaaaatctatgatgatgcaagtgaccataggatcatcaatattcttgatttgaaggtcgatcctgaacttggcggaattttgcgaggaaaagaggggtattttccagcctatcacatgaataaagaacattggatctctattgatctacgtaaaatagaaaagctagatgaactagcagatttgattgatggaagttttaaatcaacgcaatga

SEQ ID NO: 3032 - DNA (genomic), 912 bp, Enterococcus faecium; double-stranded, circular
  misc_feature (B) LOCATION 1...912
  hypothetical: NO
  anti-sense: NO
gcgagatcaatgaataaaaaagaaatagcagtagtcgcaagttgtaacacaaaattcgtaccacatttagctgcattatttgtctcagtattagataattgcaacccgtctaaatttgttcggttctatgtgattgacgatgatatcgattttgaaagtaaacagcttttacgcttctcagtgaaaaacgcacgaatgaactcagatgtggaattcttgaaaatcaataaagaattctttacaaatgtggtaatcagcgatcgtattccagaaacagcttattatcgtattgcgattccggaattgttccgcggcacagaagttgaacgtatcttatatatggattgcgacatgatcgctttacaagatatctctaaattatggcgtcttgacttcggtgattcaatcgtagcagctgttgaagacgctgggttccatcaacgactggaaaaaatgaaaatttcagctaaatcaatgcgttatttcaactcaggtttgatgctgatcaatgtgaaaaaatggttagatgaaaatattacgcaaaaagtattagatttcatcgaacataatccagaaaaattacgattccatgaccaagatgcattaaatgctatcttacatgaccgttggttaccacttcatccgcgttggaatgcacaaggctatatcatggcaaaagcaaaaaaacatccaacagcagcaggtgaacgtgaatacgaagaaactcgcaacaatccttacattatccatttttcaggacatgtgaaaccgtggagcaaggattttgaagggccaacgaagaaatattacgaaaaatatgcagggatgacggctttccgttgtgtagctaaattccctaaatatccaaaatatgcaaaagttcaaccaaaaacagatgtagttgttaaataa

SEQ ID NO: 3033 - DNA (genomic), 1488 bp, Enterococcus faecium; double-stranded, circular
  misc_feature (B) LOCATION 1...1488
  hypothetical: NO
  anti-sense: NO
gatatgtcaatcagtcaaacgatttgtgattttgccacacttgcgatcgaagctggcggatggatggaaatggaccgcttatatttacagaatcgtcttttagggatgataggagaagacgctctagaaagcgtcgaagtaagaccagttaaggaagaatcagtagacttattggatcggtttgtcgctaaggcaagagaaaatggtgtgctttcagaattaccagcagaacaagagatttttgaagcacaattgatggattttcttacaccgccgccttccgttgtcaatgcattctttgcacagcattattcgaaaagtccagaggaagcaactgattatttctttgatttaagtaagaaaaatgattacatcaaaacaagagccatagctaaaaatatcaaatttccagcagagtcagcatatggtgaattggaaatcacgatcaatttatctaaaccagaaaaagatccaaaacaaattgcggcagaacgtgaggcagccaaagtagattatcctacatgtatgctgtgcatggaaaatgaaggatatagaggacgcttgaattatccagcccgcaccaatcatcgaatcattcgaatgaatctagatggtgaaagctggggattccaatattctccttatgcttattacaatgagcattcgatcattttatcagagcagcaccgtccaatgaaaatttcaaaggaaacatttgttagactgcttcggattactgaagtcttgcctcattactttgttggttcaaatgctgacttgccgattgttggaggatcgattctttctcatgatcattatcaggcaggacgtcatgaatttcctatggcaaaagcaccaatagaaaaactcatcaaattagcagattatccgcaagtcatcgcaggagttgtgaaatggccgatgtctgtgatccgtttgcaatcaacagataaagagttgctgattgaagcagctaattcagtgttggaaaagtggaaagaatattcggatgaaacagtagaaatccgggctttttcagcagatggtacaccacaccacacgattacgccaattgcacgaagaagggacaattattttgagctggaccttgtccttcgagacaataatgtttcagatgagcatcctgatggtatttttcatccgcataaagatgtccaacatatcaagaaagagaacattggattgatcgaagtaatggggcttgctgttttaccacctcgtttgaaaccggaactagcagaagtagagcggttcttattgggagaagaaaaccagatggctgaatatcatcgtccatgggcagaacagttgaaaaaagagcatcctgatttgacgaaagatgcggtcactgatgttgtacaaaaagctgtaggtcaggtttttgctcgtgtcttggaagatgctggggtgttcaagcgagatgaaaaaggacaagcagcgtttgagcggtttactgcgattttataa

SEQ ID NO: 3034 - DNA (genomic), 363 bp, Enterococcus faecium; double-stranded, circular
  misc_feature (B) LOCATION 1...363
  hypothetical: NO
  anti-sense: NO
tcgaggtcaatacggcttcgtctaaaatcgaattactgtcatcctctaatgaaagctccaatcattttccagtacgggtatcttcggctaatggcgaagcgttgtggtttgcttaaaaactatgatgaaaagctccatgccttagtggtgacccaattaactggtgatacggatatcaaagaaggggatgttgtccagacatccggtcttggagggaattctccagataacttgccgatcggtacggttattaaaacgaaaccagatagttatgggctggatcgggaagtttatgtgaaaccttatgcagaaatgtatgacgtgtcagttgtgacgattgtccaacggctagcggaggattag

SEQ ID NO: 3035 - DNA (genomic), 1710 bp, Enterococcus faecium; double-stranded, circular
  misc_feature (B) LOCATION 1...1710
  hypothetical: NO
  anti-sense: NO
accatgtcctttgatggtgtatttacccacgcgatggtcaacgaattgcgtgaaacgttactatctggccggatctcgaaaatccatcagccttatgaaaatgaaatcgtgctggtgattcgttcacgcggcaaaaaccatcgattattattatctgcgcacccaagttatgctcgtgtacagattacccaaatcgattatcagaatcctgataatccgcctaacttcgtgatgatgcttcgaaaatatttggatggcgctattttagaagacatcgaacaaatcgaaaatgatcgagtgatccatttccactttgctaaacgaaacgagttgggtgatctacaaaatatcatattgatcgttgaattaatgggacgtcatagtacgatcgtcttagttaatcgagaaactggaaaaatactggatgcgatcaaacacattggaagctctcaaaacacttatcgttctttgcttcctggtgtagaatatgttgctccgccaaaacaagaggtcttgaacccatttagctccgagaaagaaaaaatctttcagcggctttcccaaactgaactagatccaaaagcaatccaacgtcagtttcagggaatcggtttcgatatcgctcaagagctgaccaaaagattactggaacgtcctaatgaaaagatggttgtatgggacgaatttttctcagccatcagccatcagcctattcctactttttacgaaacggaaaataaagattttttcacaccgattgcttatcaggtattgtccgaacaggcatctgctgtaacagcttatccaacactcagtcaattattagatagctattatcacgaaaaagcagagaaagatcgggcaaaacaacaaggcggagaactgattcgaaaaatcgaaaatgaactaaaacgaaataaaaataaattgaaaaaacgtgaacaaacactcaaagaatccgaaaacgctgagaattaccgtagaaatggcgaactacttactacttttctgacacaagtaccacgcggcgcaaaagaagttgttttacctaattattatgaagaagatcggccaatcaaaatagcactagatccggcattgacaccaaatcaaaatgcacagaaatatttccatcgataccaaaagctgaagaacgctgttaagctgattggcgaacaaatccaagaagccaaagatgaaatccaatatcttgaatctgtcttatctcaactggaaattgccggcccaatggatatcgaagcaattaaagaagaattgacttcagaaggatacctgaaaaagaagaacttaaaaaaacaaaaacgtaagaaaccatctcagcctgatcaatacttttcttctgacggaacgctcattcttgttggtaaaaacaatcttcaaaatgaccagctgacaatgaagacagctaaaaaaaccgactattggcttcatgcaaaaaatatacccggttcgcacgtcatcattaaaagtgacaagccctcagatgaaacaattacagaagctgccgagttagctgcctatttttcaaaataccgatactctgcccaagtgccggttgatcttgtacaggtaaagcatatccgaaaaccaaatggcgccaagcctggttatgttatttatgaaaaccaaaagacgattatcgtgacaccagaagaagaaaaaattacagctatgaaacaaaacaggtaa

SEQ ID NO: 3036 - DNA (genomic), 369 bp, Enterococcus faecium; double-stranded, circular
  misc_feature (B) LOCATION 1...369
  hypothetical: NO
  anti-sense: NO
ttccccccaatatgtgggccaatnatggcgattccatggacaacgtttgctcagtacgctgcttcaaaaggcggggtaaaattatttaccgaaacggtagcaatggagtatgcaccgaagggaatcagaatcaatagtataggccctggtgctatccgtacacctattaatgcggcaaaatttgatgatcctgaacaaaaagaactcttggaaagtatgatcccactaggacgcgtaggtgaaccaaaagaaatagcggcgacagctgcatggttggcttcagacgaatccagttatgttacaggtattacactatttgcagatggtgggatgactttatatccttctttccaaggtggaaaaggataa

SEQ ID NO: 3037 - DNA (genomic), 1212 bp, Enterococcus faecium; double-stranded, circular
  misc_feature (B) LOCATION 1...1212
  hypothetical: NO
  anti-sense: NO
cgacaaccaattcacagaaaagaggacttccctatgaatgattttactacagaaattgtgcaaactctagtcactaaaggcgatttaaatgaattattccgttcgcacttagaaaaagcgataaacacactcctacggactgaattaacggcttttttagattacgaaaaatatgatcgcactggttttaattcaggtaattcgagaaacggttcttactttcgatcaatcaaaaccgaatatggtgaattaacattggaaatacctagagatcgtaatggtgagtttaaacaacaaactttaccagcctacaaaagaacaaacgatacattggaaaccactattatccatttattcgaaaaaggtgttacgatgtctgaaattgctgatttgatcgaaaaaatgtacggtcatcactatactccacaaaccatgtccaacatgactaaagttctgactgaagaagtaaatgcctttaaatccagagccttaaatgataagtatgtcgctatttttatggacgctacttacattccactaaaacgtcaaaccgtatccaaagaagcgatttatattgccattggtatacgagaagacggcactaaagaagtactgagttatgcgattgctccaactgaatcaacatacgtttggaatgagctgctacaggatattaactccagaggagttcaagaagtcttgctttttattacggacggcttaaaaggcatgaaagatactatccatcaaatttatcctaaagcaaaatatcagcattgttgtatccatgtatctcgtaacatcgctcataaagtacgtgtcaaagaccgaaaagaaatctgtgatgactttaaggctgtttatcaagctaactcaaaagaagaagcgaataccttcttatccggcatgattgagaaatggaagaaaaactatcctaaagtgacgcagtcactcatagaaaaccaagacttattaactttttatgattttccacctagcattcgtagaaccatttactcaaccaatctaatcgagtctttcaataagcaaattaaaagatacagccgtagaaaagagcagtttcaaaatgaagaatcactagaacgctttctagtcagcatttttgatacatacaatcaaaaatttctaaacagaagccataaaggttttcaacaggtaaccgatacattagtttcaatgtttactgagtaa

SEQ ID NO: 3038 - DNA (genomic), 1134 bp, Enterococcus faecium; double-stranded, circular
  misc_feature (B) LOCATION 1...1134
  hypothetical: NO
  anti-sense: NO
cgacaaccaattcacagaaaagaggacttccctatgaatgattttactacagaaattgtgcaaactctagtcactaaaggcggtttaaatgaattattccgttcgcacttagaaaaagcgataaacacactcctacggactgaattaacggcttttttagattacgaaaaatatgatcgcactggttttaattcaggtaattcgagaaacggttcttactttcgatcaatcaaaaccgaatatggtgaattaacattggaaatacctagagatcgtaatggtgagtttaaacaacaaactttaccagcctacaaaagaacaaacgatacattggaaaccactattatccatttattcgaaaaaggtgttacgatgtctgaaattgctgatttgatcgaaaaaatgtacggtcatcactatactccacaaaccatgtccaacatgactaaagttctgactgaagaagtaaatgcctttaaatccagagccttaaatgataagtatgtcgctatttttatggacgctacttacattccactaaaacgtcaaaccgtatccaaagaagcgatttatattgccattggtatacgagaagacggcactaaagaagtactgagttatgcgattgctccaactgaatcaacatacgtttggaatgagctgctacaggatattaactccagaggagttcaagaagtcttgctttttattacggacggcttaaaaggcatgaaagatactatccatcaaatttatcctaaagcaaaatatcagcattgttgtatccatgtatctcgtaacatcgctcataaagtacgtgtcaaagaccgaaaagaaatctgtgatgactttaaggctgtttatcaagctaactcaaaagaagaagcgaataccttcttatccggcatgattgagaaatggaagaaaaactatcctaaagtgacgcagtcactcatagaaaaccaagacttattaactttttatgattttccacctagcattcgtagaaccatttactcaaccaatctaatcgagtctttcaataagcaaattaaaagatacagccgtagaaaagagcagtttcaaaatgaagaatcactagaacgctttctagtcagcatttttgatacatag

SEQ ID NO: 3039 - DNA (genomic), 609 bp, Enterococcus faecium; double-stranded, circular
  misc_feature (B) LOCATION 1...609
  hypothetical: NO
  anti-sense: NO
cgacaaccaattcacagaaaaaaagacttccccacgaatagaaaatccctacgaaattgtgcaactctagtcactaaaggcgatttaaatgaattattccgttcgcacttagaaaaagcgataaacacactcctacggactgaattaacggcttttttagattacgaaaaatatgatcgcactggttttaattcaggtaattcgagaaacggttcttactttcgatcaatcaaaaccgaatatggtgaattaacattggaaatacctaaagatcgtaatggtgagtttaaacaacaaactttaccagcctacaaaagaacaaacgatacattggaaaccactattatccatttattcgaaaaaggtgttacgatgtctgaaattgctgatttgatcgaaaaaatgtacggtcatcactatactccacaaaccatgtccaacatgactacagtgctgactgaagaagtaaatgcctttaaatccagagccttaaatgataagtatgtcgctatttttatggacgctacttacattccactaaaacgtcaaaccgtatccaaagaaccgatttatatctgcctattgtgttatacgagaagacggcactaa

SEQ ID NO: 3040 - DNA (genomic), 399 bp, Enterococcus faecium; double-stranded, circular
  misc_feature (B) LOCATION 1...399
  hypothetical: NO
  anti-sense: NO
cgacaaccaattcacagaaaagaggacttccctatgaatgattttactacagaaattgtgcaaactctagtcactaaaggcgatttaaatgaattattccgttcgcacttagaaaaagcgataaacacactcctacggactgaattaacggcttttttagattacgaaaaatatgatcgcactggttttaattcaggtaattcgagaaacggttcttactttcgatcaatcaaaaccgaatatggtgaattaacattggaaatacctagagatcgtaatggtgagtttaaacaacaaactttaccagcctacaaaagaacaaacgatacattggaaaccactattatccatttattcgaaaaaggtgttacgatgtctgaaattgctgatttgatctga

SEQ ID NO: 3041 - DNA (genomic), 1212 bp, Enterococcus faecium; double-stranded, circular; identical to SEQ ID NO: 3037
  misc_feature (B) LOCATION 1...1212
  hypothetical: NO
  anti-sense: NO

SEQ ID NO: 3042 - DNA (genomic), 1212 bp, Enterococcus faecium; double-stranded, circular
  misc_feature (B) LOCATION 1...1212
  hypothetical: NO
  anti-sense: NO
cgacaaccaattcacagaaaagaggacttccctatgaatgattttactacagaaattgtgcaaactctagtcactaaaggcgatttaaatgaattattccgttcgcacttagaaaaagcgataaacacactcctacggactgaattaacggcttttttagattacgaaaaatatgatcgcactggttttaattcaggtaattcgagaaacggttcttactttcgatcaatcaaaaccgaatatggtgaattaacattggaaatacctagagatcgtaatggtgagtttaaacaacaaactttaccagcctacaaaagaacaaacgatacattggaaaccactattatccatttattcgaaaaaggtgttacgatgtctgaaattgctgatttgatcgaaaaaatgtacggtcatcactatactccacaaaccatgtccaacatgactaaagttctgactgaagaagtaaatgcctttaaatccagagccttaaatgataagtatgtcgctatttttatggacgatacttacattccactaaaacgtcaaaccgtatccaaagaagcgatttatattgccattggtatacgagaagacggcactaaagaagtactgagttatgcgattgctccaactgaatcaacatacgtttggaatgagctgctacagaatattaactccagaggagttcaagaagtcttgctttttattacggacggcttaaaaggcatgaaagatactatccatcaaatttatcctaaagcaaaatatcagcattgttgtatccatgtatctcgtaacatcgctcataaagtacgtgtcaaagaccgaaaagaaatctgtgatgactttaaggctgtttatcaagctaactcaaaagaagaagcgaataccttcttatccggcatgattgagaaatggaagaaaaactatcctaaagtgacgcagtcactcatagaaaaccaagacttattaactttttatgattttccacctagcattcgtagaaccatttactcaaccaatctaatcgagtctttcaataagcaaattaaaagatacagccgtagaaaagagcagtttcaaaatgaagaatcactagaacgctttctagtcagcatttttgatacatacaatcaaaaatttctaaacagaagccataaaggttttcaacaggtaaccgatacattagtttcaatgtttactgagtaa

SEQ ID NO: 3043 - DNA (genomic), 1212 bp, Enterococcus faecium; double-stranded, circular; identical to SEQ ID NO: 3037
  misc_feature (B) LOCATION 1...1212
  hypothetical: NO
  anti-sense: NO

SEQ ID NO: 3044 - DNA (genomic), 1212 bp, Enterococcus faecium; double-stranded, circular; identical to SEQ ID NO: 3037
  misc_feature (B) LOCATION 1...1212
  hypothetical: NO
  anti-sense: NO

SEQ ID NO: 3045 - DNA (genomic), 240 bp, Enterococcus faecium; double-stranded, circular
  misc_feature (B) LOCATION 1...240
  hypothetical: NO
  anti-sense: NO
cgacaaccaattcacagaaaagaggacttccctatgaatgattttactacagaaattgtgcaaactctactcactaaaggcgatttaaatgaattattccgttcgcacttagaacaagcgatcaacacactcctacggactgaattaacggcttttttacattacgaaaaatatgatcgcactggttttaattcaggtaattccagaaactgttcttactttcgatcaatcaaaacctaa

SEQ ID NO: 3046 - DNA (genomic), 1212 bp, Enterococcus faecium; double-stranded, circular; identical to SEQ ID NO: 3037
  misc_feature (B) LOCATION 1...1212
  hypothetical: NO
  anti-sense: NO

SEQ ID NO: 3047 - DNA (genomic), 366 bp, Enterococcus faecium; double-stranded, circular
  misc_feature (B) LOCATION 1...366
  hypothetical: NO
  anti-sense: NO
cgacaaccaattcacagaaaagaggacttccctatgaatgattttactacagaaattgtgcaaactctagtcactaaaggcgatttaaatgaattattccgttcgcacttagaaaaagcgataaacacactcctacggactgaattaacggcttttttagattacgaaaaatatgatcgcactggttttaattcaggtaattcgagaaacggttcttactttcgatcaatcaaaaccgaatatggtgaattaacattggaaatacctagagatcgtaatggtgagtttaaacaacaaactttaccagcctacaatagaacaaacgacacattgaaagccaatgtcttcaccaaagttcgcncccac

SEQ ID NO: 3048 - DNA (genomic), 462 bp, Enterococcus faecium; double-stranded, circular
  misc_feature (B) LOCATION 1...462
  hypothetical: NO
  anti-sense: NO
cgacaaccaattcacagaaaagaggacttccctatgaatgattttactacagaaattgtgcaaactctagtcactaaaggcgatttaaatgaattattccgttcgcacttagaaaaagcgataaacacactcctacggactgaattaacggcttttttagattacgaaaaatatgatcgcactggttttaattcaggtaattcgagaaacggttcttactttcgatcaatcaaaaccgaatatggtgaattaacattggaaatacctagagatcgtaatggtgagtttaaacaacaaactttaccagcctacaaaagaacaaacgatacattggaaaccactattatccatttattcgaaaaaggtgttacgatgtctgaaattgctgatttgatcgaaaaaatgtacggtcatcactatactccacttaccatgttcaacaatgataaaagttctgactga

SEQ ID NO: 3049 - DNA (genomic), 1059 bp, Enterococcus faecium; double-stranded, circular
  misc_feature (B) LOCATION 1...1059
  hypothetical: NO
  anti-sense: NO
gccacgccaatgcaagtngaatccatngntccnngnnnnnnnnnnnnnnnnnnnnnnnnnnnnnnnnnnnnnnnnnnnnnnnctttaggaatcttaggcggattagcggcttgtggcaatggtaactcttcagcagaaggggaagccgatgaaggaaaaacgttaacagtttccgttgattctggatataaagattatataaacgaaataaaaaacactttcgaaaaagaaaacgatgtgaaaatcaagctagtagaaaaggacatgttcgatcagttggaatcattagcgttagatgggcctgctggaaagggacctgacatttttatagcagcatatgaccggatcggtgcgttaggacagcaaggacatctggcggaagtaaaactgggaaatgaagcagcttacgatgaaacagacaaagcccaagtgacttatgatggaaaaatctacggagaacctgcagtaatcgagacccttgttttgtactataacaaagatttagtcgatacagcaccatcaacgtttaaagatttggagaatctatccaaagacagtcgttttgcttttgagtcagaagcaggaaaaaatacaggatttttagctaaatggactgacttttattattcctatggtttaattgcaggttacggtggctatgtatttggtgatgatggcacaaatccttcagatatcggtttgaataatgcaggtgctgtagaaggaatctcttatgcaacagattggttcaaaaatgtttggccaaagggaatgcaagacataaaaagtgcaggagacttcgccagccagcaattcatgtccaataaaactgcagcaatcattgacggtccatggcaagcgcaaacatacaaagggaacaatatcaattatggtgtagccaaaattcctactctaaataatggacagccttatcaaccgtttgggcggaggaaaaaggatggtatgtcagcaaattatgctaaaaacaaagaactctctccaaaatggcttgattatgtaacgaatcaggaaaatcaagaaaattctttgaaatggtaa

SEQ ID NO: 3050 - DNA (genomic), 213 bp, Enterococcus faecium; double-stranded, circular
  misc_feature (B) LOCATION 1...213
  hypothetical: NO
  anti-sense: NO
gttcagccaattcaaaaacaagaaaagctgtttttgcttggctattcttattacttgttgcagggcagctttttcacaacctctccactaaacggtgttctcctgccaactcctcggtcacaagtcacaatattcaacaaacatgagaagctgttttttgaaattgttccttgtgactcggagctaaacggcaggctcacaacctcttggtaa

SEQ ID NO: 3051 - DNA (genomic), 336 bp, Enterococcus faecium; double-stranded, circular
  misc_feature (B) LOCATION 1...336
  hypothetical: NO
  anti-sense: NO
tcacttacaatatggatggagaatacactgcagagattcgtgagatgctctatggcaaatgaacattatttttacgtattattctgtaaagatcagacattttatggtggatatacaaccgatctttctagacgattagaggaacataacaatggtactggtgctaaatatactcgtcttcaaaaaagaagacctgttaagatgatccatgcagaagtattttcttcaagaagcgaagcaacaaaagcagaagctgcattcaaaaaactcacccgaaaacaaaaagaacgttatttacagacacactcaaccgttttgcttcctgaatctatatga

SEQ ID NO: 3052 - DNA (genomic), 750 bp, Enterococcus faecium; double-stranded, circular
  misc_feature (B) LOCATION 1...750
  hypothetical: NO
  anti-sense: NO
atggatacaatccgtaattatttagacagtcattttatcggagtacctcaaagtaccgagatagataagctgaaaactgatttgttggcaaatatggaagaccattatcatgaattgatgggagaaggaaaaaatgaacaggaggccatcggtacagtaatttcgacatttggttcaatcgatgaattattagaagaactagatgtcgaaaaaaaacatcaagctgacgagacggaaacaaacacagcttctatttatttaagcgaagcagaaaactactggaaagaatacagagcggcaagtctccaagtggcatcaggtgttctattcattagcttatcttttgcaagttttcttttcttttgttcagcaggatatgtgttcatgggtatttcttgtctgattttcggtatagcattagctgtcggtttttttattgcttctggtatgaaaatcacacgtttaaatcactttttgcaccatcggaaaatacctgaaaaagtattagcagaagcaaaagaaaaagaagaagagtatcagcgaagttttggcttctcactgattgcaggaattggattatgtattttttcacttttcccacttttggcttctttaatgtggtatatggatggtagtatcggtgcctctatattttttgttacggtaggaacgggtgtcttcttgatcatttatggcagtctagtccgtcattcttatcgtcaattcactcaaagcgcttattactggtga

SEQ ID NO: 3053 - DNA (genomic), 207 bp, Enterococcus faecium; double-stranded, circular
  misc_feature (B) LOCATION 1...207
  hypothetical: NO
  anti-sense: NO
atcggtacaatagaattagacagaaaaaataaggtgtgtagattattaaaaaacacattggaggatttttcatgccaagacttcaacgaagaacctattcaaaagaattcaacnaacaaatcgtcgatctctatctcgntggtaagcctcgcgcagaaattattcgagagtatgagcttacgccttcttctttcgataaatggatga

SEQ ID NO: 3054 - DNA (genomic), 414 bp, Enterococcus faecium; double-stranded, circular
  misc_feature (B) LOCATION 1...414
  hypothetical: NO
  anti-sense: NO
angtntgnannggngcccnnnnnnnnnnnnnnnnnnnnnnnnnnnnnnnnnnnnnnnnnactggtgaagattgcatatgtagagcaaaaagctgatattgattttacttttccaataaaagtaaaagaatgtgtatctatgggaacatatgccggaatgaaagtttttcaaagaattaaaaatgcagaatggcaaagagtttcaaaggctttggaaaaggtcgatatgggaaaatattctaatcatcaaataggagaattatctggaggacaatttcaacgtgtacttttagcaagatgtcttgctcaaaatgcggatttcatatttttagatgaaccatttgtagggatagacttagttagtgaacgaataattatggatacgttaaaagaattgaaacatcagggggaataa

SEQ ID NO: 3055 - DNA (genomic), 1314 bp, Enterococcus faecium; double-stranded, circular
  misc_feature (B) LOCATION 1...1314
  hypothetical: NO
  anti-sense: NO
aaaataacaatggaagtagaggtgcagagaatgaagaaaagaatgagaatcatcttagctttaagtgttatgttattcttcttgacggcttgtgggcaagaagatgacaaaaaaatcacgctgaacatggcttggtggggttcgcaagtccgacacgatgcaacagtaaaagtaatcgagctttatgaagaaaaaaatccccatgtgacgatcgattatgaattttatgattatgaaggatattacacaaaattaggtacactagcagcatcagatgatatctgggacattttccaactgaacaatcaatttcctcaatacatcaatcagattgaaccattagatgaatatgtggagcaagggataattgatatttctaatgcagatgaatcctatttagcaacgacgacttacgacgggcaattagttggactgtctaacggggtgaattcgtttgcgattgcttacaataaaaatatatttgaacaattaaatatccctgaaccagcttcaaattggacatgggatgaatttgaacaaatcagctatcaaatcactgaagaattaggaatctatgctatttcaagattcgaagattttatagctggctgtattattcaaataccacaagttgagaaaggattgaatttttataatcgggaagatctatctaacagcttgggatttgaaaatccagactatctaacagattttttccagctgcgtaaaaatctggtagacaaaggggcccatccagaaccaggtggtggagctgcaagtacgacggatctgtcttttcaggcggttagggatagagaagcggcaatggtgtttctatcaagtaaccagttgacagaaatattgtcaggggctcctgaagatatggagattcagttgattaatccacctcgcagaaaagcagatggagaatctggtatccctttacgttcttcgcaaatgctgagtatggcaaaaagctcagcccataaagaagaagctgctaagtttattgatttctttcaaaacagtgaagaagccaatgaaattttaaaaggagaacgtggtgtaccaatcatgtcgaatattcgagaacagctcgctcgtgcagatgatgcaactttgcaagcgacatttgattatttagaaatgatttccgatatggacaacggcgaagtgaatgtctttgatagtgctttgaatccggaaattcaagaccaatacaatcttttagttgaaaaagtcatttatgaagaagtaacagcagaagaagcagcagagagtctttatgagtttgcgtcaaacattctaggatag

SEQ ID NO: 3056 - DNA (genomic), 645 bp, Enterococcus faecium; double-stranded, circular
  misc_feature (B) LOCATION 1...645
  hypothetical: NO
  anti-sense: NO
ctaaaaacaatcaacaagtatcgaaaggaggtgaggcgaatgacgacaatgaaaacatttctagcagtaaagaatgaaggcgcagtaccgcaaatttttattcagggatttattggttctagttggttctttgaagggaatactgacaagggaatcaaaaatattttggatagtctaggtgatcaagaagaaattgaagtagtaattaattcaaacggtggagacgtatttcaagggattgctattgggaacttacttaagtcaaataaagcaaaagttaacgttgtgattaacggcttagccgctagtgctgcttcaattatcgcaatggctggcgatactataaaaatctacaacaatgcacaattgatgattcaccgcgcttccacatacggagaaggaaatgtcgatgacttccgtacgattgctgaccaactggaatcaattgataaatcggtaaaggcttcatataaaacacgattcaatggcacagatgaagcattgcaagaacttcttgaaaaagaatcgtttatggatgcagaaacagctttgagttatggattggtcgatgaaattatcgatgcagaaaatagctcaggtactgaagctaaaaaagaacaaagcgttgaagaaattgtcgaatga

SEQ ID NO: 3057 - DNA (genomic), 1032 bp, Enterococcus faecium; double-stranded, circular
  misc_feature (B) LOCATION 1...1032
  hypothetical: NO
  anti-sense: NO
ggaaaaacaatgatagtaattatgaaaaaagaagcaacggaagaacaaataaaaaaagtcgtcgatcatatcgaaaaagaaggattcaaagtctcaatcgatcaaggaacagaacgagtagtgattggactaaaaggtgatacgcgaagtttacaagaaggagcatttacacgctatgaaggagtagaaaatgctgtgcgtattttaaacacatacaaattgacttctcgagaattccatcctggcaatacagtcgtggatgtagacggagtaaaaattggtgacggcagtttcgtgacgatggctggtccttgttctatcgaaggattagaccaaatcagagaatgtgcgcgaatggccaaagccgggggcgcaaaaattctgcgaggtggtgccttcaaaccacgtacttctccatatgctttccaaggtttagaagaagaaggattgaaatacatccgtcaagcggctgatgaatttggaatgaaagtgattactgaagtgatggatgaagggcatatcgatatggtggctgagtacagcgatatcctacagattggcgcacgtaatatgcaaaattttaaactgctatctgctgtcggtaaaacaggtaaacctgttggattgaaacgtggaatttccggtacgatcaatgaatggcttaatgctgcagaatacattgcagtcgaagacaaatctcctgtcatttttatcgaacgtgggattcggacttacgaaacagcgacacgtaatacgtttgatttaagtgctgtcccattgatgaaaaaattaactcatttccctgtgattgttgatccaagtcatggtacaggaatttgggaacttgtaccaccaatggctcgtgcgggtgtggcaagcggagcagatggcatgatcgtagagatccatcctgatcctgcaaatgcttggtcagacggtccccaatcgttgaatgaaaagacttactcacgcatgatgaaagaagttgcgatcatgaaagaagcaatggaaaagattcagacactcgattaa

SEQ ID NO: 3058 - DNA (genomic), 273 bp, Enterococcus faecium; double-stranded, circular
  misc_feature (B) LOCATION 1...273
  hypothetical: NO
  anti-sense: NO
gggtgcgcaatttcgtacgcgttttgtgcatcgtgcaagttactattacatattagatcactctttgagtggtctttttatttttgcacaaaggaggaaacaacaatgtatagaccacaatacttagaacagaagtatgaagtaatcactgttcataaaggtaatggcgaaaaagtatatgagtatagaagaccaataaagagcgatacatataaacgaaaggaaaacaatgaagttattccattgtatggcaaaagaatagctaagcattaa

SEQ ID NO: 3059 - DNA (genomic), 1281 bp, Enterococcus faecium; double-stranded, circular
  misc_feature (B) LOCATION 1...1281
  hypothetical: NO
  anti-sense: NO
acaacagcaatgaaacagagttgtcgaaagagttgttatgccgatacggattttagcagaaaggataaaggaattatgaaatatcaaaaaataaaagaggcattgcaggcgttacaagagggaaaacttgttttggttatggacgataaagagagagaaaatgagggggatttaatttgttcggcacaatttgcgacaacagaaaatgttaattttatggcgacttatgcaaaaggcttaatctgtatgcctatgagtgaaagtctggctaacaggctcatgctttcccctatggttgaagataatacagataaccatgaaactgcctttacagtttctattgattataaggatactacaacaggtatttctgccgaagaaagaggattaacggctcgtatgtgtgtgactgagaatgtaaatccctttgactttcgtagaccggggcacatgtttcctctgattgcaaagaacggaggtgctttggaaagaaatggacatacagaagcaacggttgacctattgaggttggctggcttaaaagaatgtggcttatgttgcgaaattatgaatgaaaacgggaaaatgatgagaacacctgatttaattcagttttctcaaacacaccatatacctaccctcacaattaaagaattacaggaatacagaaaagtatatgatttgcttgtagaatgtgtttcggttgtagaaatgcctacaaaatatgggaatttcaaagcacattgttatatcaataaattgaatggagaacatcatgttgcattggttatgggagatttgaataatggaaacgatgtgctatgtcgtgtccactcagagtgcttaacaggagatgcctttggctctttacgctgtgattgtggacagcagttagataaagcaatgaaaatgattgcagaaaatggttctggtgtattgctttatatgcgacaagagggacgaggtatcgggcttgtcaataaactaaaagcctatcatttacaggataacggtatggatacacttgacgccaaccttgcattaggatttcaaggcgatttaagagaatattatatcggtgcacagattttaagagatttgggaataaaatcattgcatttacttacaaataatcctgataaagtttatcagttagaagattatggaatgaaaatttcaagcagagtaccgattgaaatagaagcaaatccttatgatagtttttatctaaagacaaagaaagaccgaatgggacacattttgaatatggaggaaaaataa

SEQ ID NO: 3060 - DNA (genomic), 954 bp, Enterococcus faecium; double-stranded, circular
  misc_feature (B) LOCATION 1...954
  hypothetical: NO
  anti-sense: NO
gctgcagcaatcggttttataaaggttgctgcagtttttttaaataagaaggtgaagaaaatgaaaaagaaaataggtaatagacctcaaacccaaatcagtcttttattacaattatttatggcagtgatgtttcttgccggagctgcagtttttacatatccatttttagcagatgctctcagcaattatttggatcaaagaaggatcgagaattatcaaaagcagcttgaacgcgataaagaagaaaaacatgagcaacaattagcagtgcatgaaaagaaaaatcagacgcttgctcatacatcagtaatcccaggaatgggacaagtcaaagatccttttgagcaagcggttagaaatgtccaaaatccaggaaaagaatattacgaacaacatatgatcggagccatctatattccgaaaatcaatgttagcttgcctttatttgatgaaacgaatgatcttttgttagatagaggagcgacagtcctgcaaggcacctcttttccaactggaggagagagtacacattccgtgattaccgcccatagcggtattgctgagaaaaaactctttacggatcttgaagaaatggagcaagatgaccgattctatcttgaagtgtatggtcggatgctcgcttatgaagtcgttgagaaaattgttgtccttccaacaaaaacaaatacattagcaattagagaaaagcaggatctagtcacacttatcacttgtacaccttacaccgtgaacactcaccgattactagtgacaggaagacgagttccctttacagaagaagtctcttcaaagatagaacagacaaaaaaataccatctttatcgattacttatactccttctaggtatattgctagtgctaacgcttttcggttattggtgttatcgaaaatttaaaagacaaaaacaacgaaagaaaaataacagataa

SEQ ID NO: 3061 - DNA (genomic), 1983 bp, Enterococcus faecium; double-stranded, circular
  misc_feature (B) LOCATION 1...1983
  hypothetical: NO
  anti-sense: NO
aaaatggcaataaatcggtatgtaaaaaaagctggaatgcttgttggaatgttaggaatcattgcaggctgctttcagggatatcgagcatatgcagaagatgtcacgcaaaaaacgccaccagagaaggtcaatatcacggttcataaattaatgtatgatcaaggaacgcaattgaatgttgatgttgacgggatcaaaaacgatggttatacgcacgatcaatatcctacgggtgtaacgaaatacaacaaggcagattatggtgatgttgagtttacgttaggaaatattacggatcaagtattaccgagggaagattctgatctaaccaacgcgaaagtggacgaaatcgttaaagatgtagaagacaagggatctaacagtgagtacgtcaagaatgcaaccaacaaaattacttcagctgtagatgaaaatggtgagattacttttgctgatcaaccagcctatgtcaacaattccaaagggaatgtatatgtggtttatgaaagtaaatccgctgctggattagtcacacaaaaagcaaaaccaatggttgtgattgcgccaatgactgataatacaggttcaggttttttaaaagacattcacttatatcctaaaaatattgtttctaagttgagttttgaattaacgaaatttggtgacgatggcacagctcaaagcaaacaaacacctttaaaaggggcaaaatttgagttatacaagggcgaacctggaaaaggaacaaaattaggagatcttgtatcggatgatcaaggaaagctgactgctactgatttgacgttaggaaaatactattttgtggaagttccttcagaagttgtagtgggatcagataaagaaccaacagccgatcaatatttattaggcgcagacgctcgcaacgatgcgcacaataaattaacctttgaaattacgaatgatggcgtgacaagtgacttaaaagcttcatacgtaaactataaagcaccagtgatcgataaaacagtaacaaatggaacaggacaagaacattctttccaaattggtgacgcagtaaattatcaaggaacgattcatatcccaacagacattgcaggcggagcagacggtatcacagtaaacggagtgaaaagcgaaacttctccttacagtgtatttaaatggggggatacagcaggacaaggactttcttatgtcgctgctaaagcaaatatcaaagtaacaaataaagatggatctgtggtattaaaagaaaatacagattataaaatccaaaattcagaaaatggctttgtgatcgattttatcgtgaataatggccaagtaagtgatactgtagcaagtttacacggacaagatcttcaaatgacttataacatgtatgtaaatgacagcgcagctgttgccaatccattaacaaatagcgtggatttcgtttataacaacaatccatttaatcaggaagaacaccacgaaaaaacgaaagctgacgttgtgacttatggtgcaaaattcttaaaagtcgatagcggactatttggaacaggaatcaaagcaacaccgcttgaaagcgcagaatttgctgctaaaaacgcagaaggaaaatattatggtggattagttgatacggataaaaacggtgtcaaagaagcagtatgggtagacgatgtagcaaatgcagcgatcctaaaatcagataaagaaggtcactttgaaatcactggtttaactgaaggtgaatattcactggaagaaacaaaagcgcctgaaaactatcaaaaattaacgaaagagatctctttcaaagtagacaaagattcatacaaagaagaaaaccgaattacgatcaaaaacaatcaaaaagcttccgtaccaatgaccggtagcaacggttttcaaacgtatgtattaatctcttgcttgttgctaggagcaggggcactttctgcagttgtttactttaagaagaaagcctag

SEQ ID NO: 3062 - DNA (genomic), 798 bp, Enterococcus faecium; double-stranded, circular
  misc_feature (B) LOCATION 1...798
  hypothetical: NO
  anti-sense: NO
ctggaggcaatccacatgtttaatctattaactgctgaaaaaataaaagtatggaagagccgtaaaatgtgggtctcactaggactgatggtcgtacttccgcttttttattcttggaacgaatggtatatgcatacaaaatacggcaatgaattaaaccaagcaacggatacagtcatcaacggtgcaacagggattttaatggtggaaaaaatggctgcatggattcttctggctttcgcagcatttgcgtgcttttatattggggaagaatttcaaaacggtacgattcgcaatacgttatctttaggacggaatcgaatgacttattatgtgtcgaaacttctcgttacgcttttgatcacaacacttggcgtggttttgattacggggctagccatgattgcttacacacttgctttcggatttggtgaagttgagggaatcaaaaactatggaaattatgttctaaaagtatttcctgtattgcttctgctgatattagcgacattatctgttccagtggctttgacattcatcactagaagtaccagtgtcagtttgcttctttcttttctttatatcatgggaacggccttcgttcccggtgttttcgcaaaaatcaaaggcttggaatttctaacggagtggtttacggaaacgtggctcatgtatacggactttgcgcaacaagcaacttattcgcaagcaccgaaaatgattctggtcagtctagtaacaatcgtggtatcatcagctctaggaatgtttattttccaaaaatctgacattaagtag

SEQ ID NO: 3063 - DNA (genomic), 393 bp, Enterococcus faecium; double-stranded, circular
  misc_feature (B) LOCATION 1...393
  hypothetical: NO
  anti-sense: NO
ctttgggcaataaaggaaaggagaaagtcaatgcaagaacaatccgttatggaaatcattaaatggtttataggtttaatgatgattatggcaatggtttctataggacttttttgtgttcaattacaagatattaatactttcaagcaacaagtaaattatcaaattgaacgaaaaggaggtctgacgacagaagctgttgaagcaatcgacaaatattcggctactaattatgatagacgttttacaattgaaagcgataagttaaatcagaaagtatcttatggagaagaaattgattatacgatcaaagcaactattccaattcaaattttaccgcttcctgatgtaactttatcgtttaacggaaatagtgtttctcaaataagatga

SEQ ID NO: 3064 - DNA (genomic), 210 bp, Enterococcus faecium; double-stranded, circular
  misc_feature (B) LOCATION 1...210
  hypothetical: NO
  anti-sense: NO
atggatgttttacgagagtattcatcactatttactgaagcctatttactggagcagttcggctataaaattccttttgcagactatcaacaaggtgttgggacggcagcagaactgtccttttatgaagggataagtcaagcggttgggagaccagtggatgctgaacattttgagcagcggatcagcagcactggaaaatcggagtag

SEQ ID NO: 3065 - DNA (genomic), 201 bp, Enterococcus faecium; double-stranded, circular
  misc_feature (B) LOCATION 1...201
  hypothetical: NO
  anti-sense: NO
ctttttcaaattccaatgtttcaaggattcggttattcattttatcaccttatctttcactatgaaaaaagagctgtgccggacatacgctacgcagccttcttaaataaactactctgtacaaaaaacgaaatattttccagcactattttccttaattcaaaatattcgttacccaaagctcatacatcttgttggtaa

SEQ ID NO: 3066 - DNA (genomic), 552 bp, Enterococcus faecium; double-stranded, circular
  misc_feature (B) LOCATION 1...552
  hypothetical: NO
  anti-sense: NO
gttcttcaaatgaaactagataaatatacagtaggaagacgttacgggaaagctttatttgaactggcgatcgattcaaataaagcagaagaaatttatcaagatctcgtaagcttacgtcaaatctatgaacaagtacctggattaggtaatatgttaagtgatgttcgtctagaacctcatgaaaaacgagaaatcatggacaagcttgttagtggctatgatggaatcgttaaaaactttttagaagttgtttatgcgtataaccgaatggatgatcttttgttcatgatcgaagaatatgaacgtcgatatgatgaacatcaaggtttgctgttgggaagtgtcacaacagcagttccactttcagacgaacaacgaatacaattagaaaagaatgttgcaaaaacaatgaactatcaatcagtcgaattaaaacaaatcgttgattcttctattattggtggcgcgattgttgaagctaaccatcgagtaatcgacggaagcattcgcacgcaattagaaaatatgcgtaatcaattaaatagatag

SEQ ID NO: 3067 - DNA (genomic), 333 bp, Enterococcus faecium; double-stranded, circular
  misc_feature (B) LOCATION 1...333
  hypothetical: NO
  anti-sense: NO
acttatcaaataaaagacttctttggaggaatcactatgaaggaatatataaaaaacatctattttatcgaagaaacacaaaatatcgagggttcttatattgaagtaaaaacactctttgtcaatgaagataaaaccaaagcattggatatttataaaaaattagcttcaaaaaaaacgaatagttttggattgatattaagcgagtataaaatcaaagcagaagagagttatttctatcaattactaaaacggtggagtaagcttcccgccgatttttatcgaaaaatgcagatcatcaactatcaaccgcttgctgagacacatgcctaa

SEQ ID NO: 3068 - DNA (genomic), 750 bp, Enterococcus faecium; double-stranded, circular
  misc_feature (B) LOCATION 1...750
  hypothetical: NO
  anti-sense: NO
aactatcaaatcagaaagcgaagtgaaaatatgggacgtaaatgggcaaatatcgtagcaaagaaaactgctaaagatgctaataatagccggatttatgcaaaatttgggattgaaatctacgcggcagcaaaatcaggtgatcctgatccgcatgcaaaccaaaaactacgtttcgtcattgatcgcgctaaaacttataatgtaccaaaacatattattgaccgagcaatcgaaaaagcaaaaggtgcaggagatgaaacatactctgaattgcgctatgaaggatttggaccaagcggctcaatggtgattgttgatacattgacgaacaatgtgaatcgaacagcagcagacgtacgggcagcatttgggaaaaatggcgggaacatgggtgtttccggagcggtttcttacatgtttgacaatacagcaatctttgcttttgcaggagaagacgctgacgagatccttgaatacctaatggaaaaagacatcgatgttcgcgatgtaatggaagaagaaggacaaatcatcgtttacggtgaagtagcggatttccatagtatacaagaagcattaaaagaaaaaggaatcactgatttttcaatcgctgagatccaaatgatccctcaaaacgaggtaacactatctccagaagatcaagaaacatttgaaaaaatgattgatgcactggaagatctagaagatgtacagcatgtgttccataatgtggcattagaagactaa

SEQ ID NO: 3069 - DNA (genomic), 195 bp, Enterococcus faecium; double-stranded, circular
  misc_feature (B) LOCATION 1...195
  hypothetical: NO
  anti-sense: NO
gaatatcaaatactttcaaggatgctgcttcttaaaataaatattcaaaccaatggaatacatcatgcaaaaaaagccagacaaccgaagtccttgcgtgtcagctgtctgagcaaagtttatttaatttgttcttttaaaaagaacgatacacatactgatttttcggagcagagactttctcagcgtttgtaa

SEQ ID NO: 3070 - DNA (genomic), 939 bp, Enterococcus faecium; double-stranded, circular
  misc_feature (B) LOCATION 1...939
  hypothetical: NO
  anti-sense: NO
cagaatcaaatgaagaagttgattttgacggaaacgaggaaagctgagatgagattaactgacttttcagctattcatctacctgctgtagaaaaagaaatcttgtcttttttagatgagcatacaacggatagaggactctatgatgcgatgagttattcagtgaaagcaggcgggaaaagaatacgtcccttattacttttaacggccgttgcttcctttgatgagcctattgatgttcccgtctatcaagtagcagctgctttagaaatggtgcatacgtattccttgatccacgatgatttgcctgcgatggacaatgatgatcttcgtagaggaaaacctaccaatcataaagtattcggcgaagcattagctatattggccggagatggtttgcttacaggagcattccagctaatcagtatggcacacttaggtaattctcctaagcttctgctgcttcagcaattagctgtttgtgcgggatcacaaggtatggttgctgggcaagctgcagatatcgagggcgaatcgaaaaagctttctttagaagaattagcatttattcatgaaagaaagacagggcatttgattcgttatgccttgctggctggtggcatattagcgaagcaacctgaagaaatcttattgctacttcaacgattagccgaacatttaggtttagcttttcagataagagatgatctactcgatgtgattggtacaacgaaaacattagggaaaacagctggtaaagatgaacgtatggaaaaaaatacttacccgcgtttattaggcctagaaaagacacgtgaggcgttggagattgagctgttatccgccaacaagatcatagacaaattagaagaggacgttttttcttttgatggcgggctgatgcgccagatgatcaagcaatttgatgtggagaaatga

SEQ ID NO: 3071 - DNA (genomic), 1242 bp, Enterococcus faecium; double-stranded, circular
  misc_feature (B) LOCATION 1...1242
  hypothetical: NO
  anti-sense: NO
ccgcaccaaatattgcaaaagctcgcttacctatccaattttaatcacggagaggaatccgaaaaaatgagtaaagaaatgtcaaatgcgttagacgctttagaagctgaaaaagggatctcaaaagaaatcgtgatcgatgctttagaagcagcattggtttctgcatacaaacgtcactatggccaagcacaaaacgtcgaagtggaatttgatcagaaaaaaggaaagatccatgtctatgcggtaaaagaagtaacggaagaagtgatggattcacagttggaagtctcattgaaagatgcacttttaatcaatccagcatatgagatcggtgatacgatccgttttgaagtaacaccaaaagattttgggcggatcgctgcgcaaacggctaaacaagttattttacagcgtgtacgtgaagcagaaagaacgattatttataacgaattcagtgcttatgaaaaagacatcatgcaaggaatcgtcgaacgccaggataaacgttatatttatgtcaatcttggtaaaattgaggcagttctttctaaacaagatcaaatgccaaatgaattttatcaaccacatgatcgaatcaaagtttatgtttcccgagtagaaaatacgtctaaaggtccgcaagtatttgttagccgcagccatccagacctattgcgccgcttatttgagcaagaagtaccagaagtctatgatggaatcgttgaaattgtcagcatcgcccgtgaagctggcgatcgttcaaaagtggcagttcgctcaaatgatccaaatatcgatgcagtcggtacatgtgtcgggccaaagggacaacgagttcaagcaatcgtcaatgaattaaaaggcgaaaacatggatatcgtcgaatggaatgaagatccagctgtattcattgcaaatgcattgaatcctgcacaagtcatggatgtgatcttcgatgagacaaatccaaaggcctgcacagttgtcgttccagactaccaattatcgctagcaatcggtaaacgcggacaaaacgcacgtttagctgctaaattgactaaccataaaatcgatatcaaatcagaatctgacatgacggaattttatgaaaatcaagaacaacaaaaagaaacagaagaactgcatgatgaagcaatcgttcagtcagatttaacagacgatgaatatgaaacaattgcattcaacaatgaaacggtcgaagaaaaaccagaagcttaa

SEQ ID NO: 3072 - DNA (genomic), 1293 bp, Enterococcus faecium; double-stranded, circular
  misc_feature (B) LOCATION 1...1293
  hypothetical: NO
  anti-sense: NO
gtgagccaaatcaaaaaagtcagattgagcaaacaatcaaaaaatggctggaggcggaataaaatggaagaaaaagtgatcatcgtaggggtagaaaccgaagcaaaccagcgttacttttcagagtcaatggaagagctagttcagctgacgaataccgcatcaggagaagtcgtattcacaattacacaaaagagaccacaagtggatcggcaaacgattatcggtaaagggaaattacaagaattagttcaacaagcggatgcgcatgaagcggatttgatcatctttaatcatgagctaactccgagacagagccaactgattaccgatgctgttggtcttccggtaattgatcgcgtgcagcttatcttagatatttttgcgatgcgtgctcgttcgaaagaagggaagctgcaggttgaacttgctcagttagaatacctgctgcctcgtttagtagggcaagggaaaacattatctcgtcttggcggtgggatcggaacaagagggccaggtgaaacaaagttagaaacagaccgccgacatatacggaataaaatttttgctgttaagaaagaattgaaagaagtagaagctcatcgagagcgcaatcgccaaaaaagaaaaaatagcgagatttttcagattggacttattggctacacgaatgccgggaagtcaactatcttgaatctattgacacaagcggatacttattcgaaagatcaattgtttgcaacgttagatccattgactaagagatggcgttttgctgaaggatttgagattactgtaacggataccgtcgggttcatccaagacctgcctacgcaactgatcgatgctttccattctacattagaagaaagtcaaaatatggatcttttgctacatgtagtcgatgctagttctccagatcgtattttacaggagcagactgtcttaaaattgatggatgaactgaatatgaaagaaatgccgatactgactgtttacaataaggcagaccagatcgacccagcgatgttcacgcctacgctattcccaaatgtattgatttctactcagacgaaagaaggtaagatggcgttgatcgaagcaatcaaacgtcagctgatggaactaatgaccccttatacactttctgtgccaagcaacgaaggacagaaattaagcgagttgagaagacaaacaatggttttggacgaagcgtacatggaagaaacaaacgaatatgaagttaaagggtttgcaaaaaccaattcaaaatggttaagaaaaaaccaataa

SEQ ID NO: 3073 - DNA (genomic), 201 bp, Enterococcus faecium; double-stranded, circular
  misc_feature (B) LOCATION 1...201
  hypothetical: NO
  anti-sense: NO
gagggccaaataatgaaagaactattttcagcatacaagctccctattatctttgggggtcttggactactgctagctgttttatggttaacgattggatttttcaagacattgttgatcataatcatgacagcaattggcgcaggaatcggtttttatttgaaacagtcaggaatagttgatcaattttttaaatcatag

SEQ ID NO: 3074 - DNA (genomic), 348 bp, Enterococcus faecium; double-stranded, circular
  misc_feature (B) LOCATION 1...348
  hypothetical: NO
  anti-sense: NO
ccgttacaaatctttcgtgcgtatcctcaggttattcaagatatcaatcaagtcacactgcaacgaggaaccttcgtgtattggtgttgttgcatagactcacaggctttggattcgacctttgctaaagatgatacgttgttaccaattactttacgtttggctaccgctagtcgtaaaggagtaagaagtgagcgtggacaaagatcctccctaaaaaggggtctttttctctatgtaaaaaagaggaaaagtttgctgaatttaagtgctttattgtatttttttgacgtacttaatcaagtacgctataattatatcagaaaaaggaggagagacaatggctaa

SEQ ID NO: 3075 - DNA (genomic), 375 bp, Enterococcus faecium; double-stranded, circular
  misc_feature (B) LOCATION 1...375
  hypothetical: NO
  anti-sense: NO
agtatgcaaatattaggaggaaacaatatggcattcccacaactagatttaaaaagtgaaaaaggaccaaaagctgttatcaaaacaaaccgtggtgacattactgttcaattattccctgaactagcaccgaagacggttcaaaatttcattgaactttccaaaaaaggttattatgatggcgtgatttttcaccgcgttattcctgatttcatgatccaaggcggcgatccaactggaacaggaatgggtggcgaagtatttatggcgaaagttttgaagatgaattcagtcgtgaactgttcaaccttcgcggagctttatctatggcaaattcaggtccaaacacaaacggaagccaattctttattgtaa

SEQ ID NO: 3076 - DNA (genomic), 1704 bp, Enterococcus faecium; double-stranded, circular
  misc_feature (B) LOCATION 1...1704
  hypothetical: NO
  anti-sense: NO
gtgaagcaaatgaatcaattcctgagttataagcatattgaaaattggttcaaagctatagaagaaggcactatcaaggtatgcaaagagcaattattgctaaaaaattatctagaagaaagagtctttactagagaagatatttacttcgataagcagatggtagaggattcaatcaatataccagcacaatactttccattcgaattaattccgtgggaaaaatttctacaatgttttatttatggtgttcgatggaaaaaagataaaacactagtgttcaatagatatctttcattaatgggacgtggtaatggtaaaactggttttgcttcttggaacaacttctttctactaaccgctaaacacggtattaaaaattatgatattgatatctatgccaataatgaaagccaagcaaagactagttttgatgatgtatttaaagtaattaaagatcatcctgatttagataaaaaagtatttaaagctacgaaggaagttattcaaaatatcgctacaaacagcaaacttcgttataacacggcaaatgctagaacaaaagatgggaagcgaccaggtgcaaaccgctttgatgaaattcacgaaaatgaagattattcaatgataaatgtggctacttctggtggtggtaaaattcgagattatagagaattttatgatacaactaatggtcatgttcgtggtggtccgcttgatgacattatagaagaatcaaaaatgattctttctggagaacttggaattgacaaggatggagcagaattttctagtttgtttccatttatttgtcgcttggataacgataatgaagttgatgatcccgacatgtgggaaaaagcttgtccaactattaattacaatgcagatttaaaacggaaaatgtttcaagaatactctcaaatgcaacgtaatgctggtttaagacttacgttcatgaccaaacgaatgaacagacctatggaagatacacgatttgctgttgcttcatatgatgatgttctgcatacgaaagaaaaagaatttcctgaaaaaatggatgaagtgataggaacagtcgattttgctgatagacgagattttgccagcgttgggttgctaggaaaatacgataaagatgtttattttacacaacatacttttatccacgaatcagcccttcgattacaaaacatcaaacgagaggttatagatatttctatagatcaaggaaaatcacagatcgttcatggaaaaaatatagaagctgattatattgtaggttggtttcttgaaatgagtaataaatattatattaaaaaaatcgctatggatatgtaccgtgcaaaaatattgaagcccgctttagaagaagcaggttttactgtggaaattgttcgaagcggatctgttacacatggtatgttaaaagatctggttgatgacctttttattaatcaacgtttattttttggtgacgatgcgattatgcgttggtattgcatgaatgtatatgaagagcatatttctaatggaaatatacgctatgaaaaaatagaacctgaaactagaaaaacggatggctttttttcattccttcatggtttgaattttttagatgatatttatgattctgctcctgtaacagtcacaaatagctcagtagaaaatacaggaactggatttactcctctagtattctaa

SEQ ID NO: 3077 - DNA (genomic), 957 bp, Enterococcus faecium; double-stranded, circular
  misc_feature (B) LOCATION 1...957
  hypothetical: NO
  anti-sense: NO
aaggagcaaataatgaaaaaaattcgtgatttagtaatcgatgagcagtttgaacaatttgtcctgatcaaaagtgcagatgtaagaatcgctaaaaacggaaaaaaatttattgcttttactttccaagatacttcaggtactatcgatggtaaatactgggatgcttcggaggaggaaatcaataaatttacagccggcacagtcgtttttctaaacggtaaaagagaggtttatcaaggaaaccctcaagtaaagattcttcatatgcgcttaacaagggtagatgagccaggagagcctagtttatacatggaaagagcccctttgaagaaagaagaaatggaagaagaaatcaatcaattgttgtttgagatcaccaatgcgcattggaatcgtattgttcgctatctacttaataaatatcaaaaacaattttttgagtttccggcagcaaaaagaaaccatcatgcatttgccagtggattagcttatcatactttgacaatgcttcacttagggaaatcaatcgccgatgaatatcctgagctgaatcgagcattgttgtatgctggtatcattttgcatgatttaggaaaggtgattgaactttccggtcctatgtcgacagaatatacgcttgcaggaaatttgatcggtcatctggtattgattgacgaagaaataactaaagcctgtcttgcgttgaaaatcagcgaagctgacgaagatgttctcgtattacgtcatatggttttagcacaccatggcttattagaatatggctcacctgtacgtccaagaataatggaagcagaaatattacatcaaatcgacaatatcgatgcttcgatgcagatgatgttgacttcgattcgtcaaacagaaccaggaaaatacaccgatcggattttcggtatggacaaccgaagtttctatgtaccaaaagatttatag

SEQ ID NO: 3078 - DNA (genomic), 249 bp, Enterococcus faecium; double-stranded, circular
  misc_feature (B) LOCATION 1...249
  hypothetical: NO
  anti-sense: NO
aaaaggcaaatgatagcgatttgtactctttccattgccaagataagcgattgtaagcatgagtggtgcctccttttattgatgttttcagtatatcctagaaaagcgcagaaagtatttataatagctattctggtaaaaaagttcagaaaaacacttgttatcattcggtttggtgaaattaatgttcaaagtaaggataaaaatcaaaaagatagtagcggaaccaagtgtttatcagtaagatag

SEQ ID NO: 3079 - DNA (genomic), 492 bp, Enterococcus faecium; double-stranded, circular
  misc_feature (B) LOCATION 1...492
  hypothetical: NO
  anti-sense: NO
ggagttaaaataatggaaataccaacaaatttaaaacataaaccagtaatcgttgtagaagactatgataaagttgatggaagaaatgcattaaatatggatgcaaaagggctttcactgggccttgctcagtggaatgatcgtggaaaagtcgatatctcaggcaaggtatggcgacatactggagaaaaatggtcacgacagtcggaagaattaccaatcacacgtattttagatttagcgatcttagctgcgcaaggaagtttatacttccaagatgcttatcgttatgaaaaattttatgatccagaaaatccagtcgtagacatcattggattacaagggaaccgaatgacggtagaagtagataccaaaaatccaaagatcgatgaagacatcattttgtattacgatacactacaaaaagacggagaactgattggggaacgattccgtattttaaaacgtcttttagatgagctaggatattaa

SEQ ID NO: 3080 - DNA (genomic), 2370 bp, Enterococcus faecium; double-stranded, circular
  misc_feature (B) LOCATION 1...2370
  hypothetical: NO
  anti-sense: NO
ggtgataaaatgaataaccgaatccttgaaacattggaatttgaaaaagtcaaacagatggtcagacaatttgtagtgactgcacaaggaaaagaagaactggcagaattggtaccagtgagtgagaaacaaacgatcacaaactggcttcaagaaactgaggatggattgaaagtgcaacgtctgcgaggcgggatccctatacctaaacttgaaaatatccgtccccatatgaaacggatcgagatcggagcagacttgaatggagtggagcttgcacaagtttccagagtattgtctacgacaagcgaattgaatcgtttcattgatgatctttctgacagtgaaatcgaatttgcacgtttgtatatgtgggcagatcagttagtcacgatccctgttttgagccgccgtttaaaggaagcaatcgatgaagacggacgcgtgactgatgacgcttctcctgagttaaagagcataagacagaacattcggcgaagtgaacaagctgttcgtgaacagttagatgggatcgtccgtgggaaaaatgcaaagtatttaagtgatgcgatcatcaccatgcgaaatgaccgctacgttatcccagtcaaacaagaataccgcggtgtatttggcggtgtagtccacgatcaaagtgcttcaggacagactttatttattgaaccaaaacaagtggtggatttgaataatcgtttgcgtcaataccaaatcgctgaacgaaatgagattcaacgtattttaagtgaactttctgctgaacttgttccccatcgtcaagaaatcatccacaatgcttatgtgattggtaaaatggatctgatgaatgcaaaagcacgatttggtaaagaagtaaaagccatcgtgccgggaatcagtgaagacaatcatgtcgtcttgaaacaagcaagacatccactgatcgatcaggaaaaagtagtttctaatgacatcacaatcggaaaagactatcaagccatcgtcattacaggacctaacacaggtgggaaaacgatcacgttgaagactttaggtctgttacaactgatggggcaagcaggattaccgattcctgcaggtgaagaaagtcaaatcggtatttttgaggaagtatttgcggatataggagacgaacagtcgattgagcaaagtctatcgaccttttcttctcatatgacgaacactgtagatattttatcaaaagtcaatgaaaaaagtctggtattatttgacgagctcggtgcaggaacagatccgcaagaaggtgctgctctagcaatcgcaatcttagatgatcttggtaaaaagtctgcttatgtgatggcaacaacgcattatcctgaattgaaagtttatggatacaatcgggcaaatacgattaatgccagcatggagttcgatgtggatacactaagtccaacgtatcgtttgctgattggcgttcctggacgaagcaatgcgtttgaaatctctagccgattaggtcttgatacagaagttattgatgaagcgaagcagttgatgaatgatgagagccaagatttaaacgaaatgatcacagatttagagaatcgccggaaaatggcagagaccgaatatctggaaatgcgtcattttgtttctgaggcacaagaacttcacgatgatttgaaagaagcttacagctatttctttgaagaacgtgaaaaagaaatggaaaaagcaaagaaaaaagcaaacgaagtcgtgtcagaggcggaagaaaaagcagaaaaaatcattgctgatattcgtaaaatgcaacagcagattgggcaaggaaatgtgaaagagcatcagttgatcgatgcaaagacccaattagcaaatctacatcaagaagaaactttgaagaaaaataaagtattgaagaaggcgaaagaacaaaaaacgttgaaaccgggagacgaagtgttggttacgacttacggccaaagagggacgcttttacgtaaaaacgggaatcagtggcaagtagaaatcggtatattaaaaatgaatgtgtccgaagacgagctgacgcctgttgctcctcaaaaagagccgacacaacgagttatccatgctgtacgatctgaatctagtagtcacgtgccgaatcaattggaccttcgaggaaaacgatacgaagaagcgctaagtgaggtagatcaatatttggattctgccattctagctggttatcctcaagtgactattgtccacggaaaaggaacaggcgcacttcgcaagggaattactgattatcttaaaaaccatcggagcgtcaaaagctttgagtttgcaccggcaaaccaaggcggaaatggtgcgacaattgttaaatttaagtaa

SEQ ID NO: 3081 - DNA (genomic), 3213 bp, Enterococcus faecium; double-stranded, circular
  misc_feature (B) LOCATION 1...3213
  hypothetical: NO
  anti-sense: NO
aacgataaaataaaattgtcaaaacgtcagagaggatggtggagaatgaatcaatgtgtaaaaaagctgattgcgtcgattttgtttgtcttccctctcttgatggtgacatccgtttttgccgatgtagagaaaacaaacgaatcaacgcaatcagagaatcaaagttttgacaagactactttttcagaagaatcgattacttctgaaactacagaatctcaaagtgaggcttctactaataaaaggcaagaagaaaataagacaagtgagacctcagaagtagctgaacaaacgtctgatagcagtgaagcggcactggcaagagctgtttcagcggatgggtacagcgaagctgccacaacagaagaactggcgcagcttctcgcagacgaatcagtaactaagatccgactgattcagcctttgactttagacagggaattagagatcaaacgagatatcgttattgattttggtggattcgctcacaatttcggcacacaccatatttatatcaatgagatacctcagtcgatcgagttccagaattttaaaggaacagctgcacatccaggtggattgacaccaaatatcgatggaaatgccattatcattgcttatatgaccgatttttggggaagcagatatcattttacgggagaaataaaatttaccgggacacttgatttgtatgatgggtccaaattaggactgatttacgctcctcgtgcaactgtcacattagatggtgtttccggtgtgttggatgtccaaccagtgaaggaaggactgaatgccgctccgggtaaagcctatttttgtagaagctatcaattgaatgtgatcaatggtagtcaactttatggaccgtatctagggaaattctacggttttctagattcaggagatgagactggtagtggaaaaacagcgccaggaatccatatcttaagcggttcaaaggtctctcttgattatgatcgggcagatggcgttagcgatgaaggagaggcagtcgatacgctacctggtaatgtcatgtttgaagtcagtggttcgggaagcgaattttcggtaaatacaaagatcaatattaccaatgacaacaatcgcggaatcatccaaatgagaggttcaggatcgaaagtcactgtatcgaatggtgggaaaatcaccatcaatacagcaactacgggcggatttcgcttgcaaggagattctagtcaaatccatgtatcaagtggtggacaaatctcggtcaaaatggctggagatgacgatcaacccgggaacaatgggatgcgttttgtaggaaaaggcctttctttgatcgtagaaggagccggatcagttatcgacatcgataagcagagtgggcgttccagcgcagttcgttttgagaatggtacgcaaaagctgacagtaaccaatggaggctcattgagggtaagaaatacaggtgatggcaaatcttacgtgaacagactcaatcaaggaaatcaagcgatccaattttatgacgcttctggttttctagaaagtccaggttcagctgattttacagtcactggagaaaaatcaaatatcgatatacgcgcagattccggagcaactgtagatacaactggagatattgatttaaattttacggcaggtgaaaaaacttatttagtcatggtcgggaaaacaggggaagataagaccggcatcatcagtggggatgtgttgaatgtggacttagaatctcctacctattttgatttccaaaacaaacggattggaagcgagaccaatggcataggcggctgggtattccaaggaaatggagattcttctttaaagatcgcccattcagaaatcgctttatggcgaaaaacaggcgcaacattcgataactttgaaaaagacccggattatttttctgatatgacagacttatcgatcaatgggaccgacttaggcaatttcgtatcaagccctagtgcaggtttaacaaatgaatttgctcagacaggtgccggaatgaaaaattataatcgaatcagtgccaataatcagctcccgatgattgaatccttaagagtgccaacgaatgcagataaaaaaatctatgggcatgtcgttgttcccgaaggtgtcgaggcaaagccaagagatgcttggacaggcgaagtagaagtgactttacgtattacttacgcagatacgacgaaatcatctgtagaaattactgctctcacgcaaggacaaacagatgaaaatgaaggggcaggatataacccatggggagaaggcgaacaaggcggcttgttcgaagttcaagtacccaatgatgagagattaaaaacggaggatcaagtgcaagttgttgctgctaaaaaagtaagaggtggccaagaagtgacagaactggactctgccaaaacgacagtcgatgtgattcctcctgaacctgctaatttaagtaccacattgatcaatgcagcttctcgcacgatcacaggtacaggtgaagcaggagccttggtttcattgaaaaaaaatcaagctgttttgtcagaaacaactattgatgatacaggggaatttgttctttctatcccagaaaatcaactttttgcaggagatgtattagaaattgtattaaacgaccaagcaggagaagctactgctaagggtgtgcagaacaagccaagtaccaacgatgaaattgggaatcacaatccaagtgatacgccagttgtttatcatgatgccccgccttttgcacctgctacgaagatcgtagtagaaggtggtctctcatttcttgccccttccaaactcgattttggtcagatcaaagcaactggtttgacacaagaagcatttggccaaatggatatacaggaaaaattatggatttatgatcagcgagaaacgaaaaatccgtggatcttaacgataaaattatctcagcctttcacaaatgatgcaggattttctatgcaggatgtcctatatttcaagaaaggagaggagtatcaattagtgaatgaagaagaactggaaattgtcagaggacaaaattcaacgaatgtgcaagcagattattcagaatatttaaataacggtcgggcgtttaaacttgtcttaaccaaagaaaatcagatagctggtaattactcagcagagataacatggacattagcagatgcgccgacagaataa

SEQ ID NO: 3082 - DNA (genomic), 564 bp, Enterococcus faecium; double-stranded, circular
  misc_feature (B) LOCATION 1...564
  hypothetical: NO
  anti-sense: NO
ggcgataaaatgaaattaagcacagactggcgtaaagaaatacaaacgattccgaatcttttatcgatattccgtatttttttgctgccgatttatctttattttgtgctgagacagtcattttatatagcaggagcggtcattgttgtctcaggtttgtctgattatctagacggggtcattgctcggagatataatcaggtaacagacttagggaaggtgcttgatccgtttgcagatatattgacacaactttttctgattttgtctatggcatcggtatcgaccgtggctttagctgttgtttcgtctattcttgataaaagaagcgttatgtttgtagctggattaatcgggctatctaaaaatatcaaattaagtggagcgaagtggtatggcaaagtagcgactgctgtcatctatgttggcatgatccttttgctgcttttcccagaattaccaacgctgtgggtgagagtcatttttgccgtcatcacttacggtcttttacaatcttttgtcttgtatgctgtcgagtaccgaaagatgtttcaaagaaaataa

SEQ ID NO: 3083 - DNA (genomic), 819 bp, Enterococcus faecium; double-stranded, circular
  misc_feature (B) LOCATION 1...819
  hypothetical: NO
  anti-sense: NO
gaagataaaatgaaactagcagcgattgatttagacggtaccttgcttgatcgaaatggaaagataccagaagaaaatatccaagcacttcggaaatttgatgaaaatggcggaatcgtaaccgtcgctaccggaaggaacagcatttctgctaaagatattttttccgaattaggaatcggtggctatttgatttcttccaatggttcactgattgctgaaatgaaggatggaaaaatggcgaaagttctcagacgttcaaaaatagatagcgatacactgagaaaagccttcttctatgctcaagaagcgaaaatatccatcattgctagccgagaaacccaagatgatcagctgacattcgatgaatcaaatctagtcaaagatgacccttattatgaacatttcaatttacagaaccattcttttgatcaaattttaaatatgttggaagatccttctcttagctatcttaaattagcattaacagataagagtgaagaaaaactacagaagctacaaagagatctgcaagcagatggtatccaatcagtattctctgatccgcatttcttagaaatcacgcctacaggtatcactaaagctcattcacttgtttttctggcggattaccttggaatcgaatcgagtgacatcatggcttttggcgatcaagaaaacgacattgctatgttgaattacagcgggttgagtattgcgatggggaatgcacagcgacaagtaaaagaaattgcaaaccaagtaacactgacgaatgaagaagctggtgttgcttatattttaaaaaacttctattaa

SEQ ID NO: 3084 - DNA (genomic), 909 bp, Enterococcus faecium; double-stranded, circular
  misc_feature (B) LOCATION 1...909
  hypothetical: NO
  anti-sense: NO
agggataaaatgggaaaattggcgatcatcagcgacctacatgtggacatcaataaattcggcgaatcagagctgatgcagctttggcaagttttgcaaaagcacaagatcactcggcttcatctagccggagatacggctaataaagtagaccgttgcctagctgttgtcgaatttttcgtcaataaaggattatctacgacatttcatttcggcaatcacgagttggcagatgtgcccaatgaacagatgatggaccattttccagacccacattttttaaatgaacggtatattgctttaaatgagcagaccgttcttttagggatgaatggctggtacgactatcagttttccgaattgaaagattacgaggcaatcgtacgaatgaagcgtttgtattggtatgatcggttcatccagcgtgggaaaacagatctcgaggtcaatgcagaaatgcttgcagctgcaaaaaatttgctagaccagctggaagcaaaaaaacttgaggtgattttatccactcatttcgttcctaaacgggcatttatcatgtatcaatctgctccttatgagcgttggaacaaattaaatgcatttttaggatcagaatcattcggagaattacttgaccgttattcaaatatcaaacaagtagtttttggccatacgcatcgtcgctttgaagataaatccatcggtcacacgatttacagctgcagaccttttggttattattatgaatggcagctgacccgagattttgtcttgaaagaacagttgctagacagctatgatcctatgaaattacgtgtcctcttgcgtgcccatcacccagcttttcaggcctatcaaacacaacatttgcaagaggaatttgaacaagcgatgacaatcgttccgtattga

SEQ ID NO: 3085 - DNA (genomic), 339 bp, Enterococcus faecium; double-stranded, circular
  misc_feature (B) LOCATION 1...339
  hypothetical: NO
  anti-sense: NO
attttaaaaatggaggtctttgatatgtcacaagtaattacagataagacatttaatgaagaaacagataaaggacttgtattgattgatttttgggcaacttggtgtggtccatgtcgtatgcaagcaccgattttggatcagttggaacaagaatatgatgaagaagaattcagaattgctaaaatggatgtggatgaaaatccagaaactcctcaacaattcggtatcatgagcattccaacattaatgttgaaaaaagatggtcaagtagtagaaaaagctgttggtgttcattcaaaagaacaactacgtcaaatgatcgatcaatatttataa

SEQ ID NO: 3086 - DNA (genomic), 1728 bp, Enterococcus faecium; double-stranded, circular
  misc_feature (B) LOCATION 1...1728
  hypothetical: NO
  anti-sense: NO
atgctaaaaatcgtaaaacggatctccttgacttcagcaattgcagctgcagttttcatggtgatccaagtactggcagatttatatttgccgacacttacctccaatattattgataaaggggtagcgcaaggagatgtcgattatatttggcatacaggttttgtgatgatcggcttttctttgatcagtatcttagctgctatcgcaaatacattttttgctactcgtgaatcacagaaactgggtaagcaattgcgtacggatgtctataaaaaatcagagagtctgacaaaagatgcgtttgataaatatggaacggcctctttgatcacaagaacgaccaatgatgtgactcaaatccaaatggttacacaaatgtttttacgtatgatgatcaatgcaccaatcacgttgattggcgcgagcatacttgcttatcaaaaagatcatcagttgacaaaaatcttcttagttgtcatcccagtaatgattattttgatcggcggaatcatgtactttgctgttccattattcaaaagtatgcaaaagaaaactgaccgtttaaacctggtatttcgagaaggattgacaggggtcagagtgattcgagcattcgataagacacgctttgaagaaaatcgttttgatttagcgaataaagattatacaaatacggcaatcaaagttaatacgatcgtcgcattgatgatgccaatgatgacattgatcatgagcggtacaaacgtagcaatcacttggtttggtggacactacatagcagatatgactttggaagtcggtaatctgattgcatttatgacttatgcgatgcagatcttgatcagctttatgatgctttccgctatttttatcatggtgcctcgtgcacaagcttcagctgaccgtattaatgaagtgttggatgaaaaaatcggtatccatgaccctgaaaatcctaaaacagtttcttttgctggaaaaaacgcaacattggccttcaatcatgtcaattatcgatatcatggagcagaaaaacttgcattggaagatattgatttccaagccaagtcgggcgagatcgtcgcaatcataggggggactggttcaggtaaaacgaccttagtcaatttgatccctcgattatatgacatcgaatctggttcgatccaaataaatggaacggacattagtgacatgactcaatataatttgcgagaattaatgggctttgttcctcaaaaagcagttctgttctctggaacgatccgagacaatatgcagtatggtaagccggatgcaacagatgaaatgatttggaaagcattagaaatcgcacaagctaaagattttgtttcagagatggaagatggcttagatagccatgtggaacaaggaggaggaaacttctctggtggacaaagacagcgtctggcaattgcacgggcattagtcaaaacagcagatatctatgtgtttgatgattccttctcagcgttggatttcaaaacggatgccaatcttcgccaagcattgaaaacgaatatgaaagaaagtatcaccgttttagttgctcaacgagtaagtacagtaatggatgcagatatgatccttgtgctagatgaaggaaaactggttggcaaaggaacacatgaagaactattagcaacaaacgaaacttatcaagaaatcgttcattcacaactaagagaggaggacttagcatga

SEQ ID NO: 3087 - DNA (genomic), 1215 bp, Enterococcus faecium; double-stranded, circular
  misc_feature (B) LOCATION 1...1215
  hypothetical: NO
  anti-sense: NO
gatataaaaatgagtaaaaagaaaattttagttgtttcccaatatttttatcctgaacaattcagaataaatgatatttgtaaaacttgggttgaaaaaggatacgatgtaacagttttgactggcatccctaattatccacatggagatttttatcaaggttatgggtataacaaaaaaagaaacgaaaactatgaaggaataacgattaaaagaatcccaattatccctagaaaaaagaacagtcttatgatggggctaaactatctttcgtttgttgtctctggtgaactttggaaaatgttaaataaacagagattcgatttagtgtttatttacgaggtatcccctatgacacaagcattgccagcagtaaaaatagcaaagaagtttggtataccatgttatatttatgtaatggacttatggcctgaaaattttgaaataataacaggtataaccaatcctcttatcattaaaccgttggataaaatggtagattatatttacaaaaattgtaaaaaaatatttactgcttcacgtagctttaagagaaatatagaaaacagaggaattgattcagagaagatccatttctggcctcaatatgctgaagagttttatcatatcacggatacaaaaagtgataaattaatatatgataaaaaaatcaatattacttttgctggaaacatcggaaccgctcaaggactagaaatattaccaatggttggtaacaaaataaaggaaaaacagctaaacgttagattcaacattgtcggggatggaagatataagcaagaactgatggatgaagtggagcgtgctaatttacaagaatggtttcattttgttgatcctgttcctgcaactgaaatccctgagatattagcaggaagtgatttctcttttgtaagtttacaaaaaaacgacatattttcaatgacaatccctgcaaaactacagtcaagcatggcttgtggtaaacctattttattatccgcaaatggtgaagtagcagatattgttaaagaagctaaatgtggctttgtaggaaaagcaggagaacctgatgatttatttgataatttattacagattgttcatttatcttctcaagaaatagataaattaggagaaaattctagaagatactttgaaaaagaatatgaaaaagaaaaattgctgtctattatggatagctatttaatgtag

SEQ ID NO: 3088 - DNA (genomic), 315 bp, Enterococcus faecium; double-stranded, circular
  misc_feature (B) LOCATION 1...315
  hypothetical: NO
  anti-sense: NO
aactcaaaaatgagtgaagcaattatcgcaaaaaaagcagcaatcgttgatgaagtaagcgaaaaatttacagcagctgcatcagtagtagtcgttgactaccgcggattaacagttgatgaagtaacacgtttacgtaaacaacttcgtgatgctaacgtagaaatgaaagttatcaaaaattctattctttcacgtgcagctaaaaaagctggccttgaaggcatggacgaagtattcactggacctacagctgttgcattcagtaacgaagatgtagtcgctccagcgaaaatcatggacgaattttgctaa

SEQ ID NO: 3089 - DNA (genomic), 282 bp, Enterococcus faecium; double-stranded, circular
  misc_feature (B) LOCATION 1...282
  hypothetical: NO
  anti-sense: NO
nnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaatcatcaatcgaagagaaaatgttgactttgtatccgcatcagttttacacagatggatttttcatttgttgtttgcgcaaaaagtaa

SEQ ID NO: 3090 - DNA (genomic), 369 bp, Enterococcus faecium; double-stranded, circular
  misc_feature (B) LOCATION 1...369
  hypothetical: NO
  anti-sense: NO
aatnannnnnntnnnnnnnnnnttnnnaatnnnanannnnnnnannnnnnnnannnnnnnnnnnnnnnnnnnntnntnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaatcatcaatcgaagagaaaatgttgactttgtatccgcatcagttttacacagatggatttttcatttgttgtttgcgcaaaaagtaatgaggtga

SEQ ID NO: 3091 - DNA (genomic), 267 bp, Enterococcus faecium; double-stranded, circular
  misc_feature (B) LOCATION 1...267
  hypothetical: NO
  anti-sense: NO
nanannnnnnnannnnnnnnannnnnnnnnnnnnnnnnnnntnntnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaatcatcaatcgaagagaaaatgttga

SEQ ID NO: 3092 - DNA (genomic), 705 bp, Enterococcus faecium; double-stranded, circular
  misc_feature (B) LOCATION 1...705
  hypothetical: NO
  anti-sense: NO
atgaaaaaaatactagttgttgatgatgaaccttctattgtgacgctcttgacgttcaatttggaaaaagaaggctataaggtaaccagtgccgcagatggaggcgaaggattagaattagcattagaacaatcatttgatttcatcattttagatgtgatgcttccaacgatggatggcatggagatcactcagcggctgcgtcaagaaaaaaatgaaacaccgattttgatgctgacggctaaagatgatcaggtggatcgaatcattggtctggagataggtgctgatgactatttgaccaaaccatttagtccacgtgaagtattagcccgtatgaaagccatattcagacggatcgaacctcgtaagcaatcaaaagatgaagctgagcctgaatatctatcgattggacaaatcactgctgatttgaccaattatcaagtcaccgtagacgatcatctgattgaactcacaccgaaagaatttgaattactcgtttatttcatgaaacgaaaagaccgtgtgatcgatcgcgacacattgctagaccgcatttggaattttgacttcgcaggacaaagccgtatcgtagatgtacacgttagtcatttgcgagaaaaaatcgagcgagatccaaaacatccaaagtacttggtgactgttagaggatttggctataagtttcaggaaccaaaacgatga

SEQ ID NO: 3093 - DNA (genomic), 699 bp, Enterococcus faecium; double-stranded, circular
  misc_feature (B) LOCATION 1...699
  hypothetical: NO
  anti-sense: NO
gagaaaaaaatgaaaaaaaacaaaaaccaaataatagatatcatttttatgttatttctaagttttgcttacgtcatccctctattcatgtctatgggaatctatcatagtgtcaatcaggatacttactttcatttatctcgaatcataggactagataatgtatggagttctccagtaaacttcaataacttcgatcatcatggaacaatgatgaatattttttatccatggcttactctttatccagcttttttattttataaaatgatgggaaatcttgttttaagttataatatctactatttttttatcacttttttaacaatggtcgtttcttatttttctatgaaacaaataaaaaacaatcgttatatttcgctgttattttcgattatttatacattttccgcctatcgtgccattgacatattccatcgtgcttcattgggagaagctgtcgctttaacatttttgcctttgatactaatggggtgttacgaaatttatattagagattaccaaaaatggtactggttgtctattggcatgacgctagtagtgtatactcatttactttctgtcgctatggtttctgtatttattggaggaacgttgtttctttctttttatttttgggaccaaaaaatcgctagactcttaagtcttttaaaagctaccgtcctcacctttttttaa

SEQ ID NO: 3094 - DNA (genomic), 750 bp, Enterococcus faecium; double-stranded, circular
  misc_feature (B) LOCATION 1...750
  hypothetical: NO
  anti-sense: NO
ggtgaaaaaatgcagattgaatatcaatcagatgtaggaagacgacgtaacacaaatcaagactatgccagtgtatttaccagccgttcaggtctcaagcttgctgtattagcagacgggatgggtggtcatcgtgccggagacattgccagtcagatggcggtaacgaatctaggcgaagcttgggaaaaacaagaagctgttgacgatgaaaaaatcgcccaatggttcattcaatcgattcaagaagaaaatatgctgatttatcagcgtggacaagaacagccggaatataacggtatgggaacaacaatcgtagcggccgctctgtcagatgactggttcacgattgccaatgttggggatagcagagcttatttgattcgtgaagataaaatcatgcaattgacggaggatcattctttagtcaatgaactagtcaaatcaggagaaatcagcgaagaaatggcagtgaaccatccaaggaaaaatattttaacacgttctgtcggcatgcctggaacagtcgaagtagatgtttctactcatctttggcaactaaaagatcgactgctgttatgttcagatggcttgacgaacatgctgtctgaagaagaaataggaacgatcatcaatcaagaaggcccattgtctcataaagtaactgagctgattgatcgtgccaatgaagcaggcggagcggataatatcaccgttcttcttatcgaatataaggaggacagtgtatga

SEQ ID NO: 3095 - DNA (genomic), 1548 bp, Enterococcus faecium; double-stranded, circular
  misc_feature (B) LOCATION 1...1548
  hypothetical: NO
  anti-sense: NO
ggtgaaaaaatgaacgtttcaatcggattagatatcggaaccacacaaaccaaagcagttgctttcacagatgaagcccaagaagcagcatccgcttattttcgctaccctttgatccaagaaacacaagggatggcagaacaagatcaggaattgatctttcaaggtgtctgcaccgttataaaagaagtaattaaacagttgccttcagacacaatcattcaatttgtctccttctcctctgcgatgcatggcctgatattgttggatgaagagaaaacaccgttatctcgaatgatcacttgggcagataaccgagcagcggacgaagcagaaaaactgaaatataccgtgcttggcaaagaattttatcggcagactgggacgccgattcatccaatgacaccattgaacaaaatcaagtggctgcaaaacagccaacctgaattattcaaaaaaactgcttattttgtcggtatcaaagactatatcttttatagattgtttggcgaactgatcagcgactacggaacagcttcaggaactggatattttgatatccatgaattccaatgggcagaagaagtgcttgactacttgaacattcgaatagagcaattgccgcaagtctttccttccacctatcaagtaacaggtctaccatcaaaaacagcagcagaactaggtttgccaaatgatatatcatttgttttgggaggggcagacgggccgctttctaatctagggttaggtgcttttggtgatacgatcgccgctttgaccgtaggaacgagcggagcacttcgttttattactactcagcctcagttccatccagaaatggagacgttttgttatgttctggatcagaaacattgggtagtgggaggagcgactagcaatggtgctggcatctttgattgggcagggcatacatttttacaggaagtcgttcaatctgctaaagaaaaaggagaaaatccatatgatgcactgctttcggctatcgcttttgtgccagcgggtgccaatggtctgatttttcatccctatttacttggtgagcgagcaccgctttgggacgcagatgcgtggggcagttttatcggtttacagcggcaacatacagaaaaagaaatgatgaaggcgattctagaagggatctgtctcaacctttatcggattttaaaaggagtttgccaggaaaatcagctcacagagatccgtgctacaggcgggtttgctcaatctccgatttttcgtcagatgatggctgatgtactgggttacccgcttgttttccctactgtcacagaagcatccgcattaggagctgtgattttaggctggagaagcatcggaaagatccaaagtatcagtgaagcacaggaattgatagaattgaaagagcaagttggagtacaagaaactgatcataaaaaatatcagaaaatctatccattatttgtttcgacacaaaagcatttagcacagacttatcagcaatttgctcaactgcgagaagaattagctgattctgaaaaatga

SEQ ID NO: 3096 - DNA (genomic), 846 bp, Enterococcus faecium; double-stranded, circular
  misc_feature (B) LOCATION 1...846
  hypothetical: NO
  anti-sense: NO
aaagaaaaaatgccagaattaccagaagtagaaaccgttcgtaaaggattggaacggttagtagtaggaaaaacgattcaaaaagttcaggtcttgtggcccaagatcatcgagcaaccagagacacccatctttgaggcttctcttgttggcgaaaccatccaatccattggacgtagagggaagtttttaatttttcatctcgatcattgtgaactgatctcacacttgcgaatggaaggaaaatatcaatttacgaaagaaaatacaccaatcgataaacatacgcatgtacttttcttttttgaggatggaagccaacttcgctacaacgatgtacgaaaatttggtcgtatgacaatcgtcgaaaaaggagcaagtgcaacttaccgaggaatcatgaaattgggacctgagcctttgccagatagcttcttattagcagatttcgcaaatggactgaaaaagtcccacaaagcaatcaagccattgctgctagaccaacgtctagtgactggtctaggtaatatttatgtagatgaagcattatgggaagcgaagatccatccagaacaaccggcgaacacactgcgccccaaagaggtagaacaattacgtctatcgatcattgatgttttggatcgtgcaatagaagccggaggtaccacgattcgcagttatttgaatgcattaggagaatcaggcggatttcaagtagcactgcatgtctatcagcaaactggcaaaccatgtatacgttgtggaacgccgatcgtgaaaacaaaagtggcacaaagggggacgcactattgtccgaattgtcaaaggctaaaaatcgcaaagtag

SEQ ID NO: 3097 - DNA (genomic), 1344 bp, Enterococcus faecium; double-stranded, circular
  misc_feature (B) LOCATION 1...1344
  hypothetical: NO
  anti-sense: NO
gtggaaaaaatagtaattattggttcaaaccattcagggctagccgcagctcgatttctaaacttaagcgattcaaattatgaagttattctaatcgataaaaaatcagaaattagttacttggaatgtgggacatcgttatttataaaaggagaagtaagtaatttagaagatcttttttatcaaaatagaatgacactaaattctgagataaaaaagttatttctagagacagaagttgacaaaattgatattcaaaataaaaagattagttgtgtaaaaaaagatggtacaagattctctcaagaatatgacaaagttatattagctacaggttcaaagcaaattatgctagatataccggggaataatttagctaatattttttcgataaagaattttccaaatgcaaaagagatttttaaagctttggatgatagtactattaaaaaagtaggaattattggagcaggatatattggagttgaaattgctgaagccataagaaaaagagggaaagaagtatatcttttcgatgttgcagatagagtgttgtcgacttattacgaccgtagtttttcagataaagttgaagaaatactatcaaaaaatggaatacatctttgtctatcagaaagtcctaaaaaatatttaggaagaaaaaagattgaaaaaatagtcactacaagtggtacccaatactctatggatatggtcgtacaagctataggatttctatctaatagtccaattggggaaaaggaactcttgagagatgttagtggagcatatctaactaatgaataccagcaaacaaatataaaagatatatatgctattggggattgtgctacaactttttttacgtccattaatagaagtagtgttgatttttctatttctaatgctctaagaacagcttatattgcaactcaacatattaacaatcaagattttacaccttctggttcccaatttacaaatggcttttctatatttaattacaatttttacgcagcaggtttgaatttaaaaacagcacgattattaagtgagtctatagattatatagaaatagaagatttcattagacctgcttttttgagaaaaaatagtcgtgtaaaattaagaattagctttgaaaaaaatacaaagagaatagtaggtgtacaactttgtagtcaagaagatttatctggactattatcaatgttttctcttgctatagaagaacaaattacattagacaaattgaaaatgttagattatttatttcatcctagttttagccaaccctataattttattttaaaggcagtaacaggattaaacattgaaacataa

SEQ ID NO: 3098 - DNA (genomic), 681 bp, Enterococcus faecium; double-stranded, circular
  misc_feature (B) LOCATION 1...681
  hypothetical: NO
  anti-sense: NO
gtgagaaaaatgacggataaacaaaagatagatgaatttttttggaataaaacgacgccagaagtggcacgggatttattggggatgtatttggagcatgacacaccagaaggaagattagctggatatattgtagacgcggaagcatacctaggtccagaagacgaggccgcccatagctatggtttaagaagaacaccgcgtgtgcgggcaatgtatgaaaaaccaggtacgatctacctttacacgatgcatactcatcggattttgaacatcattactcagccagaagggattcctcaaggagtaatgatacgtgcaatcgaacccgccgcaatgattgatcaaatgagtaaaaatcgtggcggaaaaactggtccagatatcagcaacggtccgggaaaattagtggaagcattagcaattcctcaagaactttatggtcagtctatagcagatagttcgttacgcttagtttttgagaaaaaaaagacaccaaaaaagatcaatgctttgcctagaatcggtatcccaaacaaaggtgtatggacagaaaagccgttgcgttttgttgtgtcgggaaatccttatatctctttacaaagaaaaaaccaaatcgagaaagattggggttggaggaaagaaaatgaaaaagaaggatctattaacatatttagatga

SEQ ID NO: 3099 - DNA (genomic), 684 bp, Enterococcus faecium; double-stranded, circular
  misc_feature (B) LOCATION 1...684
  hypothetical: NO
  anti-sense: NO
aatatgaaaattacgtatcatggacattcctgtttaacaattgaaatggaaaatggccaacgcgtgatgattgacccgtttattacaggaaatccattgacagacttaactgcagaagaagtaaagacagattggttgctgattactcatggtcatagtgaccacataggagatatgattcctattgcaaaagaaaatcaagccacaattatcagtattgttgagattgctgattatgcgaacagcagaggagtagattcattcggtatgaatatcggtggaaaacatgcgtttccattcggcgtggtaaaattcgtacatgcacagcatagttcaagctatgaagtagacggtatcgttcagtatatgggcgagcctagcggaattattattcaagcagaaggaaaaacgatttatcatgcaggggatactgcttatttcagtgatctaggattgcttgcagaagaattcgatattgatgtcgctttcttgccgattggcgataactatacgatggggccagaagatgcagcaaaggctgcgcaaacaattcgtgccaagaaagtagttccaatccattacaatactttccctgtcattgaacaagatcccgaatcttttgtagagttactggaagatagtgaaggaaaaataatgagcgtctcggaaacgctggaagtgtag

SEQ ID NO: 3100 - DNA (genomic), 204 bp, Enterococcus faecium; double-stranded, circular
  misc_feature (B) LOCATION 1...204
  hypothetical: NO
  anti-sense: NO
agtatgaaaatcaactacaccgtcgacctagtaagtttttctttagtaatcaatttttccctattttctcttcgactgtttattgatggactaagacatacgcatgcatctattttactttatcaaggagtaaatatacttagcgtatcgaaacgtttaggacatagcagtttagaaactacaatgtctacttatacaaaataa

SEQ ID NO: 3101 - DNA (genomic), 1368 bp, Enterococcus faecium; double-stranded, circular
  misc_feature (B) LOCATION 1...1368
  hypothetical: NO
  anti-sense: NO
aacatgaaaatcgtgatcattggtgcttcccatgcaggcatcacagctgccctaaatctaagaaaacttcaaccgaaagcagaagttttactgatcgatgaagatcataaagatggactaggctatgtttcaaatggaatcaacctttatttaaaaggaaagatacgtagtttagctgaagttgcccataacatgcggactcttcaagaaagtggggcaaaactgatcaccgaatggagagtaactgaacttgatccagacaaacatcagctcatcctcgcatccaaagaaggaaaaaacgagaccataacctatgataaattaatcgtagcaacaggttcctctcctgtcaccttgtataaacaaattgaagctgaaaatgtctacacctataaaaatctagtgcaatctaagcaagtacttgccgctttaaaagaagcaaaagaagtagtgatcttcggtgctggttatattggattggaattagcagatgctttgagaaataaaggatacattattcatctagttgattatatgccgaatgttttatcaagatatttcgataaggatatgatcaacagttttcaaaatcagctgcaaactaagcaaatcaatttttatccaaatgaattcttgatcgattggaaaaaatcagaagagaaagtagtatccgtacaacttctatctcaagcaataaaggcagatatggtcattttttctgcccaaactcgtcctaatacgacattgttaaaagaaaaagtggctttgtatgaggatgagactgtgatagtcaatgaatatctgcagacaagtgatccggacatctatgcgattggagatatcgtcccagtcagttttgacaaaaataaacggcatctctttttacctttagttactcgagctgtacatatggcaagagcagtagcgctaactttgagtggtcagccaaccgcttacgacctcagacaaaagataacagcagcagtcattatagactactttttaggaactgtagggctgacagaagatgaagcgccattcttggaacaaaataccggttcgtgttcaggagaatttgatctatttccacaatacgatgaagaaaacaaaacagtaaatgcaaagctgatctaccatccggatacattagaaataattggcggacagctgataagccaagaattcttattatcagatttgaacctgcttgcggatatcgtgaaacacaaaactacgattccacagctagcagttgaggattttggatttctgtctgaacacacctctcgttttcactacctcaatgagttagcttttaaagtactagctaagagagcaaatagcaatagagtagataaaagactgtga

SEQ ID NO: 3102 - DNA (genomic), 1137 bp, Enterococcus faecium; double-stranded, circular
  misc_feature (B) LOCATION 1...1137
  hypothetical: NO
  anti-sense: NO
aaaatgaaaataaaaatcatgaccattttcggcactcgtcccgaagcaataaaaatggctccgctgataaaagcaattgaaaatgatgaacgctttgaatcaatcgtaacagtcacagcacaacatcggcaaatgttagatcaagtaatggatatttttgatcttaaagcagattatgatttaaatattatgaaagatgggcaaacattgacggatgttacgagccgagtaatcaaagagttagacagcgtattggtagaagctaaacctgatattattttggtgcatggtgatacgacaacaacatttgcagcatctatcgcaggattttatcatcaaatcaagattggtcatgtggaagctgggttgagaacgtggaataaatattctccatttcctgaagagatgaatagacaattgactgatacactagcagacatttattttgctcctacagtgatgagcaaatctaatcttctcaaggaaggaagatcagagaaatctatatttattacaggaaatacagcgatagacgccatgaaatacactatcaaacaaaattattctaatgatttgctagataatctagcaggaaaaagaattattttagttacaatgcaccgtcgggaaaacttaggccaaccaatgacgaatgtttttaaagcaatcaatagattaattgagaaatttgaagatgtgcatatcgtatttccaatgcataaaaatcctaaggtaagaaaaaatgcagaagaaacattcaatgattctgaacaagtacacttaattgaacctttagacgttattgattttcaaaacttctctaataacagctatatgattttatctgattctgggggtgtacaagaagaagcaccttctcttggtgtaccagtattggtcttgagggataccactgaacgaccggaaggaattgaggtgggtactttaaaactggtaggaacagaagaagacaaagtttttgaagaagccactctgctgttaagcgataaagaagaatataagaaaatgtcgcaagcgtccaatccgtatggcgatggtaatgcaagtgaacgtattttagatgcaattgcttataattttgggatacaacaagaaaagccaatagacttccaataa

SEQ ID NO: 3103 - DNA (genomic), 1092 bp, Enterococcus faecium; double-stranded, circular
  misc_feature (B) LOCATION 1...1092
  hypothetical: NO
  anti-sense: NO
aaaatgaaaattttggttacaggcggaggaacagggggacatatttatccagctcttgcctttgtcaattatgtaaagactcaagaaccgaatgctgaattcatgtatgtgggagcaaaacgaggtctagaaaacaaaatcgtccctgatacaggaatgcctttccataccttggagattcaaggatttaaacgaaaaatttccatgcataacatcaagacggtccgattgtttcttaagagtatccgtcaagcaaaaaaaatcctcagtgattttcaaccagatatcgttatcggtactggaggatatgtttccggagcggtagtgtacgctgcagccaaaatgggtattccaacagttatccatgaacaaaacagtgtaccaggtgttaccaataaatttttaagccgatatgtggatcggatcgctctttcatttaaagatgcggcttccttttttcctgaaaacaaagcagttcttgtaggtaatcctcgagcacaagaagtagcagatactaaaaaatcagatattttgaaaacatttgatttggatccagaaaagaaaacagtcttgatttttggcggtagtcaaggagcacttaaaatcaatcaagcagtatcagtttttttaagtgaatatattccttcttcttaccaagttttgtatgcttcaggagatagatattatgaagagatcctaaataaaataaatcctgaaatacaaaatattagtgtccagccttatatcaaaaatatggcagaggtcatggcttccagtgatctgctggtggggcgtgctggtgcaacttcgatcgcagaattcacagctctggggttaccggcagtgttggttcccagcccatatgttacgaatgatcatcagactaaaaatgcaatgagtcttgttcacgcaggagcagcaaaaatgattgcagataatgaactaacaggtgaatcactaagtcagacagtcaacgaaatcatgggtgatgaagaattgcaaaagcaaatgtgccgagcttctaaagaacaaggaatccctgatgcttcaaaacgtctttatgacttagtaaaacaaataatcaaaaaataa

SEQ ID NO: 3104 - DNA (genomic), 720 bp, Enterococcus faecium; double-stranded, circular
  misc_feature (B) LOCATION 1...720
  hypothetical: NO
  anti-sense: NO
aaaatgaaaatcggactgattggcagtggacagatgggaaatagagtcgaagaagttgcacaagaaagaggagatacggtccttcttttacggacggcacctaaagaagcaactacgcttgcttttacggaactgccagaactgcttattgatttttctcatccagataatttagagaaaatcctttcgtatagcttatcatatcaacttccgttagtcattggcacgacaggttatacacaatcacagttccaagaaataaaagaacatgccaaacatgtacctgtgatgtatagtgctaatttttcgttcggcatcatggtgatgaatcaactaatcaagcaagcagctgcaatgttgcaaggctggcagatcgaactgattgaaaaacatcatagtcgtaaaaaagatgcaccatctggtactgcaaatatgctgcttcaaacaatccaagaagtgcaaaagctgcagcccgtatacaactggcaagggaaaaaaagagaagaaaaccaaattggtgtacacagtattcgtgcaggttctttacctggtgaacatgatgtattgtttgctgctactgatgaaatatttacgatcaaacatgaatctttttctaatcgaatctttgctgcaggcgcagtagaagcagcggactggttgaaagatcagtcaccaggttattacaaattagaagatttattaatggacaaaggggtgtaa

SEQ ID NO: 3105 - DNA (genomic), 681 bp, Enterococcus faecium; double-stranded, circular
  misc_feature (B) LOCATION 1...681
  hypothetical: NO
  anti-sense: NO
tcgatgaaaatcaaagcagcactattcgatttagatggcgttcttgtagacacagctcgttatcattacgaagcgtggctggttttagctaaccagctgtccattccattcactgagaaagaaaacgagcaactgaaaggaatatccagaaccgagtcactagagcgattgctgtcatttggaaaaatggaacagaaattctcagaaaaagagaaatcagcctttgctgagcaaaaaaacaatctatatcttcaagcgattcaaaaaatggatgaaacatccgttttgcctggtgcaatagctgttcttgagtacttgaaaaaaacaaacatcaagatcggattgggatcagcaagcaaaaatgcacgcctcattttagaaaaaacgaatttgacaagttattttgatgtccttattgacggcacgcaagtatcaaaagcaaaacctgatccagaagtttttctcaaaggagcacagcaattgaatgtaccgccaaatgcatgcttggtcattgaagattcagaagctggttgtcaagcagctttggctggtaacatgcatgtattgggaataggtgaaaacataaatcttccttctgctgaatatgtgattcctgatttaaccgtttttgatcaagtacgttcgttttggcatttatcagaagccgtatcacgtatataa

SEQ ID NO: 3106 - DNA (genomic), 246 bp, Enterococcus faecium; double-stranded, circular
  misc_feature (B) LOCATION 1...246
  hypothetical: NO
  anti-sense: NO
gaggtgaaaatgatgtcaaaaaaaaataaagatgttgaagtgcgtatagaagaagtgaaaaaagatatcaaaggtaagaattatgaagtcactcagttatttatagggaaaaaaatgattggtgagatcttagcctatgggccaaaagaatatgaaattttctttggtgaagaagattttggaaaagaaaaaagttttgaaaatgcgatagaaacagtgattcgacactggaatctgcacgaataa

SEQ ID NO: 3107 - DNA (genomic), 675 bp, Enterococcus faecium; double-stranded, circular
  misc_feature (B) LOCATION 1...675
  hypothetical: NO
  anti-sense: NO
ataaagaaaatgaaaaaaagaggtgacaagatgatcgagcgctatcgtacaataaaagaaaatggacaaagtgagattgagatcaaaaaatcacgctttatctgttctcttagacgaatagaatcagaggaccaagcaaaaagtttcattcaagaaataaaaaaagaacattggaaagcgaaccataactgcagcgccttcatcattggagaaaaaaatgaaatccagcgaagcagcgatgatggagaaccaagtggaacggctggcgtaccgatgttggaagtcctcaaaaaaaatcaactgatcaatgtagctgcagtagtcactcgatattttggaggaacgaaactcggcacaggcggattaatacgagcatacactcatgctgtctctcaagcattgtctgacattggaatcgtagaaggtaccttgcaacaggagatctctgtgatgatcacgtatccgcaactaggaaaattacagaattatcttgaactccaacatttttttataaaagaaatccaatatactgatcaagttagcgtcatctgtgctgtacatgaaaaaagtgctgaccactttaaagaatccatcattgagctgctgaacggacaagtccaatttgaagagggtcctgtttcttatcacgagcaactggtaactgatcatatataa

SEQ ID NO: 3108 - DNA (genomic), 213 bp, Enterococcus faecium; double-stranded, circular
  misc_feature (B) LOCATION 1...213
  hypothetical: NO
  anti-sense: NO
caaaagaaaattaatttcaacaaattattgggaagtatttgctgcaagaaaaaaatggatggaagaaaagaagattgccgatcagcagatccagtttgtccagctgaaaaaagaaaaactatattatgggttatacagccgttaacagcaagcgaggaagaccatgacattaaaagaagaaatcatacaagaaagcaaacgattaggaattga

SEQ ID NO: 3109 - DNA (genomic), 645 bp, Enterococcus faecium; double-stranded, circular
  misc_feature (B) LOCATION 1...645
  hypothetical: NO
  anti-sense: NO
gagaagaaaatgatttttttgcaaaaatatggtttttattttttattattaggtgtgattagtgatttatcgacaccgtatatccttggccttttttatcccaaactgaatcaaatgactaccgtaattagtgtgtttggtgacgtagatagtccagtcagacgtgctttcttggtctggtcagttgtatctggacttttttttgttctttcgttgcctgcgttgtatcacctatttattggaacatcaaaaacacttgcaatacttgctgttgcaacagttggtttatatgggataggtgattgtatttttactgggttattcagtatcaatacgaatgaaagctcttggaatctatcgacttggatccataatataggttctgggctaggctatgcaggctttctacttttcccattgttacttgttctgctttatcgtcaaagtggtcaaggtacgcttagccatttttatcttgttttaacagttattagtttactaattgcaggtctttacggattagcacggattccgtcgattagtcagtttgccttctttaagcaattgggcttctttcaacgcttaagttttttctttaactatttgccgatgatttgtttaagtttttttcaactacgaaagtag

SEQ ID NO: 3110 - DNA (genomic), 204 bp, Enterococcus faecium; double-stranded, circular
  misc_feature (B) LOCATION 1...204
  hypothetical: NO
  anti-sense: NO
agtgagaaaattccaccttcaccatggttatcttcattcaatgcgtccacgacagaggngttcgttgtagggcgggtcgtggccggaagggggggggggggggggggaagggaggggagggggcggggcggggggggagagggggggggagcgttngggagaggggagaggaaggagggggagagggaggggggaggggggggg

SEQ ID NO: 3111 - DNA (genomic), 936 bp, Enterococcus faecium; double-stranded, circular
  misc_feature (B) LOCATION 1...936
  hypothetical: NO
  anti-sense: NO
gaggagaaaattatgatcgaactcataaccacagtagaaactattgaacaagcagaacagttgcttgctgcaggtgcagatacactatatttcggtgaagagcaatttggattgcgtctgcctgcttcatttacacgagaagaacagcgacaattggtagaattagcacacaagtatggtaaaaaagcgaatattgctgtaaatgggatcattcatcctgaaaaaatgaaaaatgtacctgaatatttggcttttttaaaagaaataaacgtagatgtgatcacagttggtgatacaggtattatttatacgatgaaaaaaaatcctgaattgcgtataccgtatatttatgatgctgaaacattagtaacgagcgcacgtcaaatcaatttctgggcgaaaaaaggcgcagttggagcagtacttgctcgtgaagttccttttgaagagatgaaggcgatggaagaaaaactcgatattcctgtagaaacccttgtgtatggtgctacatgcatccatcaatccaaacgtccactgctacagaattactataactatacgaaacaagacgaacaaaaagatcgtgaaagaggtctttttatctcggaacctaaaaaagaagagacacattattctatttatgaagatagtcatggcacacatatttttgccagcaatgatctgaatctctcgaatgaattgaatgaactttatcagcatcattactgtacatggaaattggacggattatttactccaggcgaaaaattcgtaaacatcactcgactattcgccgaagcaaaaaaacaaattttagaaggtagctgggatcaagaaaaagcggaaaaaatgactagcgaaatcagtaaattgcatcctgaaaaccgtgaattagatacaggattcttttatattgatccttctgctatcaaataa

SEQ ID NO: 3112 - DNA (genomic), 1218 bp, Enterococcus faecium; double-stranded, circular
  misc_feature (B) LOCATION 1...1218
  hypothetical: NO
  anti-sense: NO
tggaggaaaataatggaaaaccaaaatgaaagtttaatcaagcagtatgttaagcgtcgtgcaaagcgacgcttatttttgtggttgtttggtacttctgcaggtttgattactattttgatcactgtgttcgtgaccctttttctaatactggcggcgggttcgattgataattctgattcagattcaagcagtggtggcgaagcttttacaggagaatattcggaaggattacccatttataaagaaatcaaaggaagaggccctttttctgatgagattgcgcaatatgctgtaggtgcagcagtgaaatataaattattaccaagtgtgatcctttcgcaatacggttacgaatcagcgtttggtacgtcggcgtccgcaagaaatgatctcaactattttgggattacgtggttcgatggctgtttgtttcctaaaggaactgcacgaggaattggtggtattgaaggtggctggtacatgaattttcccaactcaaaagctgcattctcctattacggctttatggtagccacacaatcaaattttaatgcatgtgtaggaaataaaagccctggcgcaagcttattgatcttaggacgaggtggttatgccgctgcaggaattactgaagatagtccgtattatacaggttgtatgtcaattatcacttctaataaattaaccgaatatgatgaattcgcgatgaaacattggggtgaaggtggtaatgataatggcacaattactggtgaatggacgaatccattccctggcagcagtttagataaaagtacctttagcggtggtcaattatttggaacaaatccaggcagtgaattccgtccgaatggcttccatgatggattagattttggttcagttgatcatccaggaagtgaaattcacgcggtgcatggaggaaaagtcgtgtacgttggcaatcctggtatttcaggtttaggtgcttgtgtgatcgtgattaattacgacgggttgaatatggtatatcaagaatttgcgaatagtacaggaaattctcgtgtgaaggttggagatcaggtgaaagttggtcaagtaatcgggatccgagatacagcacacttgcatttaggtttcactcgaatggattggcgtcaagcacaaggacacgcattcacagatgatggtacatggattgatccattaccatttttgaatagcagcaaaaaatag

SEQ ID NO: 3113 - DNA (genomic), 678 bp, Enterococcus faecium; double-stranded, circular
  misc_feature (B) LOCATION 1...678
  hypothetical: NO
  anti-sense: NO
aggaggaaaatggtgaaacaaaattttgcaattgtaggccttggacgatttggcggaagcatctgccgtacactgatcgaagctggacaagaagtactggctattgacagtaatgaagatcgagtcaatgaatatatgaatatagccacccatgctgttgtggcaaatgcacaggatgagatgacacttcgttcattaggtataagaaatttcgatcatgtaattgtcgctattggagaagatatccaagccagcatcttagttactctgatggtaaaggaaatgggcgtaccgaatattttagcaaaagcccaaaatgagtaccatgcccgtgtactagagaagatcggagcagatcgtgtcgtacaccctgagcgagacatggggatacggattgcacataacttagtatcaaagaatattctagactacttagagctgtcagataaatattctttagcagaaatccgagtctccaatcctaaatttttcaacaaaacattagctgaattaaatttcaggcaacgttttgacttaacagtagtcgccatacgaagagtagatcaaacggttatcgcttctcctgcagcagatgaatatgttcgtgaaaatgataatctactggttattggagagacaggcgatgtggatattctagacgataagatgaatcaatag

SEQ ID NO: 3114 - DNA (genomic), 549 bp, Enterococcus faecium; double-stranded, circular
  misc_feature (B) LOCATION 1...549
  hypothetical: NO
  anti-sense: NO
gggaggaaaatgaagatcatcgtgattggacaaagtgggtcgggaaaatcgaccctcgcaaggaagatcaaagaaatcaccggctttccgctactgcctctagaccttttatggcatacgacagattacagtattcaggcaaaacagtggtttttacaagaacagcaatcgtttatggtatctaatccgtcatggatcgttgaaggaaattatacttctacgttagaagagagaatcaaagaagcagataaaatcatttggcttaaagtgccgcgttatgtcgccatctaccgagtagtttggcgttctctaaaaagaaagataaacaaaaaatcacggccagatatgcctgaagcatttacagagaaactaaacagggaatacgtagaatttttatcttttatctggcattttgaagaaaacaatgaaccgaaaatacagcaactgatccaagaaaaccatgcacgaaacaaactgatcatccttaaaacaagaggggaaaaacaagaatttttaactaaattgaaaatagagagcaaaaataattga

SEQ ID NO: 3115 - DNA (genomic), 684 bp, Enterococcus faecium; double-stranded, circular
  misc_feature (B) LOCATION 1...684
  hypothetical: NO
  anti-sense: NO
ggtgggaaaatgattaaactattagtagtagaagacgataaagtattatccaataatataaaagaaatactcgctgcaatcggcgagataacacaagtttatgatggtagtgaaggactgttcgagttggaaagtggagtttatgatcttgcaatcttggatttgatgatgccggaaatgaatggatatgaagtgttagcaaaaatacggaaagaaaaaatacagactccagtattgattttgactgcaaaagatagtttggaagataagattgaaggatttgaacgaggtgcagatgattatctaacaaaacctttctatcgagaagaactgatcatgcgcgtgaaagcattattgaaacgctcgctaggtctctttgatgaaaatgttctgaagtataaggatatcagttgtgatttaaaaagcaatgaagtcttgtataaagaacaagttttgcccatacaaggaaaagagtttgaattgctcgtttattttttacaaaataagggaatcattttgacaaaagagcagatatttgaccggatctggggatttgattctgatacgacgattacagttattgaagtttatatgagcaacttacgaaaacatctgcgaagtactggattggataaagaaatcaaaaccttacgtaatgtcggttatatactgcaaagggtgtga

SEQ ID NO: 3116 - DNA (genomic), 795 bp, Enterococcus faecium; double-stranded, circular
  misc_feature (B) LOCATION 1...795
  hypothetical: NO
  anti-sense: NO
gaggggaaaattttggatgcaaatgtataccagcactttcgggcagatgaacgtacatttatcgattcggtaggcgattggattgaacaggttcaaggacaatatgcaccctatttgaccgaatttcttgacccaagacaatcctatattttagaaacactgattcgacaaagcagtgatttgcgtttcatgttttatggcggatatgaacaggcagaaagaaaaagatgtttgattttccccgattattacgaacctgtagaggaagattttgaaacagcattgtatgaaatccattatcctagcaaatttgccagcctaagtcatgggaaaatccttggaactttagtgggaacggggatcaaacgctcttactttggcgatatcatctcggacggtgatcgctggcaagtatttattgcaaatgaggtggatcattttgttgctgcacaagtaacaaagattggaaaggttgctgtacgcttggaaccaatcaaatacacagaaatgattatgccgaaagatagctggacacaagaaagaggaacagttagttccatgcgactagacagtgtgatctctgagatttataatatttccagacagcggtccaagcagctgatcgaagctggtaaagtaaaagtgaactggacagaaaatacaagacctgattttgtacttgaactattagatattatttcagtcagaggttatggcagagtccagatccaagaacttgaggggaagacgaaaaaagaaaagtacagggtactgttcggtgtattacgtaaataa

SEQ ID NO: 3117 - DNA (genomic), 192 bp, Enterococcus faecium; double-stranded, circular
  misc_feature (B) LOCATION 1...192
  hypothetical: NO
  anti-sense: NO
gaaattgaaatggaagaaattatggcattcggcgatcattacaatgatatcgagatgctgaaaggtgtaggaattggagtggccatggggaatgctcagatcgaagtaaaacatgctgcagactttgtgactcaatcaaatgaagaagatgggatatacgaaggactgaaacacttcggtctgatttattag

SEQ ID NO: 3118 - DNA (genomic), 285 bp, Enterococcus faecium; double-stranded, circular
  misc_feature (B) LOCATION 1...285
  hypothetical: NO
  anti-sense: NO
caggctgaaataattgataaggaggtggcaactttgaaagactataaattggatttccagtctgaattgcccatagagttcgtaaatgaattcaaaattgaggcgccagataaaactcgtacattatttactttcaaccacgatatgattcttcaagaattcgaagatgatactgtaatatgcgttgctcgtgatagtgagtttttaactatctattcgaaccgtaaattcaatcagacaataccggtacgaagcaagaaggttattatttattttgaggaataa

SEQ ID NO: 3119 - DNA (genomic), 600 bp, Enterococcus faecium; double-stranded, circular
  misc_feature (B) LOCATION 1...600
  hypothetical: NO
  anti-sense: NO
cataacgaaatagaattgaggagaatatatatgaaaacaaaagattatatttttattggtttagctacagttatttccctagtaatttactttttttcaataatggttagtagtattggtggggcgtttggtcacagcatatccccagggatttttggattattatctggaatcatatttgtttatattagctataactaccctagaaaaggaatttttactatttacacaattgttttattgttattttttacgttaatgggcggggcgtacttaccttggtttatcagttcgattagtatggcgatcttagctgatattattctatctgtatttggatatgatcgagcaattcctcaagttgtgtcttgggttctaatgcaactaggcagtgctgccggacagtggattcccatatggttctttacagatcgttttcgtcaagactggatagatagaggacaatctgctgcaacaatggatgcaatgatccactacgcggtgggtatatggggaattatttcagtgttagttgtagcaagtttatctatgattggtgtattgattggaagaaaagtcttaaaaaaatacaaaaaatag

SEQ ID NO: 3120 - DNA (genomic), 189 bp, Enterococcus faecium; double-stranded, circular
  misc_feature (B) LOCATION 1...189
  hypothetical: NO
  anti-sense: NO
gcattagaaatcaaaggcggtatcatccaaggtaaagtctcttcattggaagaaatcacagcattggcaaaattgccaaatcgcgaaggacttctatctatgttgctatctgtaccacaagcgccagtccgcaacgtggcttacgctgtcaaagcagtggcagacaaagaagatggagatgcagcttaa

SEQ ID NO: 3121 - DNA (genomic), 537 bp, Enterococcus faecium; double-stranded, circular
  misc_feature (B) LOCATION 1...537
  hypothetical: NO
  anti-sense: NO
acgccagaaatgtcttggttgaagaagcaggagagcattatgctgttgttaaatttaatggaactgagattggaaggcaaatctttgatatcaaggtcaacaaaccagtggaaaaaaattaaggagacgatacggatgcttgatatagtaccatcaaatacacatcggagtggtagcttaataaattttgctgcgatttttgcttgcgcatcggtaattctagcatctccagttgttgtggatgcaagttctactccgaaaactaaaaatgataatcaacttgtaattactacaaaaaatgagattaacacaatttcaagtaatgatggcaaaatttttgatgtgataaatacggttttaaaaagaaaagctgaaatcaatataaaatatgatgaagatttaaacttgtatttctttgttatcaaaacaacatctgaattgttttcctcagattacgatgttttggatactctcgataatgtattatctgactataaatatatggggaaatctgtagtagcaactttgggggaataa

SEQ ID NO: 3122 - DNA (genomic), 702 bp, Enterococcus faecium; double-stranded, circular
  misc_feature (B) LOCATION 1...702
  hypothetical: NO
  anti-sense: NO
gaaaaagaaattaccagatgcacaaagtgtaaaaagaagtcactgctagaatttgatggaacagacttcgaagttaaaaaagtagaaaagaaagagcgcaaaagaaaccctgcgaatcctttcactacaagtagcctgcaacaagaagctgcccgtaagttaaactttcgaacaagaaaaaccatgatggtagcacagcaattatatgaaggaatcactttgggtaaacaaggaacagtcggcttgattacatacatgcgtactgattctacccggattgccgatacagcaaaagcagaggccgcagcatttattgaagatacgtatggaaaagaattttctagacatgatcaccgaaagatcaaaaatgctcaaggcgcacaagatgcccatgaagctgtgcgtccaacgagtgtgcttcgtacaccagatgaactcaaacaatatttagataaagatcaattgaaactttatacattgatctggtcacgttttgtggctagtcagatgacaccagctattttagatacaatgaaagtgacattagaacaaaatggtgtcatcttcattgcgaacggttcaaaaatcaaattcaaaggattcatgcaagtgtatgtggaaggtagagatgacggcaaagaagagaaagaaaatattcttccagaacttgaagaaggcgatgtagtccaatctgttgattaa

SEQ ID NO: 3123 - DNA (genomic), 621 bp, Enterococcus faecium; double-stranded, circular
  misc_feature (B) LOCATION 1...621
  hypothetical: NO
  anti-sense: NO
atgaaagaaatcagacgaaaacatttccgttttcctgcgtacgatgatgagttaggcgtaaaattaaccaacgacaagaagcgagtattatttgacggacaagaagatcttttgactgaacagaatcagtccccgtttgaacagatgaaagaatttcatttcacgaacacgaacaccgagaaaatccgtcgcaagcgtcgtgcaacaaatggattgaagtcagctccgcgtaaggaaaatttggaaaagcataaaggaaaattaccggattataccggccattaccaatcagaaatcacatcgacaggacgaaaaaaactttttggtgattcctctcgttctgtcagacaaagtgaaacaaggacagagtccaagcatactacacgaaacgcatctgttgacacgaaggtgcgggagcgttcttattttgttcctaaatatgtacccgcatcgattatcccagaccctagagaaagcaaaatttttgaggatcatttaatcgaatcggatgaaaaaaaacggaggactcttatctgttgttcgatacagaaccgacgccgtatcaagaaaaaagaaatggtgagccgtctgtacgaacattcaatcgcacaaaaacgttag

SEQ ID NO: 3124 - DNA (genomic), 1560 bp, Enterococcus faecium; double-stranded, circular
  misc_feature (B) LOCATION 1...1560
  hypothetical: NO
  anti-sense: NO
aatgaagaaattagcataattaaggaaggaaaaagaatgaagaaaatcagtgtaggacttattgggatagcagctctaggattattgggagcttgctccagcactaatgatgcaaaagtatcgaatgataaagatggaaaattagaaattgtaacaacattctatccaatgtatgatttcaccaaaaacatcgtcggcgatgaagcgaacgtggatttaatggttccagcgggatcagaacctcatgactatgagccctcagctaaggatatggcaaaagctcatgatgctgatgtttttgtatatcataacgaaaacatggaatcatgggtaccaaaagctaaagaaagttggaagaaagctgggcctaatgtagtagaaggaacaaaagacatgattttattgccaggtagtgaagaagaagatcatgatcacggagaagaagatcaccatcatgaactagatcctcatacgtgggtttcacccaaaatggcaattaaggaagtttcaaatatcaaggatcagttagttaaattgtatccgaaaaaagcaaaagtatttgagacaaatgctgaaaagtatttgactaaactgaaacggttggatgctgactataccactagtcttaaagaagcgaaacaaaaaagttttgtgacgcaacacgcagcctttggatatttagctttggattatggattgaaacaagttcctattgctggactaagtcctgaagaagagccatcttctggtcgattagctgaattaaaagagtatgttaaaaaaaataagatcaattatatttactttgaaaagaatgctaatgataaaattgcaaaaactttggccaacgaagctgggataaaattggaagtactgaatcctcttgaaagtcttacaaaagaacaaatggataatggtgaagattatgtttcagtaatggaagacaatctaaaagcgttagaaaaaacaactatggttgctggtgaagaggtagttccagaaaaagaagcgaaggatgaaaagacagttgctaatgggtactttaaagatgccgatgtgaaggatcgcgaattgagtgattatacaggcgaatggcaatctgtttatccgttgttaaaagatggaattttggatgaagttttcgattacaaagcaaaaatcaataaagacatgacagctgccgagtacaaagattattatactactggctataagacagatattgatactatcaacattaaagacaacaccattgattttgtagtcaacggtgaacatcatcaatacacatacaaatatgttggatacaaaattttgaattatgaaaaaggaaaccgtggtgttcgttttaattttgaaactgatgatgcaggtgctggtcgttttaaatatattcaatttagtgatcatggaattgcaccaagtaaggcagagcatttccatattttctttggtggagaaagtcaagaaaaactctataatgaattgcataattggcctactttctatccagcttcattgtctaaacatgaaattgctcaagaaatgatggctcattaa

SEQ ID NO: 3125 - DNA (genomic), 684 bp, Enterococcus faecium; double-stranded, circular
  misc_feature (B) LOCATION 1...684
  hypothetical: NO
  anti-sense: NO
tgtggagaaatgagggaaagaatggaaaaagaacgcgtagatgtattagcggtcaaacaaggattatttgaaacaagagaacaagccaaacgttcagtgatggctggtttgatttacaacgaaaaaaacgagcggtttgataaaccgggagaaaaaattccagtgagtagtgaattaagagtcaaaggtaaaaaacttccttatgtttctcgagggggattaaaattagaaaaagcactcaaagcatttgatctatctgttgaaggaaaaacattgttagatattggtgcatccactggcggatttactgatgcagctttgcaaaatggcgcaaaaatgagttatgctttagacgttggctacaatcagctagcttggaaaataagacaagatcctagagtcgtcgtaatggaaagagtgaattttcgttatgcaaaacccgaagactttaccttaggaattccagaagttgctgttatcgatgtttcttttatttcactaaaactgatgctgcctccattacatgctattttaaaagaagagggagaagtgattgctttaatcaggccccaattcgaagcaggcagagaagctgtagggaaaaacggaattgttcgtgaccctcagacccatcaaaaaggttttagaagacattttgtcatttgcggcacaaggtggatatga

SEQ ID NO: 3126 - DNA (genomic), 417 bp, Enterococcus faecium; double-stranded, circular
  misc_feature (B) LOCATION 1...417
  hypothetical: NO
  anti-sense: NO
ctaatggaaatcacgaaaaaattaaatattccagcatcgtttttttacgataaagttatggactctgtccttttcgatgtacgtaaagcgaccggcaaatcagtaactagaaaacagctgaaaaatttggagtacgtcaaacaattctcgcaaaataaccgggctcgcataaaaatcgaagaagtcattgaaaaccagtcttataagtttcgtacatcgacaacgaagaatgaattcgtcgttcattatcaaatcaaaccattggacgattcgacctgtgaggttcattacacagaaaaaatggagtcttatggcatgcttcaaaagttgaatgatatgcttttaggaacaatcttgatgtattttaaacggagacgtttcaaaaaaatgctagatatgatcgaagcaacgtattaa

SEQ ID NO: 3127 - DNA (genomic), 1017 bp, Enterococcus faecium; double-stranded, circular
  misc_feature (B) LOCATION 1...1017
  hypothetical: NO
  anti-sense: NO
gaggtggaaatcatgctgaaattcaatgaagaagaacaaatcaaagcaataaaaggcgcactagctttacgtccgcaagtagaagaaatcatcgataaactttatgcggaaaaatttgacgctgtctattatctaggaatcggtggaacgtatgcttcctcgatgcaagctgtcacttatatgaatgggaaaagcaacttgcctgtctttgtacagcatgctgcagaatattacactactggaaacaaaagattaacaaaagattctatcgttattttgtcctctgttaccggtacaactcaagaagtagtgaaagcagtagaacaaatcaagaaagtaggagcgacactgattggatttatcgataaagcgaacagtaagttgtctcagctatgcgattttgtggtcacttatccagctcctggaacagaacaaatcaaattttttatggcagcagatcgattgatgtatttgaatggagaattcgaagcttattcagaatactatgaacagctcgaacgttatttaccaacagggttagtggaagcagagaaaaaagcagatgcatttggcttatcatttgcagaaaaacatcgacgtgatagtatgcattattttattggagcagggaatcaatggggagctgtttattcatatgccatgtgttactgggaagaacaaagctggcttccatcgaaatctatccatgctgccgagtttcttcacgggacgttagagatcgtagaagaaacaaccccagtcacattatttttaggcgaagatgaacagagagtgttatctgaacgtgtggctaaacttttgccaaaaatttgcagcaattatacattgatagacacaaaagactatccagtagaaggtatcagtgaaaaatatcgcggacgtgttttgtctttcttattgatgcatgtagtgacacaacgcatcgatgctcatgtggagcagttgaactgccatccattagagatacgccgctactatcgtcagtttgattattag

SEQ ID NO: 3128 - DNA (genomic), 903 bp, Enterococcus faecium; double-stranded, circular
  misc_feature (B) LOCATION 1...903
  hypothetical: NO
  anti-sense: NO
gacgcggaaatgtacgaggactggaagcctgacagcatggcggtgcaggaggtcaggcccgtggcgaaaaaacatcaccaccagcgccagcattgcaaccgccagaaagaccgccttatgtgccgccgcatactgggcgatggcgcgggcaatcttgccggtggcggtcaggacgttttgggtaaatttcgcgctctgtttggcttcatgggcggcctgggcatatttccgcttgattttctgcttctgcacccattttgccagcgcgtttttgcgttgcagttcggggttatcccgcagggcggtctgccatgcaaggtcagtgtgcgcccgcgccgctttctgctgggctttccgcaaagtgcggtagggtttggagcggcggcggttccgttccccggcgcaggacgcgccccgcgccctgttcggcaaccatttcgattttgtgggcagattccagagccacgttgtcacgctcatattcacggagtttgccatgcagctttaagactgccgccgtttttgccgcatttccggcacgggaggacagggagggcttttggtactccggcaggatttcatcctcaaaacggagccgccgctttatcttcccgctggcttcgtcaggctggtgatccatgtgcaggcggcgtttggcaggcagcttcatttgtgcttgctccacgcggcggtctgcgcgttccgtgcggcaggcggccttgttatatttcttttgttggcgggtgggcatatcgggcgcagtatcgccggaaatgtccgtatctttgggagtgtcctcaaatttcaggcgtgtttccccggcctttggattgccatcggattttagcttatcctccggtttggcggcgtgttcggccagctttgctgtctgccgctttctga

SEQ ID NO: 3129 - DNA (genomic), 867 bp, Enterococcus faecium; double-stranded, circular
  misc_feature (B) LOCATION 1...867
  hypothetical: NO
  anti-sense: NO
aacgaggaaattaaacacatgaaacttgcagtagttacagatagttcggcatatctgccggaacgtatcaagaaccatcccgacttattcgttattccaatccctttgattatggatgggaaaatttataacgaaggaatcgatatcgaagcggatgaatattatggacttttaaaaaacagtaaagattttcctactacttcacaacctgtcgtaggggaagttttgggtttatatgaggaattgaaagagaaagggtatgacacgattttaagtatccatctttcttcagggatttctggctttgtcaacacattatttgcgatgaaagatgacatcagcggagtaacggtcattccttatgactctaagatcactagtatgccgatgggacacatggtagaagctgccttagacttaaatgatgaaggtcagtcccttgatgaaatacttgcacatatcgatcgaatccgagataatacctatgcttatctgattgtagatgatttgaacaatttagtacgaggaggacgtttgacaaatggtgcagcgctgattggcagcttattaaaaatcaaaccgatcctgacattttctgaagggaaaattgttttattcgaaaaaatccgttcaagtaaaaaagcatttgctcgagctgaagaaattattggtagaagaaataacgaaatacaaccgccagtcaaactttacgtgatacatgcaaataatttagaagtagcgattgcggagaaagagaaattgcagaaaaaatatccaaatgcagaaatcgaaattggtcatttcggaccagtcattggtacacatttaggtgaaaaagccatcggcattgccatttcagcgcaataa

SEQ ID NO: 3130 - DNA (genomic), 384 bp, Enterococcus faecium; double-stranded, circular
  misc_feature (B) LOCATION 1...384
  hypothetical: NO
  anti-sense: NO
acggaggaaattataatggcattgaacattgaaaacatcgttgctgagttaaaagaagcaactatcctagaacttaacgacctagttaaagctattgaagaagaatttggcgtatctgctgctgctcctgtagctgtagctgctgctggtggcgctgctgctgctgaagaacaaacagaattcactgtagaattaactgcagctggagaccaaaaagttaaagttatcaaagcagttcgtgaagcaactggtttaggcttgaaagaagctaaagctgtagttgatggcgctcctgcaccagttaaagaaggcgtatctaaagaagaagctgaagaattgaaagctaaacttgaagaagttggcgcatctgtaactgttaaataa

SEQ ID NO: 3131 - DNA (genomic), 1302 bp, Enterococcus faecium; double-stranded, circular
  misc_feature (B) LOCATION 1...1302
  hypothetical: NO
  anti-sense: NO
caggaggaaatgcaaatgaataaaacagaatatgagcaaatcaatgaaacactttatcatgaagtactgccaaacggtttgaccgtgtatttgttgcctaaaaatgactatcacaagacatatggtttgttcagtacgaattatggttcgatcgataacgaatttattccctatggtgaaaaagaaaaggtgaaagttccagatggaattgcccattttttagaacataagttgtttgaaaaagaagatggtgatgtctttcaattatttgggaaacaaggagcttccgccaatgctttcacaagttttacgaaaaccagctatctgttttctacgacggatcaggtagaaaagaatctgacgactctgatcgattttgtacaagcaccttacttcacagaagaaactgtaaacaaggaaaaaggaatcatcggtcaggaaatccaaatgtatgaagacgaccctaactggcggatgttttttggcatactaaataacttgtatcctacacacccattgcatatcgatattgcgggcacggttgaaagtatcgacaaaatcacagctcaagacttgtatacgtgctatcggacgttttatcagccaagcaatatggttttatttgtagttggtaagatggagcctgagaaattgatgaaacttattcgggaaaaccaagaagcaaaaaatttccctccaaagcaagaaattgtacgttatttccctgaaaacacaaaagaaatcatcaaacaaagtgcattggaagcagccattacacgagataaatttgtacttggtattaaaggattagacacattgccgcaagaaggaacagaactgttacgctataaaacagcaatcaatctgttgttccaaatgattttaggcaatacttctcgaaactatctagcgatgtacaatcaaggaattatcgatgacagctttggttttgaattcagcttggatcgtgaatttcactttgcggacttcagcggagatacggacgaaccagagaaagcagcagaaaaagtcaaagaaatcattcttggattcgctgatgatccggaagtgtcagaaacaaatctcgatttgctgaagaagaaaatgcttggacaatatttccaatcattaaattcgatcgaatatattgccaatcaatttacgcaaagtttatttggcgatcgaactttatttgatcttcctgaaatcatcgattcgatccaaatgaaagacgtactggcagctggggaagcatttataagtgaagaggccttcagcgagttttacatgagaccaaaataa

SEQ ID NO: 3132 - DNA (genomic), 978 bp, Enterococcus faecium; double-stranded, circular
  misc_feature (B) LOCATION 1...978
  hypothetical: NO
  anti-sense: NO
caggaggaaatcatgaaattccattatcatatattgatcaatccatcggcaggcagcggaaatggctataaagtagcagaaagaattttaccggtattaaaaaataagcatattgactatacacttcattatagtgaatacaaaggacacgatgctgagattgctgaaactttggcaaaagaaacattgattccttggatagaagaagaacagaaaacaatcgatactttcccccttttgatcatcgtaggaggtgacggcaccttacatcaggtacttgatactttctatcagatggaagtagaattcccagttgcttatattccagcaggttctggaaatgattttgctcgaggggcaggccttccaaaaaatcccaaaaaaggacttcagctgattttagcagctcaatcaccagaaaaagtccacataatggcttatgaagaaaaaataagtgaaaaaaaaggaatagctgttaataatttcggtataggattagatgcagctatcgtccatgcgacaaatcattcttccacaaaaaagcgattgaacaaatacaacttaggatcattttcgtatttattctctattctccgtgctttattcactcaaaaaggatttccaattctggtagatgcaggaggaaaacaattaagtttttcaaacgcatttttatgtacagcaacgaagcatcctttttttggcggaggaatcgcgattgttccaactgctgatgcgtctaaaccagtcattgattttgtcgtggtcgaacgaatcaatttctttaaaatcttgtggctcattcttttacttatacagaaaaaacaattgaaatcgaaatatttccatcactacacaacaaacagattacgtatcgtttcaacaacaccgcaacatggtcaagaagatggagaagaaatggaaaaacgaccttttgatatcacaataaccacaactaaacagttgttttggtgttaa

SEQ ID NO: 3133 - DNA (genomic), 504 bp, Enterococcus faecium; double-stranded, circular
  misc_feature (B) LOCATION 1...504
  hypothetical: NO
  anti-sense: NO
aaaagggaaataattaggaggaacattttttttatgtcaatcgaggtaggagcaaaactgcaaggaaaagtatcaggaatcacaaattttggtgcgtttattgatctaggtgctggaaaaacgggtctagttcatattagcgaagtgtcaaatggctatgtaaaagacatccatgatgttttaagtgtaggagatgaagtaacagttaaagttatttcagtaaatgatgatggaaaaatcggactatctatccggaaagcgcaggaacaacctgctgaatctggagaagaaagccgtcctaaaaaatatcaacaaaaagatccccgtgacaaccgaaatcgtccagcacagaaaaaatctttttctcgcagtcaaccttcagctcaaaaagaagacttcgattcattgatgagttcatttttgaaagatagcgatgaccgcttatcttcattgaagcgaaacacagaaggaaagcgcggtggccgtggcggacgtcgcagctaa

SEQ ID NO: 3134 - DNA (genomic), 1566 bp, Enterococcus faecium; double-stranded, circular
  misc_feature (B) LOCATION 1...1566
  hypothetical: NO
  anti-sense: NO
gtgaatcgaatggccatcaaagcagaagaaattagtgccttgattaaagaacaaattgaaaattatcaaaacgtgctttcagtcgaagaaatcggtaccgtaacttatgtaggtgacgggatcgctcgtgcacatggtttagaaaacgcgatgagtggtgagttgcttgaattttcaaatggctcatacggaatggcgcaaaacttagaatcaaatgatgtaggtatcattatccttggcgatttcgagtccattcgtgaaggagataaagtaaaacgaacaggaaagatcatggaagttccagttggagaggccttgattggacgggtagttaatccgctaggtcagccaattgacggactaggtgaaatcgttactgacaaagctcgtccagtagaagcaatggcaccaggcgttatgcaacgtaaatctgttaacgaaccaatgcaaacaggtctaaaagcaatcgacgctcttgtaccaatcggacgcggccaacgtgaattagttatcggtgaccgtaaaacagggaaaacttccattgcgatcgatacgatcatcaaccaaaaaggtcaagatatgatctgtatctatgtagcaatcggacaaaaagattctacagttcgtacacaagttgaaacattgaaaaaatatggcgcaatggattacacaatcgttgtgaatgccggtgcgtctcaaccagcgccgttgctttatatcgcaccatatgctggtactgcaatgggtgaagagttcatgtacaacgggaaacatgtcttgatcatttttgatgatctttcaaaacaagctgttgcttatcgtgaactttccttgctgcttcgccgtccaccaggtcgtgaagcttatccaggggatgttttctacttacactcacgcttattggaacgtgcagcaaaattaagtgatgatttaggtggcggttcaatgactgccttaccatttgttgaaacacaagctggagatatctctgcttatatcccaacaaacgttatttcgatcactgatggacaaatcttcttagaaagcgacttgttctacgcaggtactcgtccagcggttgatgccggactatctgtatctcgtgtagggggttctgcgcaaatcaaagcaatgaaaaaagttgctgggactttacgtctagacttagcaagttaccgtgaattagaagcatttacacaattcggttctgacttggatgcagcaacacaagcaaaactaaatcgtggacgccgtacagtagaaatcttgaaacaaaaattgcatgcaccgctagctgttgaaaaacaagtagtgattttgtatgctttgacacatggattcttagatagtatccctgtagacagtattttagacttcgaacatgaattattcgaatatctggataccaatcattcagatatctttgaaacaatccgtacaacaaaagatcttccagaagaagaagcgttgaacagtgcgattcaggaatataaagacatgttcttagctacaaaaggaaataattcctctacagaagataaattgaaatccattcaaaatgcatag

SEQ ID NO: 3135 - DNA (genomic), 219 bp, Enterococcus faecium; double-stranded, circular
  misc_feature (B) LOCATION 1...219
  hypothetical: NO
  anti-sense: NO
atttgtcgaataggcaagcaaataaaaacaaataccaaaaaatatagattcagatttaagggaggttgtgacagaagtgatcagcttcaagaacgccgtttattcggaaaaaggagctgtgatacgacttttgtcacagccctattttattggaaaaaaagagtgcttttcttttcttattttacaattaaaggtaaaataaataacaagaaggtatga

SEQ ID NO: 3136 - DNA (genomic), 411 bp, Enterococcus faecium; double-stranded, circular
  misc_feature (B) LOCATION 1...411
  hypothetical: NO
  anti-sense: NO
aaccaacgaattttattgtatctgattacgatcgtgctgctcctaaggggactggtgcagcaaaagtcggcgggaaattacgcatcgagtttacttccaggaacagaagcaaaagaactggattactcagattgtgtttatcttgatccagccacacatacgaaaatcgaagaagtaggtgcagcaaatttctttggaattacaaaagacggaaaattcatcactccgcaatcgccctctatcttaccaagtatcacgaaatattccttgttgcagttagctgaagaacgactaggactgcaagcaattgaaggagatattttcattgatgatctagatcaatttgcagaagcctggtgcatgtggtacagcggctgttatttctccaatcggtgggatttatcacaataa

SEQ ID NO: 3137 - DNA (genomic), 837 bp, Enterococcus faecium; double-stranded, circular
  misc_feature (B) LOCATION 1...837
  hypothetical: NO
  anti-sense: NO
agactgcgaattctaaatatttctcgtcagacctactattatcaagcgaaaccgatcgaaaatgagtccgacttagaagagatcgttcaggaagagtttattcgaaaccgaaaggcttacggtacccgaaaattgaagaagtgtttagcaaagcgtgggcttcaactcagtcggcgccgaatcggtcgaatcatgaaacgccgcggattgacatctacctatacgatcgctcattttaaagggcaacgaacagcttgtaatgaagcgaaaacagcgaatgtattagatcggacctttacacaagaacagccattggaagccatcgttacggatcttacttatgttcgcgtgaggaaaaagtggcattatatctgcttaatacttgatttgtttaatcgagaaattattggttattcctgtggtgagaagaaagatgcctcattggtaaaagaagcctttggacggataccgtattctttaacagacgtcaagctttttcatacagactggggaaaggaatttgataaccaaaccattcatgagattctgaatggttttggaattactcgttcattgagtaggaagggttgtccgtatgataatgccgttgtggaatcaacctataaatctgtcaaagtagaattcgtgcatcaataccaatttgagacactggcacagctacgtctagaattgtttgattatgtgcattggtggaactatctacgcttacatggcacgttggcgtatgaaacaccgatccaaattcgacaacagagattggcgaagcgaatccttgataatgagcgcggatctgatacctctggagaggcagcgtaa

SEQ ID NO: 3138 - DNA (genomic), 1119 bp, Enterococcus faecium; double-stranded, circular
  misc_feature (B) LOCATION 1...1119
  hypothetical: NO
  anti-sense: NO
tcagagcgaattatgggaggaatgacaatgtcacaatttgatcaatcaattactttaccttcaggagttcaattgaagaaccgattgatgctgtcgcctatgacgacacaactcagctttttcaatggagtgatcaccgaagatgagatcacttattataaacaacgttctaaaggtcttggtgctgttattactggtgctgcaaatgtccaagatatcggaaaaggctggccaggtgaactcagcatcgctcatgatgaaatgattcctcgattaagtgagctagcgaaagcaatccaaggagaaggcgcaaaagcgattattcagattttccacggtggacgaatgacaagtcgagcaactttatctggagaacagcctgtatctgcaagtgcagttgcagcaaaacgtcctgatgcggaaacaccacgagcaatgagtgaagaagaaatcgttgaaacaatccaagcatttggcaaagccacacgtagagcgattgaatcaggatttgatggaatcgagttgcatggagcaaatacgtatttgatccaacaatttttctctccgcattcgaatagacgagaggatcaatggggcggtagcttggaaaatcgttatcgttttattgaagaattattaacaacggttttctcagcggttgaacaatatgctaaaaaaccattcatcgtagggtatcgtttctcaccagaagaatatgaaacaccaggtatccgttttgaagacacgatctggcttcttgaacgattacgtgagtcaaaactagattatctgcatgtttcattaaatatgtatgatcgaatagctcgttctgataaatacaacgataaatcgattcttgaagtggtccataacacgattcaaggaaagatccctttagttggtgtcggtgggatccgcaatcgcgaagatgtagagcaggtattgaaatatgcagaacttgcagcaattggacagcaaatgatcgtcgatcctgactgggcagagaaattattggaaaaccgtgaggatgaatttgtaacgaaaccttttgaagaagcatataaagagctttatttgccaagcccattatataatttcttgaaagcacgttatcaataa

SEQ ID NO: 3139 - DNA (genomic), 231 bp, Enterococcus faecium; double-stranded, circular
  misc_feature (B) LOCATION 1...231
  hypothetical: NO
  anti-sense: NO
tatgatagaatcgagttgaaaaaagaacgatcagaaagaggagagagcattatgccattcgtacatgtcgaattagtagaaggtcgcagtccggaacaattagaaaatatgatgaaagatatcacggaagctgttcataaaaacacgcaggcaccaaaagaacacatccatgtcatcatcaatgagatgaaaaaaggaacatacggtgtaaatggggaatggaaaaaataa

SEQ ID NO: 3140 - DNA (genomic), 612 bp, Enterococcus faecium; double-stranded, circular
  misc_feature (B) LOCATION 1...612
  hypothetical: NO
  anti-sense: NO
tcacgtagaatagggaagaaaggagtcgatagtgtgaatttaccaaataaattaactgtacttagaatttgtatgatcccgattttcattttggttgtaggtttacctttagattggggacaatttaacgtaggagacaccacactggctgtcacacagctagtaggtgcagttatttttgctttagctagtatcacagactggttagatggaaaaattgcccgtgcgcgaggccttgtcactaattttggcaagtttgcggacccgttggcagataaaatgctagttatgactgcttttatcatgttggttgaccaaggaaaggcccctggttgggtagtagcgatcattgtctgtcgtgaattagccgtcacaggcttgcgtttactacttgtcgaacatggagaagtcatggctgcagcttggccgggaaaagtcaagacggctacacaaatggttgctattatcttgctgtttatcaataatatcccattcagcctgatcggtattccagtagatcaaatcatgctttatgcttgtctgatctttactatctattcaggtgtggattacttcatcaaaaacagcggtgtgttcaaaggatcaatgtaa

SEQ ID NO: 3141 - DNA (genomic), 870 bp, Enterococcus faecium; double-stranded, circular
  misc_feature (B) LOCATION 1...870
  hypothetical: NO
  anti-sense: NO
cgaagtagaataaaattgggagtaggggggaaagtcatggatatccaaactgttttatctgatctgaaattaaatggtaaagtgattccagttgttggtggcgatgttaatcagacctatcgtataaaaaccgaacatcgtgcttattttttaaaaatccatccgaatgtaaaaaaaggattttttgaagcagaagtagacggattaaaagaactgtcagcattcgtacgtgtaccggatacgtatatgctaggtgaaacaagtgaaggcgcttatttgttaatggaatggatcgagccgggaaaaggggatcaacgagatcttgctgcagctttagctaatctccatcagcaaacagcgccacaatttggttttcgtaaagataactatttgggtacacttgttcagaaaaattcttttgaagaagattggtggacttttttctttaaagatcggcttgaatcccagatttctttggcagaagaaacgaatcgatggaatgtacagcgtcaagaaaagtatctgcgatttaaagaacgtgtattgaaatcggttgaaccaaaaaagatcactccacgcctcttgcacggagacctgcggagtggtaatgtgttctttgaccagcaagggcatccagtttttgtcgacccagctgtttcttatgggaatcgggaacaagatattgcaatgagccagttattcggtggtttccgaccggaatttttagatgcttatcaaactatatttccattagaaaagggatggaaagaccgactgccgatttaccagttatattatcttttggcacatttgaatatgtttggagaaagttacggttcccaagtagatcaattactagaaaatttttaa

SEQ ID NO: 3142 - DNA (genomic), 885 bp, Enterococcus faecium; double-stranded, circular
  misc_feature (B) LOCATION 1...885
  hypothetical: NO
  anti-sense: NO
gtgatcagaatgaagtatattctttgtcagccggcaatcaatcggtttaaatgggagcttgaagtttgtttaactaatctgaagaaaccccgaatcaaagagatcgtattgcttttcagcagacacgatgatcagattcctattttttttgagaaagaatatggtgttgaagttcatgtgtacgatgatctgcgggacgacaaagaatatattcctgcgcttaaaccatatttatggtggaaatatttagaagaagatcattcgcgtgaggacgaccgatatttctatatcgattcggatgtcattttcaataaaagaattaatttgcgcaaattgccttctaaagatgatgtttggtattgtagcgactgctgtagttatctaagtcttgattatattagaagctgtgaaaacggagaaaatattctaaaagatatggcaaacattgtaaatgttacagtagaatctttggaaactataaacactaattcaggaggcgcacagtgggttattaaccgtcctaaagcgaattattggaaaaaggtttatctggattctaatcggctatatcgctaccttagagggcaaaaaacaaatatacaaatctggacagccgagatgtgggcacagctttggaacatgatgtatttcaatattggtcctaaagttcacgaggaattagacttttgttttgctactgatccaatagaaaaagttaaagaagtaaaaatcttacacaatgctggagtaacaacaaacgatgaagatttatttttcaaagggagatacgtgacttctacgccttttgatgaagatttatcatttgtaaacaagaaaaaatgctcttacgcatatgttaaagcaattaaggcggtggttagatga

SEQ ID NO: 3143 - DNA (genomic), 330 bp, Enterococcus faecium; double-stranded, circular
  misc_feature (B) LOCATION 1...330
  hypothetical: NO
  anti-sense: NO
tattcaagaatgattttatcttgtgtcaatgtccccgttttatccgtacataacacatcgattgcaccaaagttctggatggcattcaaatttttgatcactgttccttttttggccatcacacttgctcctttgaccaaattcgtcgtaacgatcattggaagcatttcaggtgttagaccaactgctacagatagtccaaaaagaaaagcttctagccaatccccttttgtaagcccattgatgacgataactgctggagccatcaatgacataaatttgatcagtagcatggatgttttatggatgcctaattcaaagcttgattga

SEQ ID NO: 3144 - DNA (genomic), 921 bp, Enterococcus faecium; double-stranded, circular
  misc_feature (B) LOCATION 1...921
  hypothetical: NO
  anti-sense: NO
gagtcaagaatgaaaaaaataattggagcttttgtatttgcaatcattatcattattatctgttttcaaatagatgtttttggtcaaaaaaagatagttggacaaacggtcagcagtacgaacagtacggttacaaagacaaaggaatcatttgatgatacagaacaagagacattaatcaaaatcggaaaaaatgaccgtacactatatacagatgactcgctaactaccccacttgcaactataaacggcggagagctggcggagtttctttctgaaacaaaaaatgcttatcagatcaagacaaatgatggctatactggatatttagccctcgaagatggaaccaaagtcacaaagaatatacaaacaaaaccggaagagctatctgatgcagtgattgtattagatcctgggcatggcggaaatgatactggggcattaagcaatgatgaacaaacagaagaaaaagatattacattaagtacagccataaaagtaaaaaaggcgttagaggatgctggagcaacggtttatttgacccatactacagatgaattagtacagcttggagatatatgcgactacagtgaagaaaaaaaggcagatgtctttatcagtttacacgcagactctacggaatatgcgaatgaagcaactggaatcacgacatattattactatggacaagaggaaacattagcacagacaattgctgactccttcactgatctgcctctggattcaagaggaatctccactgggaactatcaagttcttcgagaaaatcttcaaccttctattttaatcgagatgggttatatgaataatgatagtgatttaaaggaattagtaacagacagttatcagcagcagattgctgcaagtttgacacaagcattgaccacttattttcagtaa

SEQ ID NO: 3145 - DNA (genomic), 330 bp, Enterococcus faecium; double-stranded, circular
  misc_feature (B) LOCATION 1...330
  hypothetical: NO
  anti-sense: NO
ggacaaagaatgattatcccaaatagtttagaagaattagcaggctacgtagaaactggaaagagtgtatttttctttactgccggctggtgcggagactgccgttttatcaaaccgcaaatgcctgaaattgaaaatgacttttctgattggcaatttattgaagtagaccgtgacaagtacatagatgtagccgctgaatggaacatttttggtatcccaagttttgtcgtgatccaagacggaaaagaattaggtcgtctagtgaataaagatcgtaaaacaaaacaggaaatcgaatcgttcctagaaagtgtaacaaaaggctga

SEQ ID NO: 3146 - DNA (genomic), 204 bp, Enterococcus faecium; double-stranded, circular
  misc_feature (B) LOCATION 1...204
  hypothetical: NO
  anti-sense: NO
tggaaaagaatcgaaacttctctagctgaaaaggcaatggataggttgcacttaatagtatcgcaaacaaaagcacagatagcaaaagtaatgttccgatcactccgatcgtttttacacctttattcattttcgcacctcctcataggggtgaaacgatcaacttcttataagttgatcgcttctccaccagttactccgtaa

SEQ ID NO: 3147 - DNA (genomic), 1182 bp, Enterococcus faecium; double-stranded, circular
  misc_feature (B) LOCATION 1...1182
  hypothetical: NO
  anti-sense: NO
ggagaaagaatttcaatgatagaaacaataaatcccgcagaaaacaaggtttctgcgtacattcatatcccattttgcgagcatatctgctattactgtgattttaataaagtttttttagaagggcagccagtagatgagtatgtggaaatgctgctgaatgaaatgaaaataatgctagaaagtcatccgacagcgaatttagaaacactttacgtagggggcgggacaccaacttctttatctgctaaacaacttgatcgactgttatcaggtgctagagagatcctgccttttcaaaatggtaatgagtttactgtagaagcgaatccaggtgatttgacccgtgaaaaacttcaagtaatgaaaaactatggcgtcaatcgtttatccatgggagtgcagacatttgataatcgcttattgaaaaaaattggacgtaaacacaccgcagaagatgtgtatcaaactatgcaatttttagaagcagaaaattttaccaatgtaagcatcgatttgatttatgcattaccgggacaaacactagaaggatatctggatactttggaaaaagctttggctttggatctgcctcactattctttgtactcattgatcctcgaaaacaaaacaatgttcatgaactgggtacgacaaggaagactcgaactgcctgatcaggaaacggaaaccagaatgtttgaagagacgattgaagcaatggaaaagcatggacgtcaccaatatgaaataagtaactttgggctctccggacatgaatctcaacataacctcatgtactggaacaatgaccactattttgggtttggagctggtgctagcggttatcttggagatattcgttaccgcaacaaaggaccaatccaacactatttacgcccattacgagcaaatgaacgcccggtattggaagaagaaaaattgacacgaaaaaatcaaatagaagaagaaatgttcttaggactaagaaaaaaaacagggattactaaaaaacatttctatgatcgctatcaaaaaacaattgaatcggtgtacggtgatgtgctaagggaattagagcaagaagggttacttgttaatgaagaagaccgtgtttatttgacaccaagagggacctttttggggaacaatgtgtttgagcgctttttgtttgaaaaatag

SEQ ID NO: 3148 - DNA (genomic), 585 bp, Enterococcus faecium; double-stranded, circular
  misc_feature (B) LOCATION 1...585
  hypothetical: NO
  anti-sense: NO
ggaggaagaatcatgaatgaaaaaattattgaaatcaaacatctaagaaaaagcttcggtgaaaatgaagtattgaaagatatcagcgtaacagtcaataaaggtgaagttgtgacgatcatcggttcttccggttctggtaaatctactttcttgcgctgtatcaatttactggaaaaaccaacaggcggcgagatcatttataatggagaaaatgtattagctcctaaatataatttacctaaatatcgaacgaatctaggtatggttttccaatccttcaacctgttcaacaatatgaatgtcttggaaaactgtatgtctggtcaaacaactgtcctgaaacgagataaagaaactgccaaaaaagtagcaatcgaaaatctggaaaaagttggtatggatcgttatatcgaagccaaaccagcacaattatttggtggacagaaacagcgtgtcgcaattgctcgggcattatcaatgaatccagatgtattgctattcgacgaacctacttcggcgttagaccctgaaatggttggcgaagtgcttaatacgatcaaagacttagaaaagagggggtag

SEQ ID NO: 3149 - DNA (genomic), 663 bp, Enterococcus faecium; double-stranded, circular
  misc_feature (B) LOCATION 1...663
  hypothetical: NO
  anti-sense: NO
aatttgagaatcgatgtttataaagggagggcaaaaatgtgcttttttacaacttttactatcattatgattgcagtactttttatttttctagatatagcaaagcgaaatacagcatttttattatatcgggttttacttcgagcaggtctcataacatttatatcgatcgttggattttttctattcacagttattgtatttatttggagaactacagcaccaccattgccagagattacatatggagaatttccgtttagtcttgaatatgaaatagatgaggaaagaattttgattgaagatacggtgattgcagaatttataggaagttttagagggaatgtgacaactcaacctagacgaagttggagtataaaacttttaaataatagtggagagttgaaagcatttcattatgaattcttaataatagaaagtgaagatgtaacaatcactttaagtagtggctctgctggatattttatgaatgatggtggaagcaagccacagctcacagtccgtgatcgtattgcaggttttatgcatttttctcactatgacttagaagaagctcgtaaaatacttgcagaatatgggatcacattaatcaattgggaatatgcgccaccgataagaaattttttcaatgattattattag

SEQ ID NO: 3150 - DNA (genomic), 201 bp, Enterococcus faecium; double-stranded, circular
  misc_feature (B) LOCATION 1...201
  hypothetical: NO
  anti-sense: NO
ataatgagaatttttctatatattctctattttgataatagtattctcattttcaaaataaataagggaggtgtgacaaaattcttgtcacacctcccttttccgaataaactgtgttccagaaatagcttcttcgaaaataagctgaaatttcacaaaaatttgagaagcaattttcgtacattccttcttctttcttga

SEQ ID NO: 3151 - DNA (genomic), 519 bp, Enterococcus faecium; double-stranded, circular
  misc_feature (B) LOCATION 1...519
  hypothetical: NO
  anti-sense: NO
ggaatgagaatcgcaattggatgtgaccacattgtcacagatgaaaaaatggcagtatcagaattcttgaaatcaaaaggacatgaggtccttgatttcgggacatatgaccacgcacgtactcactaccctatctatggtaaaaaagtcggtgaagcagtagtaagtggtcaagcagacttgggagtatgtatctgtggtacaggtgtcggcattaacaatgcagtcaataaagttccaggtgttcgctcagcgttggttcgtgatatgacatcagctatatatgcaaaagaagagttaaatgcgaatgttatcggtttcggtggaaagattactggtggtcttcttatgaatgacatcattgaagctttcattgaagctgagtacaaaccaacagaagaaaataaaaaattgattgcaaaaatcgaacacgttgaaacacataatgcacatcaagcagatgaagatttctttacagaattccttgaaagatgggaccgtggtgactaccacgattaa

SEQ ID NO: 3152 - DNA (genomic), 348 bp, Enterococcus faecium; double-stranded, circular
  misc_feature (B) LOCATION 1...348
  hypothetical: NO
  anti-sense: NO
aaacggagaatagaaattatgaaaaacttcgatatagtgtgcagtaatacaaaaaatatatatttacgtgagctacttaacagtgattcggaaactatagaagatgtaaaaaaaatcatagtgttgtttgaaaaagaaaacatggagctagagaattgggggctttttgaaataccgattagtgggaattactgtttttataattggaagacagaagacgatgtagcttttgcaaattacttttttgataaaaattacttttccccattatatatagataagcatagtaatgaacaagttgcttcttcaataaaagaagcaataaaattggaaagagtgaggaaatga

SEQ ID NO: 3153 - DNA (genomic), 840 bp, Enterococcus faecium; double-stranded, circular
  misc_feature (B) LOCATION 1...840
  hypothetical: NO
  anti-sense: NO
gttaggagaatagttatgttgaacattacaattagaggacatgatctttccgaagtccaaacgatagaagatcttgcagaaaaaacaaaagaacaagggattcatacactgcagctcgccttaggtctttcgtttcctgaaacaccttctggcgcaaatgagatcaattctgggatgggaaattatgtcaaacgagttttagaaaagcaagaagtgaccgtaggaattttaagttgctatatcaatatgattcatccagatttaacgatacgacaagagttgctgacaaagttcgagcagtatcttcgctatgcttcttcctttggtgcgtcgatggttgcttcggaaactggatgtgttttgccggaaatccaatatacggaagaaaatttcacagatgaagcatttgctgaagctgtgtccgttatccgtcgcttggtaaaagctggagaaaaataccaaatgatggtggggatagaaccaggtttgaatcatccggtgtattctttagcaagggtagagcagctgatccaagcagtagattcggactatctaggaatcattttagatccgaccaatttgatcacaagtagtgattatcaagaacaagtccaattggtagaagaagcttttgaacgttttggtgaaaagatatgtgcggttcatttgaaagattttcgtgtcgaacaggaaaaaatcgtgccggtaaatttgggagacggtgtgatcgagtacacaaaaatcaaagagatcatcatgaagaatcgtccgtacctgtatgtggttcttgaagaaacaaaagatgatgggattcgttatggaagaagtcttcttgaataa

SEQ ID NO: 3154 - DNA (genomic), 597 bp, Enterococcus faecium; double-stranded, circular
  misc_feature (B) LOCATION 1...597
  hypothetical: NO
  anti-sense: NO
aaaaggagaatatcattgaaaacaaaggaaaagatcttggaagcgaccaaagatcttatttataaaaaaggctatcatgaaacgtcaatccgagatattctagcagcttctgatacaggaaaaggtcaattttattattacttttcttcaaaaaaagaagtttgtctagcggtgatccatgcgcatatggacgtatggcagacagaattgttcgaagacatcttaaatgctggaaaacagccagaagaagcattagaagaaatgttggactggattttcgctgatcatgagacacagatcacttatcatggctgtcctgtaggtaatttgattattgagttgagtacagtggatgaagaataccgtctgttgctactagaattagtcaatcaatgggtcaagtatacgaaacaaaatatcctggcactttctgaagaaaaactgtccgatgaagaagcagaccgtcaagccaaagcgttgattgctgaaatccagggaagtatcttattgttgaaagtcacacaggatctatcactacttaggcagaattttcaattgatcaaagaaagattgttaacttcgcaaaaggttctttaa

SEQ ID NO: 3155 - DNA (genomic), 402 bp, Enterococcus faecium; double-stranded, circular
  misc_feature (B) LOCATION 1...402
  hypothetical: NO
  anti-sense: NO
aaaaggagaattttcatgaaaaaaattttagggttaatcgttatcgtattgattgcttttataggttggaaaggctgggactactatcagtctacttatgtaggaaaagattattatgcagtaatcaaagcaccgatgcctgcagaaactgatattaaagcagataatggagaagtaattggaaaagggtttaaatataacgtagatgcgtacgctgaaaacggtgaaaaaagacaattggattttgatgtcattacttctggcgactctgctaatggttctgcttatcccgaaggaacaatcttgcagttgaaagcaagcgaaaagcgaattatagagaaaaaagtaatcactagtgataaagtaccttcatctgtaaaagacaaattagggctatcttaa

SEQ ID NO: 3156 - DNA (genomic), 231 bp, Enterococcus faecium; double-stranded, circular
  misc_feature (B) LOCATION 1...231
  hypothetical: NO
  anti-sense: NO
gaaaggagaattctaatgaaaactttagatgctattgcattaactttattgattgtgggagggttgaactggctgttggtaggcttgttcgaacttgatttagtagctatgattgctggtggttcaacaactatttttgcgaagatcatttatatcgtcgtaggtatttgtgcgatctactgcttgaaatttttcccaatgattactagaaaagttgatgaaagatattag

SEQ ID NO: 3157 - DNA (genomic), 1752 bp, Enterococcus faecium; double-stranded, circular
  misc_feature (B) LOCATION 1...1752
  hypothetical: NO
  anti-sense: NO
agatctggaattgaaggggtttccacagaacaaggaaaagcagctgcaaaacaaaaccttcatcccgttcaacgtgctattgccgttttagcagaaatctttacaccactgattcctgcaatcattgtcggtggattgatccttggattcagaaatgtacttgaaggtatccagtttgaaagtcttggtggaacaatcgttgaacactcgaagttttggaatggtgtcaatgcctttttgtggttacccggtgaagcaattttccattttcttccagtaggtatcacttggagtattgcaaaaaagatgggtactacacaaatattaggaatcgttttaggaattacgttagtttctccgcaattattaaatgcttatagtgtagcttccacagccgcagcagatattccattttgggattttggttttgctcaagtccagatgattggttatcaagcgcaagttattccagccatgctggcagggtttatgttagcgtatctagaaatcttcttccgcaaatatatccctcagtcgatctcgatgatttttgttccattgttttcattgttaccaactgttttagctgcacacgttattttaagtcctatcggctggacagtcggaagctggatctcaaatatcgtaaatactggattgacgtcttctatcanctggttgtttagtgccgtattcggattcctgtatgctcctttagtgattactggtctccaccatatgaacaatgccatcgatatgcaactgattgcagatttcggatcaacgaatttatggccgatgattgctttatcaaatatcgcccaaggctctgcagtcttagccatcatcttcttacatcgtgggaataaaaaagaagaacaaatctcgattccagcaatgatttcttgttacttaggcgtaactgaacctgctatgttcggaatcaatttgaaatacgtctatcctttcgtcgctgcaatggtcggctctggattagctggcatgtttgctaacttgatgggtgttcgagctaacgcgatcggagtaggcggtttgccaggaatactagctatccaagcagaaacatgggtacctttcatcatcgcaatgatcattgctgtcatcattccatttggcttgacgatcatctttagacgtcagggaattttgaataagattgatcctgctgttcctgaaaatgctgctgatgtacaacttcaaacagcaaatggcgcaacagcaacgccacagtctttcgaacctgtttcagcaactggtacggcagttgcaacaaaagaaacattattcgcagtcgctgcagggaccatcaaggaaataactgaagtaaatgacccagttttctcacaaaaaatgatgggtgacggttatgctgtcgaaccgtcaaacggcaaagtctatgcaccagtaaacggtaaagtgacgagtgtctttgaaacaaaacatgccattggtattctttctaatgaggggctggaagtacttgttcacatgggattagatactgttgaactaaagggtgttcctttcaatgtattcgtgaaagaaggataccttgtcacaccagagaccctgattgctgaaatggatttgccagaaatagaacaagctggcaagaaaactgacattattgttgctttgaccaataatgaaaaagttgcaggactttctcttgaccaatcaggacttgttcgcccgggcgaagcagtcggtaaagctgaagtaaaatcttag

SEQ ID NO: 3158 - DNA (genomic), 207 bp, Enterococcus faecium; double-stranded, circular
  misc_feature (B) LOCATION 1...207
  hypothetical: NO
  anti-sense: NO
gctgctggaatactcgctgaaattggtccaattgaacgtttttctgatgaaataaaattgacaaagtatgccggcctatattggcgacagagtcaatccggtaaatctgaatacgaaaatttttttacgaaaagcttcacgtctaatatctattttaaaataaaaatattcctgctaatttggaatcgtttccttcttttggtataa

SEQ ID NO: 3159 - DNA (genomic), 795 bp, Enterococcus faecium; double-stranded, circular
  misc_feature (B) LOCATION 1...795
  hypothetical: NO
  anti-sense: NO
aagaaaggaatgagaaatatgaacacaccgcaaatttttaatttcgaacaaaacgaagttcggacaattttagtaaatgatgaaccatattttgtaggcaaagacgttgcgagtgttttgggttattcaaacactaaagatgctttgtcgcggcatgtagatttggaagataagatggggtcgcgaatcacgacctcaggtcaatcaagagagatgacaatcatcaacgaatctggtttgtacagtttaatcttaaaatcaaaacttccctctgccaaaaaatttaaacgttgggtaacaagtgaagtgttgccagcaattagaaaacatggaggttatctaactccagaaaaagtagaagaagctttgcttaatccagatacaatcattcaattagcaactcaactaaaagaagaaagaactggaagattaatcgcagaacaaaagattgcagagtacgaacctaaaatctcctatttagatagcatattatcttctacagattcagtaacaattagtcagattgcagcagattatgggatgtctccacaacagatgaataaattacttcataaactaggtattcagaaaaaagtcggtaaccaatggttattgtgcaaaaaacacatgaaccaaggatacacaaaatctcatacaactgagatcccgaaagccgatggtggcactaaaattgtaatgaataccaaatggacacagaaagggcgtctatttatctacgaattactaaaaaaagaaggatattaccctcaaatggatttagaggaaattggttag

SEQ ID NO: 3160 - DNA (genomic), 258 bp, Enterococcus faecium; double-stranded, circular
  misc_feature (B) LOCATION 1...258
  hypothetical: NO
  anti-sense: NO
aagaaaggaattgaaacaatgaaaaaagaatatggctaccctacattaaaagtaatatgtaaagcgtctgctggaaatgaaactgccataagagagattttgaagttttatgacgcttatatttgtaaattatgcttgcgtccgttttaccactctgaaagtggtaaaattactatgcaggttgatgaagaattaaaaggtcaaattcatacagaaatgatgaaagcaatcttgaaatttgaaatcagagtaaagtaa

SEQ ID NO: 3161 - DNA (genomic), 228 bp, Enterococcus faecium; double-stranded, circular
  misc_feature (B) LOCATION 1...228
  hypothetical: NO
  anti-sense: NO
tctgaaggaattagtggatgcagcagaaaccttgggcgccccgatgtctacgattattatccaggtgctgtttccaaacatccgtatcggtgtgaccctagtttctctgatgattttttcttcggtttttggggagtacatgctgacgaacctgttgattggcggtcgatttcagacggtacgcatctatatgctgcggcggatgaacgaaaacggccatttggctag

SEQ ID NO: 3162 - DNA (genomic), 711 bp, Enterococcus faecium; double-stranded, circular
  misc_feature (B) LOCATION 1...711
  hypothetical: NO
  anti-sense: NO
aaagaaggaattaaaaagatgaaaatcggtattatcggcgcaatggaagaagaagtaaaaattttgagagagaacctaagcgaaccattatcatgggaacgcgcaggcgctttatttatttcaggttcattaggtaaccacgaagtgatcgtcgtacgttccggtataggaaaagtcttagcatctattaccacaagtctgttgatccaacaatacggcgtgaacatggtgatcaatacaggttcagctggcggaatcggtgaaggcttacaagtaggtgacatcgttatatcagacaaagtagcttattttgatgcagatgcaacaggatttggctacaacccaggacaattaccaggaatgcctctatattatgaagcaagcacatatttgcgcagtgaaatggttaaagcagcaaaagcaacgaatttgaacgcaaaagaaggattgatcgttacaggtgatacatttgtcgactcgccagataaaatcaaagaaatcttaacgaatttccctgaagcattagcttgcgaaatggaaggagccgctgttggacaaacagctcgtcagttcaatatcccatttttgatcgtacgtgcaatgagcgacacagcagatcactcggcgacacaaagctttgacgaatttatcgaagacgcaggcaaacgatcagcagaaatggtgatcgaatttgtcaaacatctcgtataa

SEQ ID NO: 3163 - DNA (genomic), 1311 bp, Enterococcus faecium; double-stranded, circular
  misc_feature (B) LOCATION 1...1311
  hypothetical: NO
  anti-sense: NO
gaaagaggaatgcagatgaacattgtaattgtcggcgggtcgtttgcagggattcatgcggctatttatcttcgccaattgatgccaacaagtgaaatatatttgattgaaaagcaatcgaagttaggatggattcccagcgggttcaatttgatattaaaaggaaaggttaccagtgaaaaacaactttcttggatcacgaaagaagaactgactgaccgctatcgaatccatgtttacacagaaaagacagtaataggattgaaagaaaaaaaagtcgttttagcaggaggaaaaaaattggattttgatcgtttgattctagcgactggttcaaatcaaaagtttcgaaatatttctgcagaatcaacgcttattcacccagttaaaaagatacaaaacgtaacggctcttcagcaaaagatcatgaatgcaaagaaaattgcaattattggtgcaggacaagcaggaatcgaaatagctgaagggttggcatcaagaaaaaaacaaatccatctttacgaaagccgaaagtcaattctttttcgttatctagatcctgaaatgacagaaccgttagtaaaggaaatgaaaaatcaagggctttcactttttttagaagaacaagttgtgtctttgaccgaaaatgaaaccgctattgtagagacggaaaaaagaaaggagaactatgatcttgttttgctggctaatcattctcgtcccgacaatcagatgtgggaagaacaattaacattgaatgatgatggaacgatctgggtagatgactacttgcaaacgtctcaaaaagacgtttatgcgattggcgatgcgatccaagtaacttttcgtccaacaaatgaaaaaatgtatgtttctctagtaaataacgctgtccgtacagcacgaaatgtcagcaagacaattagtggctcacagacaaaggatcagggaacctatcgtccagtcggcaatcagtggtttggctatttcttaggaagcgtaggtttgacagaagaagagagcattttttatccccaaaaaattgaaacaggatacgtagactacaagcttacagcaataaatcaaagcaaagttaaactcaaatttctatttgattctgaaaaaaagattcttggagcacagctccaaagcaaaaaagagatgttccaccttcttgaccaactgacaattgcagtagaagaaggatggacgtttgaacagttagaagaacatgagctatttttccagccagaataccgtgtgccagatatggtgtggtcaaaggtggcgaatactgcctatgaagattga

SEQ ID NO: 3164 - DNA (genomic), 567 bp, Enterococcus faecium; double-stranded, circular
  misc_feature (B) LOCATION 1...567
  hypothetical: NO
  anti-sense: NO
actggaggaatcaaaatgaaaaagatcttactaggcgttactggaagtatttctgcttacaaaagcgctgatcttacaagtcaattcgtcaaattaggtgcccaggtagatgtgattatgtctaaaagcagcacacattttatcacgccattaaccttgcaatctctgtcgaagcgcgcagtccatacagacgtcatgcaagaatcaaatccgcaggtaatcaatcatatcgaactagcaaaacaagctgacttgtttctcatcgcgcctgctacagcaaacattatcggcaagctagcaaacggcattgcagacgatcttctttcaacagtcgcaatggcgcttccagtgggaacaccaaaattgattgcccctgccatgaacacgaatatgtatcaaaacccgatcactcagcgtaatctggaaacattgagatctgtcggctatcaggaaattgaaccaagagaatctcttttagcttgtggagattttggaaaaggtgccttagctgatattcagacgatcatcgaacaggtcatgctgactcttaatgaaagaaatgcttag

SEQ ID NO: 3165 - DNA (genomic), 369 bp, Enterococcus faecium; double-stranded, circular
  misc_feature (B) LOCATION 1...369
  hypothetical: NO
  anti-sense: NO
ataggaggaatatcaatggtttatgttaaaaaatcagaaacattcaaagaaatcaattttctaaaatctcaacaattcatttcattcacaaaacaagtagaccacactcacgcaggtgttgtaaatggtgtattgccagcagggtcagtttacccagcaaacgatgggaaagctgaaggcatcacaattaatgatgttgatgttagtaacggcgctcaaccagtaggcgttattattgatggacacattctaattgaacggttgccggttaagccaagcgatgcagctcaaaaagcaatgcgggaaatcaaattatatgatgcatctgggaaaatgatcgctttaccagccgctgcaagcggactgtaa

SEQ ID NO: 3166 - DNA (genomic), 486 bp, Enterococcus faecium; double-stranded, circular
  misc_feature (B) LOCATION 1...486
  hypothetical: NO
  anti-sense: NO
tcaaagggaatgaataagatggcacatcagaatacctcggatttaattgaatcatatataaagaaaattctggaaaatagtgaaatgatcgagattcgaaggattgaaatggcagacctctttaactgtgttccttcacaaatcaactatgtgattaatacccgttttaccatccaacgtggttatctagtagaaagcaaacgtggtggtggtggttatatacgaattgcaaaagtaaggatttcagataaaaaacaattacttgagcagataaatcagttatttgatgatacaatcagtgagaaaaatgcttttgctattattcaaaaactttatgaagaccaaataattacaaaaaaagaaggaaacttgatgttgagtgcaattgcaaaaaacacattgaatttcaatgaatatgaagatcatacacgtgctcggattctccgagcatttctggaacgtttaagttatgaagatgggaagtga

SEQ ID NO: 3167 - DNA (genomic), 1215 bp, Enterococcus faecium; double-stranded, circular
  misc_feature (B) LOCATION 1...1215
  hypothetical: NO
  anti-sense: NO
ctagggggaatcattataatggtagaaagacacttatttacatcagaatctgtttctgaaagacatccacgtataaaaattgctgaccaaatcagtgatgcaatcttggatgcaattttaaaacaagatccaacagcacgagtagcgtgtgaaacgtctgtaacaactggtcttgttttagtatttggagaaatatctacgacggcatatgtagatattcaaaaagtcgtacgggaaacaataaaagaaattggttatacacgtgcaaaattcggatttgatggagatacagcagctgtattggttgcgattgatgaacaatctcctgatattgctcaaggagttgatgaagcacttgagatccgggatgaagataaaaaagacgtattagatgagattggtgctggtgaccaaggtttaatgtttgggtttgctgtagatgaaacaccagaattgatgcctttaccaatcgctttgagtcatcgtctggtacgacgcttggcagatttgcgtaaatcaaatgaattaacgtatttacgtccagatgcaaaatctcaagtaacggttgaatatgatgatcaaggacaaccggaacgcgtagatacaatcgttatttcaacacagcatgatgatgcagtagataatgaaacaattcgtcatgatgtcatcgaaaaagtagtgaaggaagttattccagctgaattattagatgatcaaacgaaatattatatcaatccgactggccgatttgtcattggtggtcctcaaggggatgccggattaacaggaagaaaaatcattgttgatacgtatggcggttatgctcgtcatggtggcggtgctttttctggtaaagatgcgacaaaagttgaccgttctgccagctatgctgcacgttatattgctaaaaacattgttgcagcagggcttgctcgcaaagcagaagtacagctagcttatgcgattggtgttgctcaacctgtttcgatctcaatcaatactttcggtactggaacggttccggaagaagaactgattgctgcagtgagagaaaacttcgatcttcggccagcaggaatcatcgagatgcttgatttgcgtcgtccgatttacaaacaaacagctgcttacggtcattttggtcgtacagatgtagatttgccttgggaacatacggacaaagtacatgcgttgaaagcaagtttagcaaaataa

SEQ ID NO: 3168 - DNA (genomic), 354 bp, Enterococcus faecium; double-stranded, circular
  misc_feature (B) LOCATION 1...354
  hypothetical: NO
  anti-sense: NO
ctttgcttttttgtattttataccagcaagccagtcacaatagcacttaaaaagctgactaaagtcgctgttagcaaaattttcaatccgtgttttgcgacaagatttcctttttcttcatttaatcccttcatcgcaccagaaatgatcccgatagaagagaagttggcaaatgaaacgaggaagacagatataattgctgttgtacgctcagtaaaatggaaattaccatttgctaattctgtcatagcaacaaattcatttgtaaccagtttagtcgccatgatactaccggcatccactgcttctttccatgggattccgctgatgaaggcaagaggggcaaagatgtaa

SEQ ID NO: 3169 - DNA (genomic), 264 bp, Enterococcus faecium; double-stranded, circular
  misc_feature (B) LOCATION 1...264
  hypothetical: NO
  anti-sense: NO
acacacaccttagtgctccatgcactgcgtacaccgaaagtaccatttatccaaagcaacgcaacatttgccatgtttgttatcantacattaggaattatngtcggttctgtctttccttttacaagttttggtgctgaattaggcttgatgccacttcctggcaattactggttatggttatttgctacagtcatcgcttatctggcgcttgtgacagctgtgaagaaaatctatatccgtcgattccaagaactcttataa

SEQ ID NO: 3170 - DNA (genomic), 279 bp, Enterococcus faecium; double-stranded, circular
  misc_feature (B) LOCATION 1...279
  hypothetical: NO
  anti-sense: NO
gtttcaaccttgcggtcgtactccccaggcggagtgcttaatgcgttagctgcagcactgaagggcggaaaccctccaacacttagcactcatcgtttacggcgtggactaccagggtatctaatcctgtttgctccccacgctttcgagcctcagcgtcagttacagaccagagagccgccttcgccactggtgttcctccatatatctacgcatttcaccgctacacatggaattccactctcctcttctgcactcaagtctcccagtttccaatga

SEQ ID NO: 3171 - DNA (genomic), 279 bp, Enterococcus faecium; double-stranded, circular; identical to SEQ ID NO: 3170
  misc_feature (B) LOCATION 1...279
  hypothetical: NO
  anti-sense: NO

SEQ ID NO: 3172 - DNA (genomic), 210 bp, Enterococcus faecium; double-stranded, circular
  misc_feature (B) LOCATION 1...210
  hypothetical: NO
  anti-sense: NO
tattttttgattttaggaattgttttattgagtgtatctactttaggaattacagtagatgctgcaacttattatggaaatggtgtttattgtaatactcaaaaatgttgggtagattggagtagagctcgctctgagattgttgatagaggagtaaaagcttacgttaatggttttacaaaagtgctaggtggagtcggtggaagataa

SEQ ID NO: 3173 - DNA (genomic), 195 bp, Enterococcus faecium; double-stranded, circular
  misc_feature (B) LOCATION 1...195
  hypothetical: NO
  anti-sense: NO
tcctttttgatcattttgaaaaaaacggacccaaatcagaatcaattccttatccttatacgaaaaaaagaaaaagctaattttaaaaatcagaacctaaaaaaacgaatttttacaggaaaagaaaagagtgagacgtacggttcatcccgtttagcgtctcactctatttgtttatctattcatgcatactag

SEQ ID NO: 3174 - DNA (genomic), 1854 bp, Enterococcus faecium; double-stranded, circular
  misc_feature (B) LOCATION 1...1854
  hypothetical: NO
  anti-sense: NO
tctattttgatagatagagctaagggaagaaaaggagtggatttcatggaagtaaagcagttgccaaaacgagaagaattgcctgaaaatttaacttgggacttgaccaagatcttttcaagcgaccaagagtttgatgagaaatatttggaattatcagaagagttaaaacaatctgaaaaacacaaaggaacacttgatcaaggcgcttctcaatttttaaatgcgattgaattcgtattgagggtttatcgccaaactgaagtcatttatgtatatgcgcaccttaaaaacgatcaagacactggaaatacagattaccaagcgctttatgcaagagcaagcagtctgttttcgaaagttagtgaagccgtttcctggtttgaaccagaaatattgcaattgtcagatgaccagatttggcaatatttcaaagaagaaccaaaattggaagtctatcgccattatatccagcaaatagtagataatcgagcccatgtcttatctgctgagcaggaatctcttcttgctggagcaggtgaaatctttgatgcttcaagtgatacatttgctgttttgaataatgcagatctagtttttccaacgattgaaggagaaaatggtgaaatagtccaattatctcatggcgtgtatggtcagttgctagaaagcacggatcgaagggtgcgcgaagcagcatttaaggggttgtacagtgtttacgaacaatttagaaatacatttgcttctactttaggcacacatataaaaggacataattttaaagcgaaagtccgtaattacagctctgccagagaagcgtctttgagcaataatcatattcctgaaagtgtatacgatactttggtagacgtggtaaacaagcatttgcctttgttacatcgatacatggaattacggaaacgtttattagaagtggaaaaactgcacatgtatgatctttatacaccggtcttaggggaagctccaattacctttacgtacgaagaagcaaaagaaaaagctttagaagcactgaaaccaatgggtgaagaatacatggccatcgtagaaaaagcattctctgaacgttggatcgatgttgtcgaaaataaagggaaacgaagcggtgcttattcttcgggaagctatgacacaaatccatatattttattgaattggcatgatacgctggatcagctatttacgcttgtccacgaaatgggacatagtgttcatagttatttcactcgttcgaaccagccttatgtgtacggcgactactccatctttttagcagaaattgcttcgacaacgaatgaaaatatcctaacggagtatttattggaaacagaaaaagaccctcgtgtacgggcttatgtactcaaccattacttggatgggtttaaaggaacagttttccgccagacacaattcgctgaattcgagcatttcatgcatacggaagatgaaaaaggtgtgccattgactagtgaatacctaagtgatagttatggtaaattgaatgcaaaatattatggtccagcagtcgaagaagacccagaaattaaattcgaatggtcacggataccgcatttttattataattactatgttttccaatactcgactggcttttctgctgcttcagcactggcgaagaaaatactaaaccaggaaccagaggcactagagaactacttggcttacctaaaagcaggtaacagcgattatcctgtggaagtaatgaaaaaagcaggagttgatatgacacaggctgcatatattgaagatgcaatgtcgatgtttgaacaacgtctaaatgaattagaagaattgatcgatcgtttataa

SEQ ID NO: 3175 - DNA (genomic), 2580 bp, Enterococcus faecium; double-stranded, circular
  misc_feature (B) LOCATION 1...2580
  hypothetical: NO
  anti-sense: NO
caatgtttgattgaacgaagtattgcaggttttaaagaaattgaatatgaagtgatgagagattcggctgataatgcaatcgttgtctgcaatatggaaaattttgacccggtgggtatccatacaggtgattctatcgtatttgcccctagtcaaacattgtctgaccatgaatatcaaatgcttcgtgatgcttctctttcgattattcgagcacttaagatcgagggaggctgtaatgtccaactcgctcttgatccacatagttttaattattatgtgattgaagtcaatccgcgtgtttctcgttcatctgcgttagcaagtaaggcgactggctatccgatcgctaagctagctgctaaaatagcgcttggattaacattagacgaaatgaaaaatcctgttacaggaacgacttttgcagaatttgaacctgcattagattatgttgtagctaaaattcctcgctggccgtttgataagtttgaaaacggagaacggcttttaggcacgcagatgaaagcaactggtgaagtgatggctatcggtcggaatatcgaagagtctttattgaaagctgtgcgttctttagaaatcggtacacaccatatcgaacttcctgagttggcagacatcacggacgatgacctaatccaaaaagtggttcgagcacaagatgatcgcctgttttatgtagctgaagctattagaagagggtacaccatagaagaattagcggatttgacaaaaatcgatttattctttttagataaactgttgcatatcgtagaaatcgaacagcagttgaaacagcagccgttggatgacaagatattgaaaacagcgaaacaaaacggttttacagacaaaaaagtggcggagctgtgggaaataaacgaagaagccgttcgccagatgagaaaagaaaatgatttgattcctgtatataagatggttgacacttgtgcagcggaattcgaatcaaaaacaccttatttttatagttcctatgaatatgaaaatgaaagttcacgatcagaaaagccctcaattctagtactgggatctggtcctatccgtatcggacaaggggttgaatttgactatgcgactgtgcattctgtcaaagcaatccagcaggcaggatacgaagcaatcatcatgaacagcaatcctgaaacagtttcgactgacttttctatttcggataaattatattttgagccattgaccttcgaagatgtgatgaatgtgatcgagctagaacagccgataggagtaatcgttcaatttggtggtcagacagcaatcaacttagccgaacctttgactgctgctggtgtaaaaatcttagggacaacgatcgaagacttggatcgtgcggaaaatcgtgatttattcgagcaagcgctgaaagagttggatattcctcaacctttaggggatactgctacaagtaaagaagaagccgtggttatcgcttcgagaattggttatccagttcttgttcgtccaagctatgtattaggcggacgtgcgatggaaatcgttgaaaaccagcgagatttagaagattacatggaacatgctgtgaaagcatctccagaacatccagtactagtggaccgttacttgcttggtggtgaatgcgaagtggatgcgatttgtgacggtgaaacagtactcatcccagggatcatggagcatattgagcgtgctggtgtccattcaggggattcaatggctgtgtatccacctcaaacattatctgaatcgatcaagaaaacgatcgaagattacacgatccgcttagcattaggtttgaattgtgtcgggatgatgaatatccagtttgtcatccatgaaaatgaggtttatgtgatcgaagtcaatcctcgagcaagtcggactgttccattcttaagtaaggtgacaggaattccaatggcacaaattgcgacgaaagctattttgggagagaaactaaagacacttggttatgaaaacggactttatccagaaacaaaagaagttcatgttaaagcacctgtcttttcttttacgaaattgcagaaagttgatacttacttagggcctgaaatgaaatcgactggagaagtaatgggatctgacagacaattagacaaagctttgtacaaggcattcgaagcttctggattacacttgcctgaatatggagccgtattatttacgattgcggacgaaacaaaagaagaagcactagaattagctaaacgttttacagaaattggctatagtctgataggaacgaaacatacagctgcttatttcgaaaaaaatggtctggtcgttgaaacagtagcgaaaatttctgaggaagcagcagaaaaaaatgtagtcgacttaataagagatggtaaaacacaagtggttgtcaatacgattgataaagatcggggaaatgcttctaaagacggtttcatcatccgaagagaagcagttgaacatggtattccattgtttacttctttagacacagcagatgcgatcgttcgagtgatggaatcccgtgctttttcaactaaccctatttaa

SEQ ID NO: 3176 - DNA (genomic), 1893 bp, Enterococcus faecium; double-stranded, circular
  misc_feature (B) LOCATION 1...1893
  hypothetical: NO
  anti-sense: NO
tctttattgattttaggtatccaactgtttcgtatttatcttggagaaggtacaggagatatgactgcagatatcgtcagcgcagtgatgtttgccgtagccgtagccgtagctgctattccagaagcattacagtgtatcgtaacaatcgtgttatctttgggaacgaataaaatggcaaaacgtcatgccattattcggaaggttccagcagttgaaacacttggttcgacaagtatcatctgtacagataagagtggtacattgacacaaaacaaaatgacagttgttgactactttttaggtaatggcgatactggggatttcacaaatgacccttcaaaatggacagctgacgaacgtcgcttgatcgaaatcagtgttttagcgaatgatgcatcgatcagtgaagacggtactaaattgggcgaccctacggaagtagcgtttatcgactttagtgaaaaattaaaccagccttatcaggaaatccgaaacaactacccaagacaagcagaacttccttttgactcagatcgaaaattaatgtctactggacacacaattgataacaaaaattacttgtttgttaaaggcggaccagatatcgtcttccaacgcagtaaaaaagtattgctaaatggtgaagtcgttccgatgacggatgaattgatgaaaaaattccaagagcaaaatgaagctttttcaacacgcgcattacgtgtactagcttttgcttaccgtccacttgataattttgatttatcatttgaagatgaagacgatttgatccttgttggtttgcttgctatgatcgatcctccacgtgctgaagtgactcaggcggtaacagaagcaagaagtgcaggaatcaaaacaatcatgattactggtgaccacaaaacaacagctgttgctatcgcaaaacaaatcgggatttttgaagaaggaaacctggctttgaccgggacggaactagatgaattgacagaagatcaactaaacgaagttttagaaaaagtcactgtttatgcacgtgtttcacctgagaataaaattcgtatcgttcgtgcttggcaaaataaaggtcatatctcagctatgacaggtgatggtgtaaatgacgcaccagcattgaaacaagcagacatcggaattgctatgggaacgggtacagatgtggcaaaagatgcagcagcgatggtattgacggatgataactttgcttctattgtcagcgcagtagaagtaggacgtaatgtgtttgataatatcaagaaagctatttcttatctatttgcaggaaatttaggtgcgatcattgcgatcatctttgccttagttgctgactggtccaatccatttacagcattacaactgttgttcatcaatttagtcaatgattcactgccagcaattgcattaggtacagaaaaagctgaacctgctacgatgaaccgcccgccaagagatccaaattcaggaatctttacggacaaaacattgatttctgtaacgtatcgtggtgtgctgattgggattgctgttatctttgctcaatggcttggcatgcagcattcacctgaattcggtgtagccatgtcattttcaacattgatttggtgtcggacattgcaaacattcccagcacgttcaaacacacaaacagctatccaagcagggttcttctctaacagaagtgtcttactagctgtagttgtatgtagcgcgctttactgcttaacaatgatcccaggactgaaagaagtcttctctatcccatcagcatttggattgacagaagtctttacatgtatgggaatcgcacttgtgacaattgttttgatggaaatcactaaattgatcattgtacgagtacaaggaaataaataa

SEQ ID NO: 3177 - DNA (genomic), 354 bp, Enterococcus faecium; double-stranded, circular
  misc_feature (B) LOCATION 1...354
  hypothetical: NO
  anti-sense: NO
aagcaattgatgaaagatactggccatttgctgtgccagtcgagaaagtgtaggttcaatcggatgatcaaaaaaataaaaactttgatcgatggttttctgctagaaagaaaactcgttaaggttagagaattaataaagattcatatagatagcggtgaacgttcaatgtattgggtcgccactgatagcgaaaagcagaatgttatgaacatgatcagattttttgagattgcattcgaagatggatattttgcgactggtgagtattttgatgcttcttcatggatgtcttcgaatccagaagaagtgtggcaaatttatttggaaatgaaagaggtggcggaaggatga

SEQ ID NO: 3178 - DNA (genomic), 1008 bp, Enterococcus faecium; double-stranded, circular
  misc_feature (B) LOCATION 1...1008
  hypothetical: NO
  anti-sense: NO
aaaaaattgattcagattggaagagataccttgctgaataaaaaacatagtataataagtgatatttcactaaatattttctcgattactattactacaggaattatgcaacttgtagtatatcctatgatttcttcatttgtacctattggcgaatttggctatatcttgacgttaatgggtctagttaacgttatttctgtagtagtaggggggagtttgaataacgtccaattaattaatagaacatactatctaaatgaagaagattattatggagatttcaaacgtctatttattcttagcttatttattagtatggctgtatctcttctaattttaggtactaatgtttttaatatattattaatcaataaattacttcttttattagtaattttatttacaacgttaagagcctatctaacagtatattggcgcatagaacttaattatcgatttattctttatcatagtattactacctcaattggttatttggttggaacttatcttgttaaaatttcaattccttctttatggccattggcttttttgagtggagagattttttcagccatttatttattttttaaaacagactttttccaaagaaaactgtctaaaagtaataattttataaaaataaaaagagattacgtaaaccttctatcttctaatattgtttctaatattcttatctattttgatcgattcattttgcaaggaactttgggcgctaaagaagtgagtatttattttgctgcttcagtttttggaaaactttctagtatgatattacagcccatttctggagtatttttaagctatctttctagagaagataaagatagtaaaaaaaagtattttgtgctttttttatccattaccgttatatctggtgttattttatttgttatttctattatattctccccgattttagttagagttttgtatagtgaactttttgaagatgctatgccttttatgataaagtccgtataa

SEQ ID NO: 3179 - DNA (genomic), 183 bp, Enterococcus faecium; double-stranded, circular
  misc_feature (B) LOCATION 1...183
  hypothetical: NO
  anti-sense: NO
cgaggattgatagctgctacgtgcatagctacgtctcttgcaactgtttcgtcagttgttccatctagaacagtcaatacggcaatacgtccgcccatatgcaagtatccaccaaatgcagcattgtcgtctttttctacaacttcaaagcgacggaagctgattttttctccgataacttga

SEQ ID NO: 3180 - DNA (genomic), 387 bp, Enterococcus faecium; double-stranded, circular
  misc_feature (B) LOCATION 1...387
  hypothetical: NO
  anti-sense: NO
aacaagttgatcgaggtggaaattttggcaagcaaaagagttgctggtacaattatgttgcatttggaggatggtactaaaaaatttttggtccattcaattgatgacaagttggaatttgcgttagcggaactttctgaaggaaagactggtttagcgaatatacttaatttcttaaaagaaatagttcatatcgatgttagcaagattagtttgatggaattgacaaatacacatattaaagaggaaaatgttccgttgtttgtctttgaaactgaacaaaagaatcaaagagaagaattaggcgaaggatatatttgggaagaaccaggtcaaatgcgctctgttcttggaacttacgaagtagagggagtgcctttcttctaa

SEQ ID NO: 3181 - DNA (genomic), 1746 bp, Enterococcus faecium; double-stranded, circular
  misc_feature (B) LOCATION 1...1746
  hypothetical: NO
  anti-sense: NO
agacgactgatacacatgtcaaaaatcaatgcaggaatcgcaatggtaaaagttcttgaaagctggggtatcgaccatatttacggcattcccggaggatctttcaattcaattatggatgcgctatatcaagaaaaaaccgaaatcaactacattcaagttcgtcatgaagaagtcggcgcactcgcagccgctgcagatgcaaaattaacggggaaagtcggcgctgtcttcggctctgcaggacctggtgcgacacatttgatcaatggtttgtatgatgcacagatggaccatgtgcctctagtagcgttcttaggacaagttgcttctacatccatgaactataactctttccaggaactaaatgaaaatcctattttcgcagatgttagcgtatacaatcgtacagtcatgacaccacaaagtcttccgcatgtagtagatgaagccattaaagccgcctatgagcataaaggcgtggctatcgtgactatccctgttgatcttggttttgaagaaattgacgaacaacctttctccaccgctcacactcacaaaacaagtgtgatattaccagaagaaaaagatttgctagctgctttgccttatcttgaaaaagcaaaaaaaccagttctttatgttggtcaaggaacgcgaaacggatttccgcaaatcaaagaattctcagaacatttttcagttcctgttgtcgcttccgttctagcaaaaggaattattcctgatgattatgaaaactttcttggttttgctggacgtgtcgctactaaacccggaaatgaagcattggcagaagccgatctgatcttatttgtcggtagcgacttcccatttggacgtgcattttttaatccaactgctgaatttatccaaatcgatatcgatgcgtcaaaatttggacgacgccatgaaacatctttgtcgatcctcggtgatgcaaacacagctttgcaaagacttgtcgagttaggggatgctcgccctgctgatagctggtacctagcaaatcaagaaaataaagaaaaatgggtaaattggttgaaatcttttgaagatcgagaggaagaaccgattcgtccagaggctgtctataaagaaatcaatcgtattgctgaagacgatgcgattttcgtcacagatgtcggtaacacgactatccattctattcgtttattgaatatgaacggtaaacaaaaacatacgacatctggatggttcgcaactatgggtaatggtgtgccaggaggaattgccgcacaactaagctacccagaaaaacaagtatttaccttaagtggtgatggcgggtttgctatggtcatgcaagatatcattacacaagtcaaatatcagcttccaattattaatgttgtcttttcgaatgattcttttggtttcatcgaagcagaacaagaagatacggaacaaaagaaatttggtgtatttttagaagatgcagatttcggtaaagttggagaagcgctcggggcaaatagctttacagtcacagaatactcgcaacttcgatttgcctttgatgcagctgcaaaatcagatcgtcctgtagtaatcgatgtgaagatcaataacaagcgcccattgccagtagaagatctgcatttagatccaagaaaatattctgaagaagaaatccaagcattcaaagaaaaatatgaagtccatgatttgccagtattgaatgaattatatgaaaagaggttgtga

SEQ ID NO: 3182 - DNA (genomic), 1299 bp, Enterococcus faecium; double-stranded, circular
  misc_feature (B) LOCATION 1...1299
  hypothetical: NO
  anti-sense: NO
gaaaagctgatgaaatgggtcgaagagaaacttgtcccaccaatggcaaaaattggtacacagcgtcatttattagcaattcgtaatggggttgtttcaacattgtcattgattttgattgggacattttttatggtctttatcaatttaccgtttcctggatggaatgaatttattgccccttattcggcaacgattgttttaccctttaggatgacgatgggattgatggctatttatgcaacttttgttatgggttcggatctagctaaatcatatggattagatagtgtgacaggtggtatattatctttaggaacgttctttatgttacaagttcctgtaaacgttttaactcctgaagaggcacctcttggctgggtcttacctatgagttctttgggagcatctgggatgtttgcggggatcttatctatgatttttgcagtggaagtatatcgtttctttaaaaatcgaaatattactatcaaaatgccagaacaagtgccacctgctgttgcccgtagttttgaggcattgattccaggtgcagtcattttaacaattacttggctgattcgaagcgtcgcgggctttgatgtaaacgctgccttattatcgttattcgagcctttaaccaatattttagggaataatttgcttggtgttttactaccaatgtttttgatccatttgttgtggtcatttggtatccatggcatgagtattgtaggggctgttgttcgtccaatgtggctgatcatgttggatgagaatgcaaaggcattggcagatggtacagctgccacccaattaccctatatcgctcctgaacagttttatcaatggacggtaacaattggtggtgcaggagcaacgatcgtggtatctgttttgtttatattcttctgtaaatcaaaattcttgaaagaggttggtcgtttttctattattcctggtatcttcaatatcaatgagcccataatttttggagctcctatgatgttgaatccttacatgttcatcccgttcaacttagttcctttagttttgactattatcagttattttgcagtcaaattagaaatggtcaatagatttactgttttgccaacatggacattaccagctccaatcggcggttatctttcagcaggaaatgactggcgtgttgttatcttgatcatgatcaacacattgatagcatttattatctattatccatttgtaaaagcttatgataaaaagatgctgtcagatgaacaaagtcgtggagaaaacgaagtccagactgtctaa

SEQ ID NO: 3183 - DNA (genomic), 321 bp, Enterococcus faecium; double-stranded, circular
  misc_feature (B) LOCATION 1...321
  hypothetical: NO
  anti-sense: NO
ataattatgatgcgtggaatgggcaatatgcaaggcatgatgaaacaagtacaaaaaatgcaaaaagaaatggcagaagcacaagagctgctaaataaaacagagtttacaggtaaagccaccaatgaattggtcaaagcggtttttacaggcgatcgtcgcatgaaagatatccaaatcaatgaagaagtcgttgatcctgatgatatcgagatgcttcaggatcttgtcgtaatggcagtcaatgatgcgatcgcacaaattgatgtggaaactgagaaaaaattagggaaatacgcaaaaggtttgccaggattttag

SEQ ID NO: 3184 - DNA (genomic), 627 bp, Enterococcus faecium; double-stranded, circular
  misc_feature (B) LOCATION 1...627
  hypothetical: NO
  anti-sense: NO
ttaaatatgatttttcctaaagttaatgaagcaagcttgaataaaggatccttttttcatatctatgaaaacgaagattttgaactgtataatatcctttcacaaaaagaggtcatcgaaaaccaaataatctgccatccaattatttacaaatctattttcaagtatgcattttttgcttccaatgattttcaaagaatggagattaccgactgtatattcgaaaactgtgatttttcaggctgtatattgacaaaaagcatgttgcatcgcgtgaaatttgtcaattgtaaattaacaggtactaaattgatggaaagttatattgggaacacgttattcgagaattgtaaaatggactatgtaaatttatctggttcaaacataaaagaaagtacctttgagcactctgtcttatcaagcgcagattttgtagactgttccctcactaaaataatgttttctactaatgatttagaaaatgctagcttttttgatactgatttaaaaaatatcgatttaagtagcaactcctttgaaatgattgaagtacgctcggaacatctaaaaaattgtacgcttaatcagttgcaagcacttggttttgctagaaaatttttacaataa

SEQ ID NO: 3185 - DNA (genomic), 372 bp, Enterococcus faecium; double-stranded, circular
  misc_feature (B) LOCATION 1...372
  hypothetical: NO
  anti-sense: NO
caaaatatgataaaaacgtgttggaagaatcttccattgcttttatcttttgttccttatgtgcatttcgctttactgcttgatttctattatcattccgtaagcggattcatcacgttgatatttttatctctttttgctgggtattatttccaaaaaagcaggcgtattttatctttatttatcgccaacattatatctactgtcacttcctatttattttgcgtcaattttgctgaatggcggtacttttatcatcctttaaaaccgacccaactgattttgattctagctggcatttacttagttccacaaatccttggatcgttatgggcggtagccttatcttataaaaaagcacggcatccctaa

SEQ ID NO: 3186 - DNA (genomic), 1650 bp, Enterococcus faecium; double-stranded, circular
  misc_feature (B) LOCATION 1...1650
  hypothetical: NO
  anti-sense: NO
aacgatatgatacaagaacaaaaatggtggaaagaagcagtaggctatcaaatctatcctgctagtttcaaagatagcaatggcgatggtcaaggagacatcaatgggatccgtgaaaaacttaattatttgaaagatcttggtatcggctttatctggatcaatccgatctatcaatctccatttgtcgataatggttatgacgtaagtgactatcaagatatagaagagagattcggaacgatggaagattttgatttattgctaaaagaagcacatgaattagggatcaaagtgattatggatcttgtcatcaaccatagttcggatcagcatcaatggtttgaagaatcgaaaaaatctaaagaaagcccgtatcgcgattattacatttgggtcgacggggtagatggcaaagaaccgaataattggacatcgattttcggcggttctgcttgggagtattctcatgaaactggacagtattatctgcatgtttttgcaaaagaacaaccagacttaaattgggaaagcgagaaattgaaagaagaactattcaatatgatccgatggtggttggataaagggatagatggatttcgtttagatgcgatttctcatgtaaaaaaagatgaatattcagtaaaagccacagagaaccctttctcaccctttcaaaatgtctcaggaatcgaagaacatttgaccgatttgaaacatgtttttgaagagtacgatatcatgactgtcggagaagcaagtggtgtcactgcagaagaaggaccacaatgggtagggaaagacggttatttcgatatgatattcgaatttgatcatatccatatctggcagcaagaaaaagaagggcaattagatgtccttaaattgaaacatgcattaagcgcttggcaaacttcattggatggtatcggatggaacgctttatatatggaaaaccatgatgttcctcgtgccgtttcagtgtttggagatactcgtcccgatttttgggctatgtctgcaaaagcaatcgctatgatgtatttctttttgcaaggtacgccatttatttatcaaggacaggaaatcggaatgacgaatatgccctttgaatcgatcgatcaagttgatgcagtagattcgaaaagactttataaaaggctgcttgcggaaggtaagacaagagaagaagcattggatatcattcgtgaaacaacgagagacaacagcaggacacccatgcaatggacttcggaacaatatgctggtttttctacacatgaaccttggctgatcactaatccaaataccaaaacgatcaatgtagaacaacaagaatatgaaccagagtcggtcctgcaattctataagaacatgatccgcattagacaaaccaataaaggtctgatatacggttcttataaagaatatcttcatgaacatccacaactttatgtctatgaaagatatttagaagatgaacaatatcttattatggtaaacttaacagaatcacttgctgactatgaacttccaaaagaagcagatcagtcctggacattactcttgtcaaattcctctagcggagaatttgaagctaaaggcatactagcaccttatgaagctcggttatataaaacaaacaagtaa

SEQ ID NO: 3187 - DNA (genomic), 1290 bp, Enterococcus faecium; double-stranded, circular
  misc_feature (B) LOCATION 1...1290
  hypothetical: NO
  anti-sense: NO
ggtcgtatgatgactcgccgaggaaaagggaaagctggatttgcgcatctacaagatcgtgaaggccaaattcaaatttatgtaagaaaagaccaagtaggtgatgaggcctatgaagtattcaaacatgcagaccttggagatttctttggtgtaactggacaaatcatgaaaacagacacaggcgaagtttttatcaaagcttcagaaatcacgattttgtcaaaagcacttcgtccactgccagataaataccatggcttaacgaatattgaacaacgctacagacaacgctacttggatttaatcagtaatcgcgaaagctttgaccgatttatgaaacgaagccaaattatcagcgaaatccgtcgctatttagatggcaatggctatattgaagtagaaacaccagtattgcacaatgaggcacgtggagctgccgcacgcccatttatcacgcatcataatgcactggacattgatttatatttgcgtattgcgctagaacttcatttaaaacgactaattgttggcggaatggaaaaagtttatgaaatcggccgcgttttccgtaatgaaggaattgatactacacataatccagaatttacgatgttagaagcatacacagcatatactgatttcaatgatgtaatgaatctgacagaaggtattatccgtaacgcagctgaaaaagtactaggaacagcaaaaatcacatatgatggacaagctgtcgacttagaaagtgactttaaacgcatccatatggtagatgcaatcaaagaacaaactggtgtagacttctggcaagaaatgacattggaagaagcattagctttagccgaaaaacacaatgtagaagtaaccgaagctatgggtgtcggacatgttatcaatgaattctttgaaacatttgttgaagaaacattgacacaaccgacgtttgtatacggacatccagtcgaagtttcgcctttagcgaagaaaaatccagaagatcctcgattcacagatcgattcgaactattcatagtggggcgcgaatttgctaatgcctttacagaactgaacgatccaattgatcaaagagaaagattcgaagcgcaagaaaaagaacgtgaactaggaaatgacgaagctcacggtgtagacgaagacttcttggaagccttagaatacggtatgccgccaactggtggtctaggcatcgggatcgacagattagtaatgttgctaactgatgcacaatcaattcgggatgttttgctattcccaacaatgagataa

SEQ ID NO: 3188 - DNA (genomic), 213 bp, Enterococcus faecium; double-stranded, circular
  misc_feature (B) LOCATION 1...213
  hypothetical: NO
  anti-sense: NO
tgtctcatgattaggataaaaggaggcggtacaatggcaaaaaaatcaaaagtacaatttgtttgccaaaattgcgggtatgtgtcgcctaagttcttgggacgctgcccaaattgcggaaaatggaatacgatggtcgaagatatcgaccaagatacaaccgaccgcagaactcggacaagtttgacagcgagaacaaacctaacccactaa

SEQ ID NO: 3189 - DNA (genomic), 219 bp, Enterococcus faecium; double-stranded, circular
  misc_feature (B) LOCATION 1...219
  hypothetical: NO
  anti-sense: NO
ctgctcatgattaatctaggcgctattctaacttgtctaacctctaaattccctcttgtttactctgtgtatattatttacacaaattcatttcaccactatccaaacaagcgcatttactcgattgaccaattttttacgttaccaatcgtaaaaatctaccccgtcactccccgaaggaaattgttgatagatcaagtctactccttatttttctaa

SEQ ID NO: 3190 - DNA (genomic), 243 bp, Enterococcus faecium; double-stranded, circular
  misc_feature (B) LOCATION 1...243
  hypothetical: NO
  anti-sense: NO
gtaaccatgatcgttgctttatttttgtcttttgattcttttgccaagatatcgactacttctcgtgccttttctgaatccaaactagcagttggttcatctgctagaataatggacggatcattgtacaatgcacgagcgattgcgaccctttgccgttctccaccagatagttcttctggatacttgttgatcaacttatccacgccaagctgctcaaataattcttttgcttctttttga

SEQ ID NO: 3191 - DNA (genomic), 1017 bp, Enterococcus faecium; double-stranded, circular
  misc_feature (B) LOCATION 1...1017
  hypothetical: NO
  anti-sense: NO
agcaacatgataagttatccattattagaaagaaatgcaacgattggggttactgcaccatcctcaggcgtatcagaggaacaccattcgttactcgaatcagctttaaagagaatggaagaaaaatctttccaagtagttactggaaagacgctttggacgcaagataaggaaaaatcaggtccagcaagaaaacgagcagatgaattcaatcaaatgatgcaagatgaaaatatccaaatgatctttccgacttggggaggagaattattgattgagattctcgattttgtcgattttgatgctctacaaccaaaatggatagtaggttattcagatattagtacgttgctacttgctgtcacattaaaaacagggatagccactgcacatggaactaaccttattgatttaagaggagagtacttggatgaaacgacagcaatgtgggaaagtgtactgaaaacaagagaaggagaatcgattctacagcaatcttctgaaaagtatcaaaaagtgtggccccatgagcattcatcatcttctgttttccatctcactgaaccaacaaattggcaatcagtcagcggagatgcagtaaggatgaagggacgattattaggtggttgtattgatacgatcaggcatttaatcggtactccttatggagatgtccaatcttttaaaagaaagtataatgatggaaagccgatcttgtggtttctagaaaactgtgagctatcgtcagttgatttaagaagatcacttgttcagatgaaactggcaggctggtttgatggcagctcggggatcatgttcggtagaagtgcggcagaggatttgttagattataaaatgaaggatgtatacgaagatctgtcaaaggaattaaaactaccgatcttgtatgatattgattgtggtcatgtaccgccacaactgacattgattaatggtgcctatgcagaagtagcggtagaagatagaaaagcgactgttttgcaaacgtttatttaa

SEQ ID NO: 3192 - DNA (genomic), 843 bp, Enterococcus faecium; double-stranded, circular
  misc_feature (B) LOCATION 1...843
  hypothetical: NO
  anti-sense: NO
tcgtgcatgatattcgtcaaggaaaacttggacgatacacactggatcgttgcgaagaaatggagcaaaaaagtgatgactgaatccatccaaagtatcaaagaacgattgaaaagcatacagagaatagatgatcctacactagaatcattaagaaatgatccacgcaaaggcgtgcagcaagcactggcttcttttgaacgacgattgaaaaaggaagcattaattaaggaaaaatatgaagaaatgttttgctttgaaaagcaagggtacgcacaaggtcaccaatggattgccggcattgatgaagtaggaagaggaccattagctggacctgtcgtggcagctgcagttatcttgccgaaaaatgagatcatattagggctgaatgactccaaacaattatcagagaaaaagcgagaacttctttatcaacaagttcaagaaaaagccctggcaatcgggatcgggatcgttgatcagcagacaatcgatgatgtgaatatttatgaagcaagtaaattagcgatgatccaagcagtagaaaaattgtccattgtaccaagctatttgttgatcgatgcgatgaccttggatttgcctattcagcaggaaaaaataatcaaaggggatgcacgatctgtgtcgattgctgctgcaagtatcattgctaaagtatatcgagaccaattgatgaaagaatatgacgtgctttatcctggatatggtttctcgcataatgcaggttatggaacaaaggaacacttagaaggacttgaacgacaaggaattacgccaatccatcgtaaaagttttgcacctgtaaaaaaatatttacaataa

SEQ ID NO: 3193 - DNA (genomic), 1272 bp, Enterococcus faecium; double-stranded, circular
  misc_feature (B) LOCATION 1...1272
  hypothetical: NO
  anti-sense: NO
gagataatgatgaacagtattgaaaatgaagaatttatccctatattattaggaagcgacatgaacgtttatggtatggcacgttcttttaatgaagcatacggcaaaatctgccaagcatatgcttcggatcagttagcccctacccgctacagtaaaattgtcaatgtagaagttattccaggatttgataaagaccctgtatttatcgagacgatgcttcgtttggcaaaagaaagatattctgataagagtaaaaaatatcttttgattgcttgtggtgatggatatgcagaattgatctcccaacataaacaagagctgtcagaatattttatctgtccatatattgattattctttatttgaaaggctgatcaataaagtaagcttttatgaagtttgtgaagaatatgatcttccgtatcctaaaacattgatcgtcagagaagaaatgttagtaaatggacatttggaacaggaattgccttttgaattcccagttgctttgaaacctgcaaacagtgtggagtatctttctgtccaatttgaaggaagaaaaaaagcttttattttagagactagagaagagttcgatttaattttaggccggatatacgaagccggttataaaagtgaaatgattgtacaagattttatcccgggtgatgatagtaatatgcgtgtgctaaatgcgtatgtagatgaagatcatcaagttcggatgatgtgccttggtcatccactattagaagatcctacaccagcatcgattggtaattacgttgtgatcatgccagattataacgaaaaaatctatcaaaccattaaggcatttttggaaaaaatcgaatatacaggctttgccaatttcgatatgaagtatgatcctagagatggagaatataaattatttgaaatcaatttgagacaaggtcgtagcagtttctttgtgacattgaacggcttgaatctggctcgttttgtcacagaagatcgagtgttcaacaaaccctttgttgaaacgacctatggaacgaatcaatcagataaagcaagattatggatgggtgtgcccaaaaaaatctttttagaatatgctcgggaaaatgaagacaaaaaactagctgagcaaatgatcaaagaaaatcgttacggtactactgtattttatgaaaaagaccgatcaatcaagcgctggttgttgatgaaatatatgttccataactatattccaagattcaaaaagtattttcatgtgaaagaaggctag

SEQ ID NO: 3194 - DNA (genomic), 245 bp, Enterococcus faecium; double-stranded, circular
  misc_feature (B) LOCATION 1...245
  hypothetical: NO
  anti-sense: NO
tcccaatgatttatgaagatggacaggatccattgcctcgtgtactaggagacatcatgatttctattgaacgtgctgctgaacaagcagaagcttacggccattcatatgatcgggaacttggctttttagcggtacatggattcttgcatatcaacgggtatgaccatatgacaccagaagatgagaaagaaatgtttggtttacagaaagagatcttggatgcctatggactcaaaagataa

SEQ ID NO: 3195 - DNA (genomic), 201 bp, Enterococcus faecium; double-stranded, circular
  misc_feature (B) LOCATION 1...201
  hypothetical: NO
  anti-sense: NO
gctgcaatgatagttgttttctcttttcttatttcttttaaattatgcaagatagcttcttctgttttggcatctactgcagagagtgcatcatctaatattaataattcaggatttttgatcaatgctcgagcaatcgaaatcctttgtttctgtccgccagataaagagactccacgttctccaactaaggtatcataa

SEQ ID NO: 3196 - DNA (genomic), 861 bp, Enterococcus faecium; double-stranded, circular
  misc_feature (B) LOCATION 1...861
  hypothetical: NO
  anti-sense: NO
cggcaaatgatggattatttcaaaaagaccagtgtgaatcggcaaacaaaaaaaatactaagttatgtcctcatgacagtaataggaatcattttgatcattccattgctttggatggtgtttacttcattgaaaccaatggaagaaatcgttcgttatcctccgacctttttcccagaaaaaatcgtatgggaaaactatctggatacgattgccgcctttcctttttggcgctatgcaagaaatacattattcatcactgtgctagtagtgatcggtaatgtcctttcaaattcttttattgcttatggatttgcgaagcttgattttcctgggaaaaagctgatgtttgctttggttctttctacgatgatgatcccggggtttgtaacgatgatccctcaatatgtattattctccaagatcggctgggtaggtacttatttgcccctgatcgttccatcgttcttcggcaatgcgttcaatatatttctgatgcgtcaattttacttatcgatcaataatgaattgatcgaagctgctgaaatcgacggagcgaatcatttgtatatttggagtcatttgatgcttccattgacgaaacctgccttgattaccattgcgatcaattccttcaacgcagcttggaatgatttcttaggtcctctgttatatatccaagatcaagaaaaatacacgttacagattggcttgcaagtttttcagaaccaagcaacgacacaatggaattatctgatggcaggagcaacacttgtcttgatcccgacgattttgctgttcttttttgcacaacgttatttcattgaagggatggatttgacaggaggttcaaaaggatga

SEQ ID NO: 3197 - DNA (genomic), 231 bp, Enterococcus faecium; double-stranded, circular
  misc_feature (B) LOCATION 1...231
  hypothetical: NO
  anti-sense: NO
caaaaaatgatggaggttgtgacagaagtggtcagctccaagatatttcggatcattttccgtaaaagttacttctggaacactgtttaccaagaggtcgtgagcctgccgttcagctccgagtcacaaggaacaatttcaaaaaatagcttctcgtgtttgatgaatattgtaacttgtgattcggaattggcaggagaacaccgtttattcggaagaataggactgtga

SEQ ID NO: 3198 - DNA (genomic), 453 bp, Enterococcus faecium; double-stranded, circular
  misc_feature (B) LOCATION 1...453
  hypothetical: NO
  anti-sense: NO
gaggaaatgattcgtatggcgcacgaaaaaacacgctacaaagcagtgattgccaaccaaacatatactattatcggacgggaaaccaagcatcatatggatatcgtaacgaagctgatcaatgaacagttagcagaattgaaacaattatcaccacaaatggataatgaacaagcagcaatcttgatggctgtcaatgcgctttcggatcaattgaagaaacaagaaagaatcttggagctggaagaagaaacagcagaattaaagaaaaaaatgatcaaatttacagagcttgaaaatcgtgtgaaacgcattgaagcaatcgagaacgaagctcgggaagtattgaaagaaaatggtcaagcagatcataccattaaaaatcatgtggaagcacaacagattttaaacgagaaacgaaaaggacaaattaaacaaaaatcttctaattaa

SEQ ID NO: 3199 - DNA (genomic), 285 bp, Enterococcus faecium; double-stranded, circular
  misc_feature (B) LOCATION 1...285
  hypothetical: NO
  anti-sense: NO
ttcagaatgatcagcttgatatccggcttcacgtattgttggcagatgccccgcagtttcttggaaacgtcccggccggaaatgctggagatgatgatgtttttctccacggagaagccttcaaaatattggacgttggtgacgaagttttcttccgctgccttggcgatggtgtggaaacggctgccgttcaacagctgttggccgatctccaaagcgaaggaggtggtgaggttgttgattaccaaaagttctcccataatctggggcttcaagctcttgtaa

SEQ ID NO: 3200 - DNA (genomic), 585 bp, Enterococcus faecium; double-stranded, circular
  misc_feature (B) LOCATION 1...585
  hypothetical: NO
  anti-sense: NO
ttgagaatgattttcattcttattttaagtgaatcgttgaacaaaagcaaccgctttttcatatgttttaggtattattgggaatatgctataatcgtaagaaagacaaagagaagaaggagggtattttttatggcacaagatgatgtaaaaagccatttggataagggactttatggtacacctttagtgaaccctgaagaacagcataaatatttagggacattcagggaacgctgctatcttagtatgactgttgctgaaatgatccaaccaaaaaacaaagaaaactttttaaaagaactcaaaaaacatccagatgcttccatactcttgaatggggctctacccctttctgtccaaaaccaatatatccagctagcaacgaaaaacaatagccgtttcactgtagtcaacgattacgtcactgcaaatcctgaggaattcggattgctcttaacagcaaaagaagcagtaaatgaacctgtgattgatatcgaaaaaaaatacccagaagaaaactcttcgccagctgaaaaagaaaaaccaaaaaagaaaaaaagcttctgggatcgtttattttaa

SEQ ID NO: 3201 - DNA (genomic), 189 bp, Enterococcus faecium; double-stranded, circular
  misc_feature (B) LOCATION 1...189
  hypothetical: NO
  anti-sense: NO
ggaatgatgatttgcggcacgatcgaaagtaatcctattaaaaaagaagcgcatgcaaataacgtaaacgaaggcgcaaaaaaagcggccaacagagagacggcagataacgctaccattcgaatgatcaattttggacgatccaccacgtcccctaaaggaactaaaaacagtaaccctaacgcatag

SEQ ID NO: 3202 - DNA (genomic), 729 bp, Enterococcus faecium; double-stranded, circular
  misc_feature (B) LOCATION 1...729
  hypothetical: NO
  anti-sense: NO
gtagtgatgatgatggctaaaaaactatctgaatttcttccgccgaagtttcattcagtatggagagcaactttaaatcaagatattcttaatatagtttgtaaaggtgggcgtggttcaggaaaatcatcggatatagcgcatatcgttactcagttacttatgagatatgcagtgaatgctgtaggtatacgttatgttgataatacacttgagcaatcattgtatgaacagatgaaatgggcgattgaacagcaaggtgtttcccacctattcaagtttaataagtcaccacttaaaattacttatcttccaagagggaattatatgatatttcgtggtgctcaaaacccagaacgaatcaagtctttaaaagatagcaagtttccatttgctataggttggattgaagaattagcagaatttaaaacagaagatgaagtcacgactatcacgaactcccttttacgtggagagttggacgatggtcttttttataaattcttttacagttataatccgccaaaacggaaacaatcatgggtaaacaaaaaatatgaaacatcctttcagcctaagaatacattcattcatcattcaacttataaagataacccttttatttctaaggagtttctgagcgaagtcgaagcagccagagcaaggaaccctagacgagctgagtgggagtatgatggtaaagctattggatgtggtgttgtaccgttt

SEQ ID NO: 3203 - DNA (genomic), 219 bp, Enterococcus faecium; double-stranded, circular
  misc_feature (B) LOCATION 1...219
  hypothetical: NO
  anti-sense: NO
ctgccgatgatccgtttaggtgcgtttggaatgtcgactttatgtccaagcgtatctgtgactgtatgcgtgctggtggatgaagtcgtcgaattggtagttgtagctgtttcttcatctgaagagggggagcaagcgctcaatactccagccagcagccacatgctagataaggtgaatacttttgtttttaagttcatttctttcctcctgacataa

SEQ ID NO: 3204 - DNA (genomic), 204 bp, Enterococcus faecium; double-stranded, circular
  misc_feature (B) LOCATION 1...204
  hypothetical: NO
  anti-sense: NO
ataaagatgatcttacctgataaatattatcaaatcattaagtgggcggtacttacggtacttccggctacatctgtattagttgcaacactaggcaaagcatatggatggaatggaacagatatgacagttctgactatcaatgcagtagcgacgtttttaggtgttatctctggtgtgtctgcatataacttaaagttatag

SEQ ID NO: 3205 - DNA (genomic), 639 bp, Enterococcus faecium; double-stranded, circular
  misc_feature (B) LOCATION 1...639
  hypothetical: NO
  anti-sense: NO
ataaagatgataaaagttttattagtagatgaccatgaaatggtacgcttaggcgtctcttcttatttatctatccaagaagacattgaagtgattggagaagctgaaaatggacgtcaaggctatgaaaaggcgatggcacttcgaccggatgtcattttaatggatctagtcatggaagaaatggatggcatcgaatcaacaaaagcaatcttaaaagattggccaaaagccaaaatcattatcgtcacaagttttattgatgatgaaaaagtttatcctgcaattgaagcaggagcagcaggatatttgttgaagacgtctacagcacatgaaatagctgatgctataagggctacgcaacgcggcgagcgagtactagaacctgaagtgacaacaaaaatgatggaaaaaatgagtcggcgaaatgatccagtattgcatgaagaattaacgaatcgagaaaatgaaattttgatgctgatttctgaagggaaaagtaatcaggaaatcgcggatgaattgtttatcacactgaaaacagtcaaaacgcatgtgtcgaatatattagctaagttagaggtagaagaccgaactcaagcagctatctatgcgtttaaacatggtttggtgaaataa

SEQ ID NO: 3206 - DNA (genomic), 1875 bp, Enterococcus faecium; double-stranded, circular
  misc_feature (B) LOCATION 1...1875
  hypothetical: NO
  anti-sense: NO
ggagagatgataatgcagcagctaacaaaaagagaaaggcagcttttgatttacttggtggaaatgtctgaaccggtaacaatcaaaaagttggctgaaaaagaaaatgttagtgttcggacgataaaatacgatctagatgatataagagagtggctgaatgagcggaagcaagtcctatatagcaaacgtagtcagggaatttggatgaatattagtagctctgatcgaatcaaattaaaaagcgaattgatggatgttaatcgttttgaaatatttgcagatcaaagtctccgaatcaaacgtttactaattatgcttttagtaacaaaagaagctattactggaatgaaaatggccaacgcattagatgtcagcaaagatacgatcatgaatgatttagatgtgctggaaaataattttcttaaggaaggattgaccttgaatcgtcaggcgcgaaagggtttttggatcataggagaagaacgtctagttcgattaacgattgaagagattcttcaaaaagagttcacggattatgacatttataaattaatgtcattgttattgaatggcggtgagactgaatactttgaaatgtattctgctactgctacacctatccaagaggtatttaatcaagtaatcattcgaatgcgacacttactggaatttgaaaatctagagaaactgaattacgcggaattactaaatattctgattcgagtgacaattgctaccgttcgcttacgcaaagaggctacgattggtcgttatcaattggttgctgaacaagaattagacaaaaacgatctttcttatcgcgtcatgcagcaggtctttgattattatcagttgccactgttcgaggatgaatatcattatatctatagtgatacattcgacacgattcaccagcaagacgtcatgaaactagttgagaatgtgatttataaagtaagtaaagcaatcaaccattctttttatcaagatccacaattgttgacgaatctgtatgctcatttatccatgcgattatcgagaaagaaaaaatttgtcaatgaatataatccttttaaagaagatatcaagcagaaatacccggaattatttgatgcgatcaagcaagcagttcgacaagaaataagtgaacaaaatattctgatcaatgattctttcgtggcatatattgccttacactttttggtttcctacgaaagagaagaagatctacgaagcgttagagccgtctacatttgttcaacagggttgggtgtgactagtctgatcaagcaaaagatcaatgaagaattaaataatatcactatcgtggcatttgcttcagtattgaatgcgcaagaaatgattgctaccaaagatcctgatttggtgattagtatttttccaattaatggcatcgatcgtcctttcatcaaagtccatccattacccactgaacaggacttgaaaaaaattcaacaaataataaaaaaaatacttgcttcttccaatcagcaggaaaggcataacttgaatcttagagaaacgtccatcaataaagatactttagaagactttagcaaggaattgattttgaaagcttatacgatttatgaacgtttacttgtcattttggaagcagaattgatccaagaatatcgagaagcttttttgcttcatgtattcttaatggttcatcgtatcacatttgatcaacaatatatggcagaaggtcgtcaagtagaccagattattttagacaaaggaacactggtaggaaaaatcgaagcagtttttgcagaaaataatttaggaatcaatcagtcagaaatcagtgcattattctcatatataaaagaaggagcgtcaagttag

SEQ ID NO: 3207 - DNA (genomic), 1992 bp, Enterococcus faecium; double-stranded, circular
  misc_feature (B) LOCATION 1...1992
  hypothetical: NO
  anti-sense: NO
gagtggatgataatgaaacagaaggaaaaattgctgttgagatatttgattgatcacaagaaggagtatgtcaccagtcaacgtttagcttctgaattgttattatctgatcggacaatccgtaattacttgcagcggatcaaagagttagtagaaaaaaacggaggtaagatcattgctaaaccaggttatggctaccaactgcatattttacaaagactgacatttgacttgtttttgagtcggcaagaaatagtacctggatatgctagagaaccgcaaggattttatgagtccgaagatcgacaaaagtatatattgaaccaattgcttttggaagatgccattctttttatggatgatttggcagaagagctttatatcagtcgttccagtttgacaaaggacatgcaagaaatcaaggagcgattgattccatattcactaaaaatcgtttctaagcatggtcaagggacatggatcgaaggggaagaaagaaatcgacggcattttatcatggatactttttttggaaaccattatggaaattcattgaaagaatatttagggcaaagccgttttttcccagacatcagttttgaagagctagtcattatcattctcgatgaaacaagagaagctaagttaaaagtttcggattttatcatacagaatctgactttacacttggctttggggatcaaacggctccgagaagggtttgaaatcaaggaattaggcatcgaacaagaagtttctaagcgagtagagtatcaagtggcgcagcggatcgttcaacgtattgaggtaatcgcaggtgtatcgtttcccgaagaagaaattgcttatttgacattacatctcatggctaagtcgaatcacaaagaaaatcaaaatgatcaggaactatcaaaggaattagcgaaagttctgaaaagattgtctcaggaatttcatttttcattagtagaggatctccagcttttcaatggactactcgatcatttgtcaccgatgatgattcgattgagccgaggtattcgcattgagaacccattgactgaggagataaagaaagaaaatcccaaagtctttgacgcagtaaaaaggcatttcagcaacatgccggctttgaaaaactataccatcaatgaagatgaatgggcctatttggctttgcatctcatggcggcattggaaaaagaaagagctgcgcataaactacatgcattgattatctgtgcaacgggttacggcagtgcccaactattaaagaatcgcgtagtcagtgaattcggtaaaaatattacagtggtaagtgtaaaaggctattatgagatcaatgaaacaactttaaaaggaatcgacctgattatttcttctattgatctttcgacaatgtttttcaaaattccagttttacatgtcagtatttttttgaatgaagatgatgttcgtaaaatacgaaaggtagttggagaatctataccctatcattcctcagatagaccgataccagcattttctctacagcaaaaaaagcagatttacaccgaacagttgtctgaaaaatttttcaagacttatacgtacgaaccgaaaaaggaagaaattcttcatgatttgctgcaaaagctgagcataaatgaagaagaaggatatataagagaaatgcgaaagcagatccagcaacgtgaaaatatgggacaaatcatattcagtgatacagtggcagtcccacatcccgctgttccagttggaatcgaaacaaaggtagccgttgcattgattccttctgggatgcagtgggatcaatatcaagaaattcattttgtttttttagtttcgccttcttatgtcgaaaatgaaggaattacggtcgtgactaaagcaatcgttaggttagttgaccagctaaaagtacagcaggaaatcttagctgaacctatttttgagaatttcagcagtaaatttatcaaactgatcgaataa

SEQ ID NO: 3208 - DNA (genomic), 378 bp, Enterococcus faecium; double-stranded, circular
  misc_feature (B) LOCATION 1...378
  hypothetical: NO
  anti-sense: NO
aaatctgtgatgactttaaggctgtttatcaagctaactcaaaagaagaagcgaaataccttcttatccggcatgattgagaaatggaagaaaaactatcctaaagtgacgcagtcactcatagaaaaccaagacttattaactttttatgattttccacctagcattcgtagaaccatttactcaaccaatctaatcgagtctttcaataagcaaattaaaagatacagccgtagaaaagagcagtttcaaaatgaagaatcactagaacgctttctagtcagcatttttgatacatacaatcaaaaatttctaaacagaagccataaaggttttcaacaggtaaccgatacattagtttcaatgtttactgagtaa

SEQ ID NO: 3209 - DNA (genomic), 507 bp, Enterococcus faecium; double-stranded, circular
  misc_feature (B) LOCATION 1...507
  hypothetical: NO
  anti-sense: NO
attaacgtgattaaaccaatgtttttaaaagttggcacaggaattgcttatataaaagtgaacagaaagaaaggaattaaccatatgaagaaaattctaatagcgactcacggtcacttagcttcaggctttcttagcagtattcaattactgacggggaaggttcaagagattacggtgattaatgcttatgtggatgagtgtgattttgaacaggagttgaatgtatttgtaaaccaggtgaacgagcaggatcagatttttgtttttaccgatttatttggcggaagtgtcaatcagaagattaccaaaacctttttggagaaagagattgctgtaactattttgtctggctttaatctgccaattctgctcgaaatagtattggcaaccaaggaattaacaaaggaggatattcaggaactggtaaataaatgccaacaggaattaaagatgaccattcttgatgaggtacatgtagtaaatgaagaggaagattttttttag

SEQ ID NO: 3210 - DNA (genomic), 660 bp, Enterococcus faecium; double-stranded, circular
  misc_feature (B) LOCATION 1...660
  hypothetical: NO
  anti-sense: NO
atgagcgtgatcgttttagcaggtacaattggtgccggaaaatcaagtttaacagaaatgatggctgaacactttgatagtcaggcattttatgaatcgattgatgataatgaagtcttgcccttattttatgcaaaccctgaacagtatgcttttttgctgcaaatttattttttgaataaacgttttgcaagcatcaaacaagcaatgaaagatgacaataatgtattggaccgttcgatttatgaagattcactgcttttccatctaaatgcagatctaggaagagcaacagaaacagaagttcgtgtgtatgatgaactgctggaaaacatgatggaagaacttccctatgctgcccataaaaaacatccggatttattagttcatattcgtgtatcttttgatacgatgttggagcgtatcgaaaaacgtggtcgttcgtatgaacaattgtcctttgatccaagtctatacgattattacaaagaattgaacagacgttacgatcaatggtatgaagaatacaaagaaagtccaaaaatccaaatcgatggagaccgctataattttgtggaagatcctcaagcaaaagaagaagtcttgaaaatgatcgaagaaaaattagcagagattcgccaaaccaaagtagccatttga

SEQ ID NO: 3211 - DNA (genomic), 342 bp, Enterococcus faecium; double-stranded, circular
  misc_feature (B) LOCATION 1...342
  hypothetical: NO
  anti-sense: NO
tttcaagtgatggaatacgcggatacaatgatgcgattattttatcgatcctttaacaaaaacgattcttatggatatgaaatttctaaaacgattcgtgagaggacaaatgattcctatgtgatcaaagagacaacactttactccgtttttgcccgtttagaaaagaatcaactgattgtttcgtatcctggagaagtgactcatggaaaaaagcggacatattataaaatcactgaaatagggcgtaatcttttagaagaaaaaaagcaagagtggctgacgacgaaagacgtagtcacatcaatttttggagggaaattaaatggatacaatccgtaa

SEQ ID NO: 3212 - DNA (genomic), 2109 bp, Enterococcus faecium; double-stranded, circular
  misc_feature (B) LOCATION 1...2109
  hypothetical: NO
  anti-sense: NO
agagaagtgatatacgtgacacaacttaaaaaattgtgccaaaatcgtttagcaatcgttttgacagctgttttctttttctggctgaagacgatcattgcctactatgcagatttttcattaggtgtggaaggtacgatccagtactttatcttgtggatcaacccaattgcgactaccttattgttttttggcctttctttgtatattaaaaagccaaagccagcgttagctattcttttgatcattgatattttaaatacgcttttgttgtacttgaatattattttttatcgggaattcacagatttcattacagtcaaatctgtattaggcttttcgaaagtgtcgcaaggattgtcaggaagctccttttctttgatgaagccccatgatgtcatctactggctggatatcgctgtgttcattgggctactggtttggttgaaggtcaagaaaatacctatcaaaagcaaccctgtcggcaaaccgatggctatcgctgttacctgtctttcagggcttattttttcaggaaatctagcgctgagcgaagccaaccgtccacaattgctgcagcgaacatttgaccgttcatatattgtcaaatatctaggaatcgatgcgtatactatttatgacggaatcaaaacaggaatgactagcagtgttcgcgcgcatgcaagcagtaatgggattgatgaagttttagattatacaaagaaacattatgcagagccaaatcccgaaacatttgggatcgctaaagggaaaaatgtgatcgttctccatttagaaagtttccagcagtttttgattaatatgaaggtagacggacaagaagtcacaccgtttttaaatagtattttccagaatcaagcaacgatcagctttgacaatttctttcatgaagtaggacagggaaagacaagtgatgctgaaaatatgttggaaactggcacatttggtttacctcaaggctcattattcacagaacttgggtcagacaatgtctttcaagccgcaccagcgatccttggacaaaagcaaggctatacaagcgctgttttccatgggaatgtagctagtttttggaatagagatcatgtatataaaaacttaggttatgacaatttctttgatcgatcttattttgatgaatccgacgaaacgttaggttatgggatattagataaagatttattcagagaatctgcccaatatcttgagcatctacaacagccgttttacacgaaatttctttccgtaaccaaccacacgccttattatacggatgacaagaatttcgactttccatctttgaatactggcaatagcacagtagataattatgttcgaacggcacattatctggatcaatcattggaacaattttttacgtatttgaaaaaatctggtatttaccaaaattcaatctttgtgatttacggggatcattttgggatctcgaatacagataataaagatttagcaagcgctcttggtaaagatccagatacatgggatgaatttgacaacgcacagatgcaacgagtgccattgatgatccatatgcctggttatactaaagggacagtcaatcatgaatacggtggagaaatcgatgttttgccgacattactacatctattgggaatcgatgataaagattatcttcattttggtacagacttattatcttctcagcatgatcaagtagttgcttttcgaaatgggaactttgtgacacccaaatacaccgtcctaggaggaaaagcttacaataatcagacaggagaaatcatcgatacgaaagcagcaggaatcgatgaggaaatctccaaagatcaggaaaaagtcaagactgcgttaagtctttcagataagctgaatcaggaaaatctcttgcggttttatgtgccaaacggatttgagacgattgatccgaaaaaatatgactataaaaatgaagcggaacgtaatgaagcaatcgaaaagcaaaaaggcgaacattcgacaagtgtcttttcaaaaaatggtaataaaacaacaaccaacttatatccagtaacaagaacagacgttgaacagcaaaaaaataatcaataa

SEQ ID NO: 3213 - DNA (genomic), 372 bp, Enterococcus faecium; double-stranded, circular
  misc_feature (B) LOCATION 1...372
  hypothetical: NO
  anti-sense: NO
catgaggtgatacagatgaaattagaagtgacaaaagaagcacaagaagtattgaagaataaattagaagcagacgatcaacttttattagatatcgaaaacggtgacggtccatttgcagaaagccaagtcagttgccaattggatacggcatttcgattgatcattgtcaaaaaagatacacaaacagatctaagtctttattctgtagtggctgatacaccagttggaccaatcaaaatcaaagacagtgcaatactttacatggatgatccatccacacttgctttagaaccaacttataatagtttacaattaaaaggaccaagcggcttgagaaaaggcaacttgcaagttgttcgaaaagactag

SEQ ID NO: 3214 - DNA (genomic), 1437 bp, Enterococcus faecium; double-stranded, circular
  misc_feature (B) LOCATION 1...1437
  hypothetical: NO
  anti-sense: NO
gtgagggtgatggaaatggaaaagaaatcgacgggtattagcaaatggggactggttgctctggttgtcagttcgtcaatcggaagcggtgtgtttgggatcacaagtgatctggctagttctgcagctccagggccagcgatcctttcatggataatcgttgggattggtattttagctttggtattatcgctgaatcatttaggagaaaagcgtccagatctagatggtggtattttcggttacgcggaagcttcatttggtaaattaggtggcttcatcagtggttggggttactggttgtctgcgtggctgggaaatgttgcttttgcaacgatgctgatgagcgccatgggagaatttttcccgatattcaaaggtggacaaaatgttccttctattttatttgcaagtatttttatttggggtctgactttattagtaaacaatggagttgaaggagcgagcgtcatcaatacaatcgtgacgatctgtaaattagtgccattattcctatttttaatatttgtatttatcgcatttaaagtgaatatattcactgctgatttttggggtaacgtatctgataatctagtgaatggaacagggcagcaaggaacgatctggttgcagattaaaggttgtttgatggttatgatgtgggtctttgtagggatcgaaggcgcaagtgttttagccaaccgcgcgaagaaacgttcagaagcccagcaagcatcgatcattggtctgctttgtttattgtttatctatatccttgcttcgatcttgccatacggcgtcttatctcaagaagagttagcaactatttcacaacctgctatggcaaatattttaaaaggaatcgtgggaaattggggagcagcgctgatcaatatcggcttgattatttcgatcattggttcttggttgtcttggacgatgctcccagcagaaacaacgatgttgatggctcgagacggtctgttgccgaaaggttggggaaaaacgaataaaaaaaatgccccaacttattcgttagttgttactgcaatcttgactaatctattcttattgactttcttagttactgattatgcctatcaatttgcctattctttatgtacagcggcaattttgatttgttatctacttgtcgggatctatcaagtccagttttctttaaaagaaggaatcaaaaaacaagtagtgatcggtgggattgctgtagtttttgaattgatgggcatcattttagcaggattttcttatgtccttttatgtagtattgcctatcttcctggtttttgcttctactggatcgcttgtcgtgaaaccaaacatcaaattacgggaaaagaaaaagtaatgattgggctgatttgtgtggccgcactgctttcaatcgggttgcttgctgtaggctggatcaagatataa

SEQ ID NO: 3215 - DNA (genomic), 561 bp, Enterococcus faecium; double-stranded, circular
  misc_feature (B) LOCATION 1...561
  hypothetical: NO
  anti-sense: NO
gttgcttcgatcaagtcagattcaattgtacctttatctgttttgattttcattgcagcttccatgtctgctggtttgttttcagcaacaagttctgcaatttcttttactaaatcttggaacatttcgtttttagaaacaaagtctgtttctgagtttacttcaacgattgctgcagtgttacctttcacagcaactgaagccaatccttcagctgcaatgcggtcatttttcttcgcagcctttgccattcctttttcacgtaaaagatcaactgctttttccatgtcgccttctacttcaactaatgcttttttcgcatccatcattcctacgccagtcatttcgcgtagttcttttaccattttagctgtaacgtctgccatgtttaactcctcctgtgtgtttttctttttaaaaaaagctgcttcaaaggagagtgaggcttgtcgcccagcctttgaaacagctccatcattcaaaattattctgctgaagaattgtcgccttcaacaacatctacgatttcttcgattgatgttgctgtgttttcttctgtga

SEQ ID NO: 3216 - DNA (genomic), 579 bp, Enterococcus faecium; double-stranded, circular
  misc_feature (B) LOCATION 1...579
  hypothetical: NO
  anti-sense: NO
atcgttgcctttttttgtcagacatgtataaactataagcgaaagaggtgttttaacatggatatatcagtgattgatgcaacgaaaacaaatacacaaaaaggaatcctttatggttcatcgaatgctcctaaaaaaatggtcgaattcatcaacttagcttgtccgtattgccgacaatggtttgaagaatcttatgagctattagaagaagcagtccaaagcgggcaattgcagcgagtgatcaaattgttcgataaagaaaaagaaagcttacagcgagggaacgtgatgcaccggtatctcacaatcagcgatggccaaaaagcgatcaaagagatcaaacaaatattcgatactcaagacgagtggaaacatctttctctccaagaagtagcggattttgcagtagataaactaaagctgacagaacaaaaagacgaacagctgagccaagctgtcatcaacgaagctgagcaagcacatattcgatttgttccaactgtcatcttgggtaaagaaatctttgatgaatctatttcaatagaggaattaaaagaattgatccaaacaaaataa

SEQ ID NO: 3217 - DNA (genomic), 228 bp, Enterococcus faecium; double-stranded, circular
  misc_feature (B) LOCATION 1...228
  hypothetical: NO
  anti-sense: NO
gttttatcgatattcttacccatttctccgcctaacgcatcgatttctcgaacgacaacgcctttagctggtccgcctacagaaggattacatggcatgaatgctaccatgtccaaatttattgtcagtaataatgtttttgatcccatacgtgcagcagcaagtgcagcttctgaaccggcgtgtcctgcgccaacaacgatcacgtcatacgcatctgcttcataa

SEQ ID NO: 3218 - DNA (genomic), 195 bp, Enterococcus faecium; double-stranded, circular
  misc_feature (B) LOCATION 1...195
  hypothetical: NO
  anti-sense: NO
atggagtcgattagaatgaacattatccagcaatatgagctaaagtatataacctttgatcagctatcagaagagatttggggttatggccaacgtttgataaatgaggttggtgttgagcgcttctctttctatgtagaagctgcagcaggttatcataattttaggttttatatcttcccgttatatatataa

SEQ ID NO: 3219 - DNA (genomic), 711 bp, Enterococcus faecium; double-stranded, circular
  misc_feature (B) LOCATION 1...711
  hypothetical: NO
  anti-sense: NO
aacaatacgatgccagataaaatattattggtagacgatgaacaggaaattgctgatttgatcgaagtctacctgaaaaatgacggatatgaagtacagaaattttatcttggacaagaagcgttggactgcatagaaagagaatcatttgatttagctgtattagatgtgatgcttccagacattgatggatttaaaatcgtccaaaaaatcagagaaaatcatttttttcctgtgattatgctgacagcaaaaatagaagacatagataaaataactggtctgactttaggtgcagatgattatatcacaaagcctttcaatcctttagaagtcgttgcgcgaatcaaaacacagttaagacgttttcagaaatataacattcaagttgattattcgacagaagaatcgataaaagaaattgatatacacggactaatcattaaccaaacgctacatacgtgtacactttatggggaaacaatctctctaacacccttggagtttgctatcctatggtatttggccgaacgaaagggcgaggtcgttccagcagaacagctgtttgaagccgtttggggagaaaaatttctcgacaacaataatacagtcatggcacatatcggacgcttgcgtgaaaaactcaaagaaccaacacgcaaaccaaaatttataaaaactgtttggggagtgggctataaagttgaataa

SEQ ID NO: 3220 - DNA (genomic), 552 bp, Enterococcus faecium; double-stranded, circular
  misc_feature (B) LOCATION 1...552
  hypothetical: NO
  anti-sense: NO
cgccccgcctttgtttttgaanatggccatggctattttcagaganaatttggacaggtctctgaaaaatatcttatggggaactggagtattctttgcttctatccagctgattttacttttgtttgtcctactgaattagaagacttacaagaacaatacagtacattgaaatctttaggtgttgaagtcttttcttgctctaccgatacccactttactcacaaagcatggcatgatacatcagatgctatcggtaaaatcgaatacgtgatgatcggtgatccgtctcatcagatttctcgtatttttgatgttttggatgaagagcaaggattagctcagcgaggaacatttattattgatccagacggaatcgttcaagctatggaaatcaatgcagatggaatcggtcgtgacgctagtgcactgattgataagattcgcgctgctcaatatgtacgtacccacccaggtgaagtttgtccggcaaaatggaaagaaagtggcgaaacattgaaaccaagttttgatcttgttggaaagatttag

SEQ ID NO: 3221 - DNA (genomic), 879 bp, Enterococcus faecium; double-stranded, circular
  misc_feature (B) LOCATION 1...879
  hypothetical: NO
  anti-sense: NO
gatgtgacgatcctattctctactcgagtagagaaattgatccacaaagaacataaaatttacggtatacgcacggaattcgaagagttccatgctcctgccgttatcttaacaactggtgggcggacttatccctctactggttctactggagatgggtacaagatcgtgaagcgagtgggtcacacggtgacgcctctgtatgcgacagagtcccccttgatatcggatgaaccgtatattcaggagaaaacacttcaagggctttctttacaggacatcactttacgtgttctaaataaaaaaggccgtgtattgactgaacatacgatggatttacttttcacccatttcggtatttctggtccggctgcactgcgttgttcaagtttcgtcaataaagaattagagaaaacgggagaaccagtgacactttctctggattgttttcctacacaaaccaaacaagagcttattcatttattgacagaaaaaagtaaagccaccaaaaagaacttagtaaatgcttggcatggtctattacctgagcgattgttggttttctttcttgagcggcttgaaatggatagcctaacaggacaacaagcctctcaaaaacaaattcaagatttcgttcaattatgcaaagagtttaagctaccagtcaacaagacttttcctattgagaaatcatttgtaactggcggaggggtttctctaaaggaaattcatcctaaaacgttggagagtaaaatcattgatggtctgtattttgccggagaattactggatgtcaatggttatactggcggctttaatatcacagcggctttcgctacaggacatgtagcaggaaggaatgctgggcaaagagcataa

SEQ ID NO: 3222 - DNA (genomic), 687 bp, Enterococcus faecium; double-stranded, circular
  misc_feature (B) LOCATION 1...687
  hypothetical: NO
  anti-sense: NO
aataagacgattgaatcaaatagacaggagaagaagcaaatggattttcaaagcattttagaaaagataaaagctgctttgatcagtttttggcgttggatcagaccatatctcggacaattccatcgatggcgaaagcgcatctggaaaaaatatcatgtgaacaaattgattttgctgattggtttgatctgtgtcttagtgacaagtatctacctctttattttagcaaaacaagcaaatgtcgaaacgttaaaatcaggattaagccaatcgacagtcatttatgataagaaaaacgaagaagctggcacactgtacgcccaaaaaggaacatatgtagaattaaacgcgatttctccctatatccaagatgcagtaatctcgacagaagataggaatttttacgagcatcacgggtttgatatcaaagggattgcccgtgcagcagtccgaatggtcttgtctggcggaacatcagggggcggaggaagtacgatcactcagcagtttgccaaaaatgcgtatctgacattagaccatacgtttgatcgaaaagcgaaggaattatttttggcaatcgagatcgaaaagaagtacagcaaagaagaaatcttgaccatgtatcttaacaatgcctattttggcaacggggtatggggtgtccaagacgcttccagaaagtat

SEQ ID NO: 3223 - DNA (genomic), 984 bp, Enterococcus faecium; double-stranded, circular
  misc_feature (B) LOCATION 1...984
  hypothetical: NO
  anti-sense: NO
atgaggacgatttttagaaggaaggctgaaaagatgaagtggggatttagatggtatggtgaaaaaggggattcgatcccattaaaatatgttcgccaaataccgggaataaatgggataattggaactttgctgactaaaatgcctggagatgtttgggagatttcagaaattgaggagttgaaagcatctgttgagagccaaggactggaactgcttggaattgaaagtgtagcgatccacgatgcaatcaaggcagggacagatgaacgagattactatattgataactatatacgaacaatcaaaaacttgtctcgatgtggggttcgattgatttgttatagcttcaaaccaatttttggatgggcgaaaactgatttgtttaatgaaaacaacgatggaagctattctcttttatacgatcagaaaatcgtcgatcagatggagccaggagaaatgtatcaattgatacacagccagtcaaagggattcaaattgccgggttgggaagaagaacggttgaaaaaattcgctcagctggaaaaactgtatgaaggaatgaccgaagaagaattatttgaaaatctgacttattttttagaaaaagtgattccagtgtgcgaaaaagcagatgtaaaaatggctatccatccagatgatccgccatgggaactttttggttttcctagagtgacgaaaaatcttggcgacttgaagaaaattctaaatgcagtagattctccatataatggactaacgctgtgcacaggatctttaggggcaaatccggaaaacgatttagttgaaatcatccatgaggtaggttcgcgcatccattttgtccacttcagaaacgtggagtttttaggagaaagaaagttcaaagaaacggcacatccctctacagaaggctcccttgatatgtatcatattatgaaagcgttggtgcaagaagggttcgacggtcctatacgcccctga

SEQ ID NO: 3224 - DNA (genomic), 363 bp, Enterococcus faecium; double-stranded, circular
  misc_feature (B) LOCATION 1...363
  hypothetical: NO
  anti-sense: NO
tggaggacgataatgacttcaataaacattgatcacacaaaaaaagtcatacatgaattatacaatagtttaatgacacgacctaatcagacgaaagcattattagatattactgatgttttatttcaggtatataaaaaaattgatacagcaaaatatcctgaaattcttgtaaataaattagttaattatatttacatcgtgggttttgataataaaatacgctttattgataatgatgaaaaattattaatagaattaggggatatttctaaaaaagctggaattaatagtaaatacaaagcaaactttacagataaatcgcaattttatagttattcagaaacaatgcctcaacgataa

SEQ ID NO: 3225 - DNA (genomic), 240 bp, Enterococcus faecium; double-stranded, circular
  misc_feature (B) LOCATION 1...240
  hypothetical: NO
  anti-sense: NO
ccgtctgcgatgacggtgtcgggatatcaggagaaatctcggaaaaaaatatttacgctaggtttttcgaccaaaggaatcaatcgtgggtttggattgaatctcatccattcaatcgtcaaacgccacggtggatttttagaattttccaaacaaacaaatggcggtacaatcgtctatctagaattaccaaaaaaggaagatcaaaatgatgacaaatgtcctgataatcgaagatga

SEQ ID NO: 3226 - DNA (genomic), 342 bp, Enterococcus faecium; double-stranded, circular
  misc_feature (B) LOCATION 1...342
  hypothetical: NO
  anti-sense: NO
gggatagcgatgggatcattaaaaaatcaaaaggataaagtcgtaggtaacgcaaaagaaaaaatcggcgagatgctcaataaagaaaatctaatcgatgaaggtcgtacgcaatcagaaacagcagaagaaaaagaaaagcagtaccaagcaagaatcgatgaaatagaagaccagcaggcagaagaagaagcgaagcggcaagatttgactcaagaacgaaaaaatccgacacctgatcgtagtaaaacaccgctcccagaaagtgaccacattcccgatgagcaaaaaatcgaggaacagggaatgaaacactatacaggaatcgaagagaagttataa

SEQ ID NO: 3227 - DNA (genomic), 312 bp, Enterococcus faecium; double-stranded, circular
  misc_feature (B) LOCATION 1...312
  hypothetical: NO
  anti-sense: NO
gaacgagccttaaacttttcgttctcggaagaaatggaaaaacacaacataacaggcagtatgtatgtggatgatcaatggtttatcagcactgatgaggtaaaaatagctgccattaggagagattacctgcagaaaattcataaaataaaagatcctaatgggaaaaaggcaaggttaattataactttgataacatctaatggtaagaagttaaaacttgcaggatcatatgataatgttaaaaagttcgaacattggtatctgcaaaaagacagcattagtcttaataaacaatttgaaaaaaattaa

SEQ ID NO: 3228 - DNA (genomic), 708 bp, Enterococcus faecium; double-stranded, circular
  misc_feature (B) LOCATION 1...708
  hypothetical: NO
  anti-sense: NO
caaattcagatggcaacgaccaaaaaagaagtcaatgtattgaataacttactggctaagcaagtggacggcgtgatctccatgggtcaccatatcacagacgaaatccgtggagaattttcacgttcaaaaactcctgttgtatttgctggctctatcgatccagatgaacaagtaggtagcgtaaacattgattatgtatccgcaacaaaagatgcagtaaacaaattggcaaaaagcggcaataaaaaaatcgcttttgtcagtggtgcgttgatcgatcccatcaatggacaaaatcgtctgaaaggctataaagaagcattaagcgaaaataacctaccatatagcgaaggattgatctttgaagcacaatacaacttcaaagatggtctatctctagtcgatcggatccataatagcggtgcaacagctgtctatgtttcagatgatgaattagccatcggtattttggatggtttattagaccgtggcgtgaaagtaccggaagaattcgaaatcatcacaagtaacaattcactactgacagaagtagctcgtcctcgtttaacaagtatcacacaaccattatacgatttaggggcggtatctatgcgcctattgacgaaaatgatgaataaagaagaagtcgaagaaaaaacgattatcttgccttatggaatcgaagaaaaaggatctacaaaataa

SEQ ID NO: 3229 - DNA (genomic), 189 bp, Enterococcus faecium; double-stranded, circular
  misc_feature (B) LOCATION 1...189
  hypothetical: NO
  anti-sense: NO
aaatgccagatcaaacgattagcggattgtttaattactttaacaaataaatatttattccgaaaagtgaaaaaaacatataaaaaaacacataaaactaaaaaattatcaaagaatcctggtgcaactgaaagaatttgcaacgggattctttcaacttatttgttatttttttctaaaaaatattaa

SEQ ID NO: 3230 - DNA (genomic), 510 bp, Enterococcus faecium; double-stranded, circular
  misc_feature (B) LOCATION 1...510
  hypothetical: NO
  anti-sense: NO
gggatacagatggatattttggcggcaattgattcatttaaaggaagtgcttcttcatttgaactaaatcaggcagttctaaatggctgggaagatcgtaaaggaagaaaaatcaatgtgccgattgcagatggcggagaaaatactgcagaagcaatctattacgcgctcaggggaacatggcgtaccattgatgggatggatctcttattccgtcagcgaaaaatcagctatttattgacaacttggcaaggaaaaaacaccgcagtcatcgaatctgcacaagcattggggttagatctacttgataaaccaacggatcaaactatccgacttgcttccagttatgccttaggagaacttattaaagatgcactgcttcaagaagtagaacaaattattgtcactttaggaggaagcgggtgtagcgatggtggtctaggattactccaatccgtgctgtctgtccagaaggtacacagaaggaaggcggcctatcctatatggagg

SEQ ID NO: 3231 - DNA (genomic), 480 bp, Enterococcus faecium; double-stranded, circular
  misc_feature (B) LOCATION 1...480
  hypothetical: NO
  anti-sense: NO
cgatcacagatgaacgaaaaaaacaggttgactttttcagatgtctatttcgatgctggccaagctttgttggtaaagaaaggaaaccaaatcaaaagtgtagatgatttgaatgcttctacaacggttctagcagtcaaaggttctacatcggctgcgaatatccgacagcatgcaccagatgcaaaaattttagaattagaaaactatgcagaagcatttactgctttacaatctggtcagggagacgcgatgactacggataatgcgattttgttagggattgcagatgaaaatccagagtatgagttagttggtggaacgtttactaatgagccttacgggattgcgatcaacaaagggcaagaaaacttcttgaaagctgttaaccaagcgctagaggaaatgcatgcagatggcacatacgataaaatctatcaaaaatggtttccaaatgaaactgaaggaaaagtagagtaa

SEQ ID NO: 3232 - DNA (genomic), 1035 bp, Enterococcus faecium; double-stranded, circular
  misc_feature (B) LOCATION 1...1035
  hypothetical: NO
  anti-sense: NO
gcggttaagatgaatttttttaaatatttgaaagatcagtggacattgatcttgggatggctgttttttattgcattgacgatctttgtgatgtggctggcgccaaacatcaaagttgatttgagcacaattgcttatttagctttgattgagggcgtctttctgattttttatctgctgggtggttacttgagcaagagaagatggtggggaaaattagccgacatacaaaaaacttcccctttgcaaaattatttgagtggtgggaggacagaagaagaaaaactggtagaagaatatatcaatcagctgatccgtgaacaccaagaagtaatgcaatcagcaatcagtaatcaacaagaccaaaaagattatattgactcatgggtccatgaaatcaaagtgccactttccgcttctaaattgctagttcgttcgatcgagttcgatattgacgatcaaaagtatacattactagaaaatgaattatcaaaaatcgatgaatacgtagaacaagttttgtattatgcaagactcgacagtttctcgcgggactacctcatccaagaatatggactaaaaggaatcattcagcctgtgatacgcagtcaggcaaattattttatccaaaaaaatattcgctacgagatcgttggtgaggatcatactgttttgaccgatgctaaatggatcgcttttatcttcaaccaattgcttagtaatgccatcaaatatacgccggatcacggaaacatcattgtgagcatagaaaaggaagcgcaaggagtcagcctttcagttaaagattcagggatcggtatcccagcggaagacttgaaacggatctttgataagggatttactgggagaaatggtcgacttagcaaaacacattcaacaggattaggactttatttagcaaaaaatctggccgaaaaattaggtatccatttgacggctgaatcaactgaaggaaaagggacaacaatgactttatttttcccaatcttaaatttttataatgaaaaacgttag

SEQ ID NO: 3233 - DNA (genomic), 198 bp, Enterococcus faecium; double-stranded, circular
  misc_feature (B) LOCATION 1...198
  hypothetical: NO
  anti-sense: NO
tgtttcaagatgtcctattcagagtttaccaaagagttactagatattctagacctaaatcttacctttcatgaggatgcctttcgcaaagagcgcatcaatgacgaaacatgttttgcttttgatggcacattgacctatcaaccggaggaatgctttcatcgccactatcaaaatgaacaaacgatcattaaatag

SEQ ID NO: 3234 - DNA (genomic), 207 bp, Enterococcus faecium; double-stranded, circular
  misc_feature (B) LOCATION 1...207
  hypothetical: NO
  anti-sense: NO
agaagcaagatgattgtaaaggagacgaaatggatgatcgatagtcctgattattgtacatgtaataacaacaaaaatatccatacagaatttaatgaccaaggaagcttgagcatatgcgacaactgtcacaaactagtcaaagattcatttaaaacatttgaatcttatcctgttcaaaattatgtaaaaagtagaagaagataa

SEQ ID NO: 3235 - DNA (genomic), 2166 bp, Enterococcus faecium; double-stranded, circular
  misc_feature (B) LOCATION 1...2166
  hypothetical: NO
  anti-sense: NO
cttataaagataaggagtaaacgaatcgtgcaaaaaaaagaaattgccgtatttatcgatcaaatcactcgtgaacgggccactggcgatttgcttattgtgggctgggcaattgatgaagtgaccaaagaaatccctacgataaaggtagaaaaagaaaatgtgattgctgaagcaacacatgtcgtaagattggatatcaatcatttatataatcttgatgttaagacccaaagcggttttaaggtacgtttatcagggaaaatgagaggaaaagcaatcttagacttccaaacagcaagacatcaaaatggcatagctgtgaaattaaacggtaaatatccttatgatgacggcattgaatcttcatgggaaagaaaaaaaagattactgaaaaaagggataaattatgcaaggactcatggcgtaaaaaaagcaatccgccgggtcaaactggaattgaaaccaggatcgatcgactatgcagagtggatcagtcgtcatgagaaacctgatctgaaagagcaaaggaaagaagtacaaggatttgcctaccgcccattgatttccatacttatgcctgtctataacgttgaaatcaaatggctcgaaaaatgcattgattcggtacttgatcaaacgtatgatcactgggaactatgtatcagtgatgatgcttctactgatccagctatccgaaagtgtctagaatcctatcaagcaaaagatgatagaattaaagtcgttttccgacaagaaaatggacacatcagtctggcaactaattctgcattggaaatggcagaaggagagtttatagcgctcttagataatgatgacgaattacctccatttgccttatatgaagtggcaaaagtgctaaacgtacatccagaactggatttgatctacagtgacgaagataaaatcgatgcagatgggaatcgctttgacccgcacttcaaagcagactggtctcccgatacattgatgggaaataattatatctctcacttaggcgtatatcggacaagcattgttaaggaacttggcggtttccgtaaaggatatgaaggctctcaagattatgatttggttcttcgtgtgacagaacaaattcctgcagaacacatttaccacattgaccgtgtcttgtatcattggcggacgatcccgggatcaactgcaagcaatggagaagctaaaagctacatctatgattctggagtgaaagcattgacagatgctctatctagaagaaatatcaagggaagcgtacatcctggcagaatttctggtttttatgaaatcacttatgatgttttgcaagaagacttggtcagtgtgatcattccaactaagaatggctatgaagatctaaaaacttgtgtggattcgatcatcgaaaaaacgtcttatccaaattatgaaatcattattgcagataatggaagtacagatcctaaaatgcaagaattatttgcagaatacaagcatcagctgaaagaccgatttatcgtcgaattaattgacattccattcaattattcacgtatcaacaatctggcagcagaaaaagcaaacggcaaatactttttattcttgaataacgatacagaagtgattgaacctgactggatgacagcgatggtttcttatgcacagtttgatcgaatcggctgtgtaggagcaaaattattttatccggatgatacaacgcagcatgcaggtgtattattagggatcggtggcgttgcaggacatgcattgaataactatgatcgaacacattgtggttactttggccgattggtcattgacgtcaattacttagcagtcactgcagcttgtatgatggtcaaggcagctgacttcaatgctgtcaatggatttgatgaaatattagaagtagcattcaacgatgttgacttgtgcttgaaagtttatgaactgggtcgttacaatgtctatgcacatcaagcagaattgtaccatttcgaatctaaatcaagaggttatgaagatacaccagaaaaacaaagacgttttgctggggaaatcaaaaaaatgcaagataagtggccttcttatattgctcatgacccattttataacgataatctaactaaagaaggaatcggcgatttttcgttgagacctgattga

SEQ ID NO: 3236 - DNA (genomic), 2229 bp, Enterococcus faecium; double-stranded, circular
  misc_feature (B) LOCATION 1...2229
  hypothetical: NO
  anti-sense: NO
agacaaaagatcgaccatccgatagtaaatttccagtttcattcatcaaaagacaatcaacaaaggagaaataaaatgaatatcggtcaaatagatactagacatgcaacagcgaatcagccaaatttctctaatgggaactgccagccttatactggcgttccttttgggatgaattattttgcaccgcaaactacggatcaaaacggcagctggtggtttcatcctgatgaccgcgtttttcaaggctaccgtcttacccatcaaccaagtccttggatgggtgatttcagtcatatgctgtttacgccgatcaatggaaaactacaggagaacacccttttccatgctcaaagttcttaccgcccagaagaaagtatattttgcccgactcatctgtcgatctgtcaattacgttatggcatctgttctacattgatacctagcatgtatggcggaatcttatctattgattacagcaaaaatgacagcggtttacttttatcctttccgggacgccatcagctctttgttatagatccttacacagtggaaggaaaaatcacacattttgctggttcagaagatcctgatttttctttttattttatattgagatttgaatatcctttaacaattgatgagttagctgtttccaacaaaaatagcgactcgatcccgttgtattttgaacagacaaaaaaacaaactatccgatttgggacatcttttatcagctcggaacaagcagcttataacctggaactagaacaaaaccaaagcaaagagacttaccttgctcacagtcaagaacaatggcagtcctattttgatcgtatacagctcacacaccatgatcaacaacaattgcggacgttttatcataatttatatcgggtgtttttatttccacaaacattttatgaaattgatcctagtgggcaaaaaatccactatgatacgactagtcgatctataaaacctggtgttctctatacaaataatgggttttgggatacgtataaaacggtttatcctctttattctttgattgctgtagaaaaatacgaagaaatgctggaaggttttttgaacagctatagagaaagtggctatttgccaaaatggctgtctcctgatgaacgtggacttatgcctgggacattgatcgatgcggtcattgcagatgctgctgtaaaagatatccgacgagacttgatgcctgaatttctaacggcaatggaaaaaggtgctacggttcaaagcaaacatccaaattatggacgccaaggaacagaagattacttgacatatggctatgttcctaatcactaccacgaatcagtcaatcacacattagactatgcttatagcgatttttgtattagccaagttgccaaggtactagaagaagaggaaatgacgaagaaatatcagcagcaatcattgaactatcaaaatatctttgactatgagtcaggatttatgcgttcaaaagataaagatggcaagttcagagaaccattttcagctaatcgttggggacaagattatgcagaaggaagtgcttggcaaagcagctttgctgtttatcacgatttttcaggactgatcggaaaatatggtggcagtgagagatataaagaaaaactcattgagctgtgcaatcagcccccaacgtttgacccaggaggatatggttttgagatccacgaaatgagtgagatggccgcgatagaatttggacaattagctatttcaaaccagccaagttttcactatccttacttgttcagttatataggacaacctgaaatggcacagccactgcttaaacagttgatgactcagaccttcgacgattctccaatgggttaccctggagatgaggacaatggaagtatggccgcttggtatatcttcaatagtctgggattttatcctgtcacgcctggaaccggtgaatatgttatcggtatgccattaattgacaaggctgttttgcttttgtcaaatggaaaggaattgacgattgaagcaacgcctaatcggccgcagcaacaatttatccataaaatcaaacggatggacaaagaatatacgaaattatattttacccatcaagatttgctgaaaggcggcacgatctcttaccaattagggatcatccctcaccctaagaaatatcaagcaaaagatttgcctttttccttatcaaactataattaa

SEQ ID NO: 3237 - DNA (genomic), 999 bp, Enterococcus faecium; double-stranded, circular
  misc_feature (B) LOCATION 1...999
  hypothetical: NO
  anti-sense: NO
ttcagctttttggtattttgttttagactagacaaaaaggaggaatcagctatggcagaaataagaatcggacattcacaagtctacgcagaacagcttggattaggagcaaatgccgttggaggacataatctttttgacggtttggaagatgagacaggaaaacaagtagttcgtacagctttgaatagcgggatcaatttgatcgataccgcttatgcttacggaaacggccgttccgaagaactgattggcgaggtactgaaggaaaaagaatatgatcgctcacgtgtcgtcatcgctacaaaagctgctcatgtaccaaataaagggcgaacatttgataattctcctgagtttctcaaacaatcggtggaagatgcactaaaacgtctgcaaactgattacatcgacattttttatatccactttccggatgaaagcacaccaaaaaatgaatcagttgctacattgcacgaattaaaagaagcaggaaaaatccgagcagtcggtgtgtcaaacttcacgttagaacaattgaaagaagcgaatgcagatggatatgtcgatgtagtagaagataaatacagtttgatccatcggcaggctgaaaaagaattattcccttatcttgaaaaaaacaaaatcagttttgttccctattttcctcttgcttccggtttgctgacaggaaaatatgaacttggtgaggaaaaacaatttggtgaaggagatcctcgaaaaagaaatccagatttccaaggagaacgtttcagagaaattttaaccgctgtcgatgtacttcgccccattgctaaaagataccaagccactcctgcgcaacttgttttagcttggtacatgaagaatccacgagtgtctgtagttatacctggagctaagcgtccagagcaagtatctgacaatgtccaagctttagatttgcatttatccaatgaagattatcaaaccattgatgaagcatttcgtggattttga

SEQ ID NO: 3238 - DNA (genomic), 450 bp, Enterococcus faecium; double-stranded, circular
  misc_feature (B) LOCATION 1...450
  hypothetical: NO
  anti-sense: NO
caccagaagatgagaaagaaatgtttggtttacagaaagagatcttggatgcctatggactcaaaagataaaaacgtagagaaaaacaaacatttcctgatgtctgtggaatttgctgtccaaggagtcaaaaccgtttttgaggaagaacgcaatatgaggaaacatgttgcgttcggtatccttgctttatttatgggcgtgattttccagcttgatcggatagagtggttatggctgcttttagctgtttttctcgtttggatagtagagatcatcaatactgtttttgaaaatgtagtggacatgtttacggattttcattttcatccgattgggaaaaaaatcaaagatatggcagctggagcagttttagtgaccgcttgttttgctgtcatcattgggttgattttatttgtccctaaaatatatcatttgttgtttaattaa

SEQ ID NO: 3239 - DNA (genomic), 1311 bp, Enterococcus faecium; double-stranded, circular
  misc_feature (B) LOCATION 1...1311
  hypothetical: NO
  anti-sense: NO
aagaggaagattagaggagagagaaacatgtcggagaaaaaaggatttcataatgatgacgtggtgttagatatccacgatcgcccaaccccaggacattgggtaggattaagtttacaacacttgttcacgatgttcggagcaaccgtgttagtccccatcttagtaggtatcgatccaggtattgcgctagtcagttcaggactatgtacattggtgtacttatttactactaaaggaaagatacctgcgtacttgggaagcagcttcgctttcattgcagcgatgcagcttttgatgaaaacagatggttatccagcgattgcacaaggagcagtcacaactggattagtctatttgattgttgcgctgatcatcaaaaagatcggttcagcatggctggataaaatcttgcctccaatcgtcgtcggtccagtcatcatggttatcgggttgggacttgcggcaaatgcagcaacaaatgctatgtataatcagggcacgtatgatttcaagtatattgctgtagcgctgatcacattaggattaacaattttcttcaacatgtggctaagaggttttctcggattgattccgattttactaggtattattagcggatacatcgtagccttgctgtttggaatcgtggatactaagccaatcgtagacgctgcctggtttgctgttcctaactttgagattccctttgtacaatatgaaccaaagctatatcttggagcaatcacaacaatggcacccatcgcttttgtgacgatgacagagcatatcggccatcttatggtattgaataaactaactaaacgtaatttctttgaagaaccgggtcttcataagacgttgacaggtgatggattagcacaaatcgtggcagcctttgtcggaggtcctcctgtaacaagttacggtgaaaacattggtgttctggctatcacacgtgtccatagcgtgtttgtgatcggtggagctgcagtatttgcagtcattttaggattcgtaggaaaattaagcgctttgattttaagtatccctggaccagtcatctcaggaatcagttttatcttatttggagtaattgccgcaagtggaatgaagattttaatcgagaacaaaatcgattttgataaaaagaaaaatctgttgattgcttcagttatcttagtagtaggaattggcggactcgtctttgaagtaggcacatttacattgtcggcaatggcattagcaactgtacttggcatcattttaaatcttatcttaccagaaacttcacgaagcgaagaaaactaa

SEQ ID NO: 3240 - DNA (genomic), 186 bp, Enterococcus faecium; double-stranded, circular
  misc_feature (B) LOCATION 1...186
  hypothetical: NO
  anti-sense: NO
aaaagcgagatagtagcaatagacggtaacgctaatggcagcataattttgaaaaatacaccaaaatctgtgcaaccatccatttttgctgattcttccaaactatccggcaaggcttggaaaaagtttctcataatgatcatattcattgcattaacagccacaggcaggatcatggcccagtaa

SEQ ID NO: 3241 - DNA (genomic), 792 bp, Enterococcus faecium; double-stranded, circular
  misc_feature (B) LOCATION 1...792
  hypothetical: NO
  anti-sense: NO
aaaggagagataaacatgatatttgattctcatacccatttaaatgctgaacagttcaatgaagatattccagaaacgattcagcgagcacaagaaatgggggtaacgaaaatggcggtcgtgggcttcgatacgccaacgattgaaaagtctttgcaattaagccatgactatccaaatatatacagtattatcggctggcatccgacagaggctggcagttatacgaaagaaatcgaaaataaattacaagaacaattgactttaccaaaggttgtagcattaggggaaattggcttggattatcattggatggaagacccgaaagaagtccaagataaagtatttcgcagacagattgctatcgcaaaagaaatgaacctaccaatcagtattcatactagagaagcacttgaagacacgtatcaaatcctaaaagaagaagatgttcgagatatcggtggaatcatgcatagtttcagtggtgattatgaatgggcaaaacgatttcttgacttagggatgcatatttcatttagcggtgtcgtcactttcaaaaaagcattagacgtccaagaggctgcagcaaatgtaccaatcgaacgattacttgtggaaacagatgccccttatctggcaccagttccttttagaggaaagcgaaatgaaccaggctatactcgttatacagtagaaaagattgctgaacttcggaatcttccgacagaagaagtggctgcccaaacatggacaaatgcgcaccgattatttggtctaagcgaacatggataa

SEQ ID NO: 3242 - DNA (genomic), 1512 bp, Enterococcus faecium; double-stranded, circular
  misc_feature (B) LOCATION 1...1512
  hypothetical: NO
  anti-sense: NO
cgaggagagatagttatggatcaggaaatatttccagaaaattttttatggggcggagcagtagctgctaatcaatgtgaaggtgcatggttggaagacggcaaattacctaatgtgacagatacgcttatcgggatcatgaaccagcatcctagtattcagtggaatgaagaaaaaaagatttgggagattgctttagacgaatcactccattatctttctcatgaagcgattgatttttatcatcgatttgaagaggatattcgtttactgaaggagttaggtttaaaagcttttcgaacaagcatctcatgggcacgaatatttccaagaggagacgaacagaagccaaatgaggctggtctcgtattttatgacagactaatcaatacattaaatcgatatgatatcgagccagtaattactcttagtcattatgaaacccccttagcattggtaggagagtatggggggtggcaaaatcgaaaattaatcgacttttttgaattttatgcgcagaccgtctttgaacgctaccaagggaaagtgaaatattggatgacctttaatgagatcaataatgcttttcgtatgccttatgcagctgctggattggttacattccctgctagagataaacttgaacccattgctacactaacaaaaaaagtgatttatcaagcctgtcatcatatgtttctagcgaacgcccgtgctactcaattattaaagaaaatcgatccaaatgctaagatgggtattatgtgtagcttttctgcattagcgacttatgcatatgactgtgatccagagaatgtatttggttcactgcaatttaaacgcaattcatggtttttctccgatgtcatgtgccgagggcattatccagcttatatttacaggacatggaaggaagaagactgtgcaccagtaatgttagatggagacgaacagtgcttgcaagctaacacggcagattatattgcatttagttattatcgtagcgctgtctataaaaaagaagcagaaatgcgcgtagatactggcggagcaaatggtttcgataatccctttttgaaggaaaaatctcccgaaccttggagttggccaattgatcctctagggtttcgttatgtcatgaatgaattgacagaccgttatgaattaccattattcatagttgaaaatggcattggactagatgaagcaccagatgaattgaatcgaatccacgatccaaaacgttgtgagtatctaaaaatacatcttcaggaaattgctgaggcaataaaagatggttgccaaatcattggttacttatggtggggaccaatcgatatcgtatcggcaggaacaggggaaatgaggaagcgatatggctttatttatgtggatagacaaaatgatgggagcggaagctttaggagattgaaaaaagatagttttgaatattataaacaaattatccagtctaatggtaaaaaccttgaatatagatctttcttcaaatga

SEQ ID NO: 3243 - DNA (genomic), 1887 bp, Enterococcus faecium; double-stranded, circular
  misc_feature (B) LOCATION 1...1887
  hypothetical: NO
  anti-sense: NO
aacgtggagatcaaagccgtgattccttctatcgagaaatactatctattcttggaaacttggaacagtagggggagattgactatgctttggaaattatcacttactgggatcaagagccgtttaagagactacttggtgttattctcaggattagttatggcatctgctattttttacatgtttgaatcaatggcaagcaacgaagcttttttgaaaagtaatacgatcgttgcggctacagttatcattttccgattcggttctgttttactagggatcatcacattcgtttatattttatatgcaaattcctttttgatgacgatgcggcaaaaagactatgcaatgtttatgatgctgggagcaaaaggcagaaaaatcgcacagatgattttttctgaaacattcttagtagggatcgcagctactttagtgggttcagctgtcggtgtaggattgacaagtatcgtccaccgattattagtggatcagttagatctcaatatttcgcattttacaccttttagtattcacgggttgttgatcactgttttgttttttgctgttttgtttttattagctgctgttgtcaatgctttttcgattgtcaaaaaaccgattttagcattgattcgtgcggatcagacaccaacaagaatcaagcagcataaattcttgtttttccttgaagtagtactgggaattgcttttctaggctgcggttactatatgatgaaacacgtggggacctatcaagtctttggtataggggtagccttagttacgatcgtattaggaacttatttcattttccattctgtgatcattttctttttatcattactaaagaaatcagaacagatttcattgaaaaaattgaacaatttcacattgtcacagttaaactttcgtattcgtgaatatacacaaatgctctcaatggtcgctatgctgtttgccttggcactgggcgctttgacggtaggattaggttttaaaaatgaaattgcagacttgacagaaaacaattctggatatgatctagtgatgaataatcctcgggcagaagatcagcaaaaaatcaaagaactttcaccaacactttctgcttcttatactcaaaaagaagatgcgggaacgatttactataatgcaagtgaatttgcggctcaaccattgatcatgataaaacatgaagatggaacaccgccgaagatcacgaaagaaaaagttcctgctaaaaaaatgaatgaactgactgtacaagaggaacttcgaagctatgaattgccggaacagcaagaaaaagaaatcaaggtagtcagtcaatcagaatttgatcaactgaacttgccacaatccactttacagctagttcaggtaaaagacttccaagcaaacctgaaaccaatcgaaacacttgttgctcaaaataaaatgaacaatccatctttgcaaaaagtagagtacagcaaccagaaatatgaaatgtatgaagtgtataatggtctattctctggttttgaatttatgggattcttcctaggtttagctttcttgaccatgcttgctagctgtttgatgttcaagatcttgtcaggaagcaagagtgacattgctcgttatgaaatgcttgaaaagataggaacacgacgcgggttgcttaaacaatcgatccgtagagaagtaggcgtgttattcttagcaccaggaatcttaggtgtagtccatgtcttattcggattacaaatgtttggtctattcatgcaaaatccatacaaagatatttgggttccgtttacgatattcttcgtattgtatttcatctactatgtactgacgacatggttatatactggaatcgtattgaaaaagagattgtga

SEQ ID NO: 3244 - DNA (genomic), 519 bp, Enterococcus faecium; double-stranded, circular
  misc_feature (B) LOCATION 1...519
  hypothetical: NO
  anti-sense: NO
atggaggagatgtctatgcggtatgtatcaaaatttttattagggatttatttattctttctattatggttgattttattcaagctatcatttaatcttccacaatttctcacttattcttacagcaatgtcaatctcgtccctttttctactttttcttttgaaaatacgacggtattacgtgagaccacttataacttgattgtcttttttccttttggggtgcttttgaatgtcaatttcaagagactttctttttctaaaaaattagggattattttccttgtaagcttcttggcagaattgattcaattcctattcggtattggcgtagcggacatcactgatttgataactaatacaacaggaggactgataggtttatgggcctatcaacttctaaacaaacatctatcgacaaataagttagaccgtctagccattattttgggatacattttattcttatttctgatcgtagcttttttatttttgacccgaactgtccgtcttcaataa

SEQ ID NO: 3245 - DNA (genomic), 267 bp, Enterococcus faecium; double-stranded, circular
  misc_feature (B) LOCATION 1...267
  hypothetical: NO
  anti-sense: NO
tatttttggataggaaatagcttgattgttcgcaaagaaacattaaaaaaaccaatgctgaatgtctatctccaaaataaaatatctgggattcatattatgaatacggctgtcagcggcaataacagtcaagctctacgagaacgctttgccaaagatgtacttagctatacagcagataaagtatttattctcattgggacgaatgatctagcagagcataaacaactttctaaagaaacgtaccaaaaaatctgcagtggatga

SEQ ID NO: 3246 - DNA (genomic), 219 bp, Enterococcus faecium; double-stranded, circular
  misc_feature (B) LOCATION 1...219
  hypothetical: NO
  anti-sense: NO
atttgttggatttcctttaacgtttttaatcggttatctcctttttgcccatctgctagaggacgaaaccacatgtccattttcaatcccataagtacagctggaacaacacaaatcgtagaaacaactaaacgtgtgcctaaacttgttgttggggtcaaaggattccaaaaaccagttgaatcaaaatggaataactgcggcatttcttgtaactga

SEQ ID NO: 3247 - DNA (genomic), 306 bp, Enterococcus faecium; double-stranded, circular
  misc_feature (B) LOCATION 1...306
  hypothetical: NO
  anti-sense: NO
aagagttggatgtacatggtttatgatgagttgattggagaaatttattgggtgattggaaagattcagtcagacccagaattagaagaacaattgcgacggttaaaatttgatattcgcaagaatggtgtcaaagtcgctggcgatccatatttaatgaatgaggagacggatgctcgaattgaaataaatcaagtaattgcagaatttgagcggattgcggaccaagcaaaagaaccagatattcgtcaatacttgttagaaatgaaagcagagttggaagtaaatggtattacagatgagtaa

SEQ ID NO: 3248 - DNA (genomic), 270 bp, Enterococcus faecium; double-stranded, circular
  misc_feature (B) LOCATION 1...270
  hypothetical: NO
  anti-sense: NO
tttttctggattttcagtttcattatctgtgtctggatttgtttccggtactgtttggtttccagaatccgtatctggttctggagttacatctggtttttcttctggggctacctctggtttttctggattttcagtttcattatctgtgtctggatttgtttccggtactgtttggtttccagaatccgtatctggttctggagtcacatccggtttttcttctgggtctacatctggtttttctccaggggttatttcaggttttga

SEQ ID NO: 3249 - DNA (genomic), 294 bp, Enterococcus faecium; double-stranded, circular
  misc_feature (B) LOCATION 1...294
  hypothetical: NO
  anti-sense: NO
gaaatatggataaaggagggaaaggagatgctgaattttttatggtcgttatttatcggcggtatattaggtttgatagctggcgcaattttaggaaaggaagtcccgggaggcgtatctggaaatatcattatcggttttttaggtagttggctcggcgaatttttactaggaccactgggaccggaactcggcggtttttatttgataccagcattattgggtgcaattttttgccttgctctttattcatttgtggcaagacgtatcagagaacgtccaaagaaagaataa

SEQ ID NO: 3250 - DNA (genomic), 1140 bp, Enterococcus faecium; double-stranded, circular
  misc_feature (B) LOCATION 1...1140
  hypothetical: NO
  anti-sense: NO
tgtaagtggatacaaaaacgaaaagatgcaggaggaaatggtaatatgggaaaattaggaatctcgatttatccagaacggtcaacatttgaaaaggacaaagcgtacttggatttagctcataagtatgggtataaacgggtttttaccagtttgctgcagatcaatgatgataaagaaaaagttctttcagaatttaaagaagtagttgattacgcgaatagcctaggcatggaagtaatggttgatatcaatccagcgttatttgaacagttggagatttcttacgatgacttatcttttttccataagatgggtgcctacggggtccgcttagatatcggattcacaggagcagaagaagcaaaaatgacgcgcaatccttttggtatcaaaatcgagatcaatatgagttcgggcacgaattacgttgacaacatcatgagttattcgccaaacacggataatttattaggttctcataatttttatcctcatcgatactctggtttaggatacgaacactttgttttttgttcagaaaaattcagaaaatataatttgaatacgatggcattcgtcaattcgcaatctgctgagtttggcccttggcctacgcaagatggcttgtgcacgctggaagaccaccgagatcttgaaattgcgacacaagtgaagcatttaatccttacaggattgattgatgatatttctattggaaatgcgtacgcaagtgaagaagaattgaaagaaatggcagaagcatttaacgcggattatcccacattgaaagtagatacggaagaaggtattacagaaaccgaacgaatctgcttgtttgataactttcatagttatcgaggggatcgctcagaatatatccttcgttcaacgatgactcgtgtatactacaaagataaagatttcccgcctcataatacgcgagatatgcatcatggggatgtactgattgacaatgaagggtacggtcaatacaaaggagaaacacaaatcgccttgaaggatatgaaaaacgacggacgtgtcaatgttgtaggaagaatctccgatgacgaattattcctccttgactttttgaaaccatggtcaagctttaaattaattgaaaataaaaaatag

SEQ ID NO: 3251 - DNA (genomic), 993 bp, Enterococcus faecium; double-stranded, circular
  misc_feature (B) LOCATION 1...993
  hypothetical: NO
  anti-sense: NO
atttatcggatggttcttcggaatcattctgggatcgcgtttgcaatctttcttgccttccagctttcccccagacctggagcattcttgatcaaccatatgttttcaaatactgttcacatcactgataaaagaacgttcgatcaagcagaaaaaaacgtggcgaaaaaaacagatttgacgtatgagtccaagtataaagagaatacttatgacatctactatccaaaaaacagcaaggggcctgttcctgttctattttgggtacatggtggaggattcgtcggcggagataaatcgggtgtcaaagaatttgcgacaaaattagtttcagacgccaacatcgcagtggttgcgatgaattatgaattagcgcctgattcagaataccctaatcaagttcttcaagtgaatgaactgatcaaagatttattagctgaagaaaaagacgacaaattgctagacatggaacaattattttttggtggagatagtgcaggttcacaaatcgcattgcaatatgcagctatacaaacgaatgatgcgtatgctaaacaaatgaaaatcaaacagctacttccaaaagatagtctgaaaggaaccatttcttattgcggacctgttgatttgaagctaacagcacagcagcattcggatgatcgatttatgaagtttttcgtcaaaaccgttgcgtggtcgttgattggaacaaaagattggaaaacgagtgagcaattgaaagaagctagtgtggctgaccatgtttctaaggaatttccgccaacgtatataactgacggaaatgcatactcattccaggagcaaggtcaagcattagaaaatcggttgacagaattaaaggtacccgtgcaatccttgttttatacagatacaaaaaaagagattacccatgaataccaatttgattacacgctaaaagaatcgcaaaattgttaccagcagacattggattttgtgaataagtataagtaa

SEQ ID NO: 3252 - DNA (genomic), 417 bp, Enterococcus faecium; double-stranded, circular
  misc_feature (B) LOCATION 1...417
  hypothetical: NO
  anti-sense: NO
cccgataggatatttcaaacttggagaccattggaggaatttgccagaaaaatttgttttaccaaaagtacacactggccaaaacagtttgatggatggaatacggatgttgcggagaaaaaagatgctcaattcaaccgtgccacagccatggaacatgacttatcgtctccgaattattatgcgatcaaaatcgcaccaggaatccattacacgatgggcggtgtgaaaatcaatacgaacactgaagtattagataaagaaaaccagccaattagggggttatatgctgctggtgaagtcacaggtggcttacatggaaacaaccggatcggtggaaattcagttgcggagatcattatttttgggcgacaagcgggcatacaagcagctcgatttgcttcggaaaatgaatga

SEQ ID NO: 3253 - DNA (genomic), 201 bp, Enterococcus faecium; double-stranded, circular
  misc_feature (B) LOCATION 1...201
  hypothetical: NO
  anti-sense: NO
aaagataggatggttgagatgataaaaaacggtttatttttatgtagtattggttctttgatcgtgttgtatagtttgaatccacattcgcaaaggtatgatttgtatagtatggtcacaggtctttttctaacaggattaggaatctatttcttcatgaaggggaaaaaaagagaagaagcaaaggagaaaaataactaa

SEQ ID NO: 3254 - DNA (genomic), 189 bp, Enterococcus faecium; double-stranded, circular
  misc_feature (B) LOCATION 1...189
  hypothetical: NO
  anti-sense: NO
ataaaaaggatcaaatatccgagtgatactagtattcaaagagggatgcagatggatcaaaaaagaattcatgtaggactgattactagttttgtcacgatgcttatttatttggatcaaggtcatttgacttggacagtagttggtgtcgtaggatttttgacattattcacagcaataaaaaaataa

SEQ ID NO: 3255 - DNA (genomic), 225 bp, Enterococcus faecium; double-stranded, circular
  misc_feature (B) LOCATION 1...225
  hypothetical: NO
  anti-sense: NO
aacagaaggatcatccgtctagttacgacgatcgaagataacgtgcttattggcgcgcaaatcggtggagtcggcgcaagtgatatggtctctgaattagctttagcaatcgaatcaggaatgaatgctgaagatatcgccttgacgattcatcctcatccatctcttggcgaaatcgtcatggatgcttcggaattagcattaggtttaccaatccatatttga

SEQ ID NO: 3256 - DNA (genomic), 933 bp, Enterococcus faecium; double-stranded, circular
  misc_feature (B) LOCATION 1...933
  hypothetical: NO
  anti-sense: NO
gaaagaaggataagtatggattttggaaatgaaacggtcttgaaagcaactggtataaccaaaaaatacggtgctgccaaagcattagataaagtatcgatcgaaatcaaacgtggaatgatctatggtttgattggggagaatggagcgggtaagtctacctttatgagaactattatgggtttgatctcgattgatgaaggttcgatcgaattatttggaacgacggatttgcaggcagcaagacgacgtatgggtcaatcgattgaaacccctgctctttatccagaattaactgcaagagataacctacgtatccaagcagcgaacggcggtgtgtcggatagagaaatcgaagacctgctgaaaatgatgcgattggaaaatacagggaaaaagaaagcaaagaatttctctttaggtatgcgccagcgtttagctattgcaaatgcactgatcacgaatccagaatttttgattttggatgaaccgacgaatgggatggatccagcagggatggcagaaatgcgagaaatcatccaacgtttggtaaaagaacggggcatcaccgtcttgctttctagccacttgctagatgaattgtcacagatcgccactcactacggtattttgcatgaaggacacttgatcaaagaattatcgaaagaagaattggcacaagaatctcgtcaatttataaaaattgacacttcggcgacggaacaagcagtaacggttctcgactctcttggttatagggattattttgtccaatctagccgtgttatccagctttttgaaggaattgaccaagtagcagccatcaatcaagcattggtagaggcaaaagttcctgtggatggtatccacctagttgggcaaaaactggaagattatttcttacaattaactggaggcaatccacatgtttaa

SEQ ID NO: 3257 - DNA (genomic), 534 bp, Enterococcus faecium; double-stranded, circular
  misc_feature (B) LOCATION 1...534
  hypothetical: NO
  anti-sense: NO
aaaggaaggatcattgtgcaggatacagtaaaaaggaaaatcgaattagaaaaaaagcaacttagtttgaaaaacatgtatttcaatcgttatctaatcgtacgttacctgactgcctttttctttttcatgaacatgcaatggatgattctgcttctatcagctaaaagtttaggaagtagtttaccgatgattctgattttagctattttgcctgcagtaggagaacaagtaaagctttatcgaaaacaccaaacgaacgttccatggacaaagtggtattttttgttccagagtgtctttaatttattagtgattccagtgttgtttacctcaggatttacattcttgtatccttttatggcaaataacaatggaggacagttatttgttttcattcttgttgtaagcggtatttttgccagtgcatttatacagtatcgtttaaagaaaatttcactcaaccaagaccaacagtatatccgtattaaacaatatgaaaaagcgttatatttaggaaaggagaataactaa

SEQ ID NO: 3258 - DNA (genomic), 1446 bp, Enterococcus faecium; double-stranded, circular
  misc_feature (B) LOCATION 1...1446
  hypothetical: NO
  anti-sense: NO
catatgaggatatttaatagaggaggaataaaaatgaatgttaaatcaaatgtgcagaagcttggaagagcgatgctatttccagttgcagcgatgccattagcgggattgatcatgcgtttatcagctgacgatatgctgaacatcccagtaattggtgcagctggaaatgccgtttttggaaacttggatatcttatttgctataggagttgcaatcggttttgtcaaaaataaggacaaaggaatacctgcacttactggttttttagcgattgctaccttgaaaaaaggcttagaaattatggacccagaagtgaatatggggatttttggtggaattatttccggtttagtagcggcatggacgtataatcgctttaaagaacaaaaattaccagtagttttttcttattttgcgggcgaaaaattcccattgactatggtgatgattctacaaacaatcgcagctgtttttttgggctttatctggccgctcatccaaattgggattgataattttgcaaaactgctcgttgatatgggagcattaggtgtggggatatttatgtttttgaatcgtttgctgatcccctttggactgcaccatgtgttgaatacgtatatttattacgatttaggaagctatacatctcctagcaaggaagttttcagaggagagatgacacgctttatcaacggagatcctcaggctggactgtttttatcaggtttttttgtagtaatgatgtttggtataccagctatatgtctagctatctataaagcagcttataaagaaaataaagagatggtcaaaggaatcatgggaagcggtgcaggaacttcatttattgcaaatatcactgagcctgttgaatttagtttcatgtttctttctcctatgttgtacgtgatccatgcactttttgccggtttagcagggattgtctgttacttattcaatatacgaattggttttacattcggagcatgtattgttgattatctcatcaattttcgaatcgctaccaatgctattttgattcttccaatcggaattttcttttttgccttgtattacgttactttttattatttgatcaataagagaaacattcagacattaggacgtgaagctaaggcagagtttggcaatgaagtaaccttagaagaaacagagttagggttagcaagtaaaaattatgaatatatggcaacaaaaatgctacaagcgtttggaggaaaagccaatatcctggatgtctatagttgtaatacacgcctacgggtagaggtagtggatcccaccatggtcgaggaacagcgaatcaagcaattagggataagcgggatcattaaaccaactgaaaaaaattatcaaattatcatcggcttagaagtgacttatgttatggcagaattcaataaattattagaagaatag

SEQ ID NO: 3259 - DNA (genomic), 1131 bp, Enterococcus faecium; double-stranded, circular
  misc_feature (B) LOCATION 1...1131
  hypothetical: NO
  anti-sense: NO
gaggtgaggatgatggagctgcaatttcctttacataatgatacatcaagaaaaatcattcatattgatatggatgcttttttcgcttcggttgaagaacgagatcatcctgagtttcgcggacatccattagtaattgccagacaccccagtgacactggtgggcgtggagtagtgactacagcaaattatgaagcaagaaaattcggaattcattcagcaatgagtgcacaaaaagcgtatgagctttgtccgcaagccatctttaagcctggcgaccatcataaatacagcgatatttccaaacaagtacgggaagtattctatcgttatacagatattgtggaaccagttagtatcgatgaagcgtatcttgatgtgaccgaaaataaaatcaattgcaagtcagccatcaaaatcgcccgaatgatccaagcagatatttgggagagtgtccagctaacatgttctgcgggagtaagttacaataagtttttggccaaattagcatcagactatcaaaaacctagaggaatcacggtagttgcccctcaagacgctgtgccatttttaaaagctttgccaattgaaaaatttcatggggtagggaagaaaactgtacctagaatgcatgagctagggatttatacaggaaaagacctatatgaatgcacagaaatgatgttgattcgaaattttggaaaaatgggctattctctttatcgtaaagtcagaggaatccatgattctccagtaaacgttacaagagagcgaaaatctgtgggaaaagagcatacttatgggcagccgttgcaaacggaagaagcagtgctgactcagttgcgccaactagctgaaaaagtagaagaagcactgagaagagtccaaaaacatgggaaaacagtagttttgaaggtcaggtacacggactattctactgtgaccaaaagagtgacattgccagaatatatctataaaaaagaagcactcttttatcaagcaagccttatatgggaggaaatcttgggagtagaaaaagggatccgattgttagggattactttgacgaatctggacccgatgacttatgaaaacatcgtccttccattatgggaaaatcaagaaatataa

SEQ ID NO: 3260 - DNA (genomic), 873 bp, Enterococcus faecium; double-stranded, circular
  misc_feature (B) LOCATION 1...873
  hypothetical: NO
  anti-sense: NO
gagaagaggattcaaatggaaaatcaaaataaattgtatcattttgttggtatcaaaggttcaggaatgagctccttggctcttgttttacatgaacaaggtctaaatgtccaaggatcagacattgaaaaatatttctttacacaaagagatttagaaaaagcaaatatcacgattctgccatttaacgcagataatgtaaaaccagggatgacgatcattgcaggaaatgcatttcctgattcacatgaagaaatccagcgagcaaaagaattaggtttggaagtgattcgctatcacgactttattggtcattttatccaaaattatacgagtatcgctgtaacaggctctcacggaaaaacaagtacgactggactgctctctcatgtattgagtggtgtccgtccaacaagttatctaattggagatggaacaggacatggtgatccgcaagcggaattcttttcatttgaggcctgtgaatatcgccgtcatttccttgcctattcaccagactatgcaatcatgaccaatatcgattttgatcatccggattattatacaagtatcgacgatgtatttacagctttccaaacaatggctggacaagtgaaaaaagctatttttgcgtatggtgacgatgcttatttacgcaaattaaaagcaaatgtgccgatttattattatggtgtcacagaaaacgatgatatccaagcacgaaacatcgaacgcacaacttctggttctgcttttgatgtctatcatggggatgaatttgttgggcacttcactgtaccagcattcggtaaacacgatatcttaaatgctttaggtgttattgcagtagcttatgtcgagaaactggatctg

SEQ ID NO: 3261 - DNA (genomic), 840 bp, Enterococcus faecium; double-stranded, circular
  misc_feature (B) LOCATION 1...840
  hypothetical: NO
  anti-sense: NO
tcaaggaggatggaaatggtagaagtagtaggtgtccgatatagagatgcaggtcatatctattattttgcaccaggagactctgaatatgtttataatgacaaggtattagtcgaatctcagcaatccttacatattgctactgttgtccttcctaaaaaagagattgatcccaatgaccttcctgaagctatccgtccgatcttgcataaagcgtcacaagctgaattagaaaaagacaaaaaaaacaaaaaagatgctcatgatgcattgaaaatcgcaaaagaaaaagtgcagttgcgtgagttggaaatgaaaatggtcaaagctgaatacacatttgatcgaaataaattgattttttctttcacggcggacgggcgaattgactttagagaattggtaaaagatctggccactgtatttcgtactcgtattgagcttcgacaaattggtgtccgcgatgaagcaaagataataggcggaattggtccatgtgggcgtccattatgctgttcttcttttttaggcgatttcgtgcctgtatcaatcaaaatggcaaaagatcaaagtttatctttgaatccaacaaaaatttccggtttatgcggacgcttgatgtgctgtctgcaatatgagagcgaagaatacgagacagcgaaaaaagaactccctgactttggaaaagtaattgctacacctgatggtaaagggaaagtcgtagggttgaatctgcttagccgtatcgttagtattcggctgactggacgggaaaatcctgtcgaatatgaatgggatgaattgaaagaatttatccaagtaggtgagatgaatggataa

SEQ ID NO: 3262 - DNA (genomic), 303 bp, Enterococcus faecium; double-stranded, circular
  misc_feature (B) LOCATION 1...303
  hypothetical: NO
  anti-sense: NO
gttgttgggatgaaattaacggtaacgccaaaagcacaaaagtggtttgactcagaaattgatctgccagaaacttacggaatacgtttttttggaaaagtctacggcaaaacagaggttcatgatggtttttcgattggaatgtcagttgaacagccagaacatcctgtaaagaaagtggaaatggatgggacacttttttttatcgaggaagcagatgaatggttctttaaaggatatgatttacttgttgattatgatcccaacctggaggagccaacctatcactttaaaaaacaataa

SEQ ID NO: 3263 - DNA (genomic), 216 bp, Enterococcus faecium; double-stranded, circular
  misc_feature (B) LOCATION 1...216
  hypothetical: NO
  anti-sense: NO
caaagtgggatgcgattgggcgaggtacaggacaagatacaaaattgtggcctacggatccgtttcgttggtcatcaagctgaatatacattaaaaacacctgctgaaaaagggcgtctcgaaacaacggatacctttataacagaagagagcagaagcatttatcttcgaaaaacgtctgcctcgttcaggcgcagtttttcaaaaactttctga

SEQ ID NO: 3264 - DNA (genomic), 1761 bp, Enterococcus faecium; double-stranded, circular
  misc_feature (B) LOCATION 1...1761
  hypothetical: NO
  anti-sense: NO
aaaagggggatccttatggcatatcaagcactttatcgagtctggcgttcgcagcgtttcgaagacatcgttggacaaaaagctgtgacacagacactaaaaaatgctattgtttcccacaaaacctcacatgcctacttgtttacaggacccagaggaaccggaaagacgagtgcagcaaagattttcgcaaaagcaatcaactgtccgaacagtaaagacggcgagccatgcaacgaatgcgaaatgtgtcgatcaattactgctggtacgcaagaagatgtgatcgaaatcgatgctgccagcaacaacggagtcgaagaaatccgatttatccgtgatcgggcaaattatgcgcctacaaaggcagcgtacaaagtgtacattattgatgaggtacatatgctttcaacaggagctttcaatgccttgttgaaaacattggaagagccaaaagaaagtgtcatattcatcttagcaacgaccgaacctcacaaaataccagctacgatcatttcacggactcagcgatttgattttaaacggatcaatacggcagatattgtcgaacatcttgaatttatcttgaaagaatcgactatcagctatgaaccagctgcattgaatgtgattgcccgttctgcagaaggcgggatgcgggatgcattgagtattcttgatcaggcaatctcgtttagtgaaggaacaattactttagatgatgccatgcaagtgacaggtagcttaactgacgaaatgatggacagttacttgagtgcttgcgtgaaaaaagaagtaccagaagcattggaaacattgaaccaaattctcgcagccggcaaagaatcacgtcgctttctagaggatatgttacaatactgccgtgacttgctgatgtatcagcaagcacctaacctagttgaggaacaatcgagtacgatcagaagtacatttacagaattgacacaaactgtttcagcggatcagctgttttcaatgataaagattttgagcgatactcaaaatgaaattcgttttaccaatagtgccgctatttatttggaagtcgctacagtcaaacttgcacagctaccgtctgcttctgttccttcagcagatgtagcatttgcagatgatcagatagtaaaacagctacaacaagagattaaggaactaagaaacgaaatcaaggaactacgcagtaatacaggaattgagaatacaaaagtacagccggtacagcaaacaaatcataaaaaacagacaagtacctatcgtgtaccgacggaacgagtatataaagttctgcgggaagcgacaagacagcatctgaaccaagtaaaagaagtatgggaagacttgctgatgagtctatctgtcactcagcgagcaatgcttaaagcaagcgaaccagttgcagctggacctacaggactagtgattgcgtttgattatgagattgtttgtcaaagagcagcaaatgacgaagaattgcagctttcggtacacaacaacttaagccgaatgatcaaagattatgcgcctgatcctgtttatattacaagagaaagctggccagaacttcgaagaaattatttgacgcaggcacaagaagagggaacagaaaactcttttgcttctgaagactcagaaggagaaatcgagttgcttcctcaagaacaagaagtaccagaagacacacttgtagtaaaagcagaggaactgtttggctccgaagctgttacagtggtagatgattaa

SEQ ID NO: 3265 - DNA (genomic), 309 bp, Enterococcus faecium; double-stranded, circular
  misc_feature (B) LOCATION 1...309
  hypothetical: NO
  anti-sense: NO
cgaggggggataaatatggaattaaaaattgacaaactcacgcttgatgatccagcttttaaaattattgacgatcgagttgttcaacaagtagagcaaactcaaggaacgttactttcattattagaaaaaaagtaccagtttccaaaatatatgaacaaggcacaagctgctaagtatatgaacgtttcatacaatactatgatgcagaaatatgttcctaacggtttaaagttgattatagttgatggagtcgtaagaatttcacaagatgaatgtgatcgctttatggaagaataccaaaaataa

SEQ ID NO: 3266 - DNA (genomic), 2130 bp, Enterococcus faecium; double-stranded, circular
  misc_feature (B) LOCATION 1...2130
  hypothetical: NO
  anti-sense: NO
gctgcagtttttttagcaaggagggaaaagatgactattaatgaagtaatttattcacccaaacacccattttttaatgctgagttaaacgacggaaatgtgactacttcaaacgaatacagctactatcggaatattcctgatgtaaagggattgaccttcgatgtaagtaatcaaaagacattagcaaaccttgatgtttgcgggacgattcaaacgttgaccttttatcgagaaaatttactaactgaggaaaaaccaggtgtttgggtcaataaacagctctctcaaaccaattcgttatccttaaaggttgaagtaaacgggattgtctaccatttgtcagaatcggatcatcgtattgaagtcgatgtgattcaagactgtttgcctagatatattcatcattattcgacgtttaaggtcattgtagtatcctttgctcccatactggctaataagcgtttaagtatgcttgttcaacaggtttacattgtgaatgaaacacacgaaagccttcaagtttcagtgaaagatgtgccttcgtatcaagagaagtattcggatcagcaaaatgtgttgatttctcaaaaaggaaataaggacacgatcgcacaacaggaagtggcaagcttcgccattgcttttgtggacccaaatgcttttgaagaagtaatgacttttcaggaatctgatatcgaaaaatggctgaaggaaacattgaactattttgctcagctatttgggcagctgtcaatgccaaacgatagagttgtccatctctatcgtcgtgcactttatcaaagcttttctagtttcggtatgaatcgacagggacaggtcgtcggcagcaattggggcagctatcctgctactaatcgaatttggaataaggatatgtattacgcatcattgccattcaccatgtttgaaccggagttatgtcaaaaaacggttctatggtttgatcaatatggcgttaagtttcctggttcaaaatttacaggaggtatcaatcattctctgagtaattcgttatccagtgcgttactggctagtctttattttgaacatactggggatacaaaattctttgagcggtgtccgcaggttctactgaatgcttcaagaattattgaggacatattagctcaacgtcggtcaggggaaccaatgctttttccatctgtttggttatcagacgcctttgcacttggaaagtatcataccggcagcaatctttgtctttggaaggcctgtattggacttgcagaaatttttgaagccctagaacaactgagtcttagcaagcgatacaaaaacattgcctgtaaactaaaggaatcaatttgtaaacaaatgactatcgatggtccttttggtgagcaatttttggagggaatcggtgatgaggagaaaacaacctattcagtgaagcactatcaaaaaccgattcttgagcaagggttaatctttttaagtgatgtgattgtggatggaaaaattaatttattgatgcatgatggagaagaatcagacactacgttgatgcctttttatcaatttttagataataaagatcatttatatcagaacaccatggccttttctgctagttctttcaatccaacctatagcgaggaaatcaaaggcatcacttggggattagaatccggcgccacttttcctggctttatcactgttttaatgagcgagctgcacaaccctcaagctttcgtaacccgattagaagaactaatttgtttggcagatttagacggttcgtggtggtggtggccgtatcgcttagaggctcaacaaggagaagtcgtgcgagactttggctgcggcaaatgcggctgggcatcgggtctttttgtcagcctaatgatcagtcaatatttcggattgaaattcaaaaaaggagtattgcaaattgatcctgttgataatttaacgttttcttggaagaatttgaagttcggtcaagccttcatttcgattgaatgtacgcaatccgagttgagtatttcaaatttgtcagaaaagccattgaaaataagtgatacgaaaaaaattcttcacgtagaaaagggaaaaacgattcacattcaaaggagaaaaagatga

SEQ ID NO: 3267 - DNA (genomic), 624 bp, Enterococcus faecium; double-stranded, circular
  misc_feature (B) LOCATION 1...624
  hypothetical: NO
  anti-sense: NO
gtaaaagttttgagagttgcatacatacgtgtctcatcgatcgatcaaaatgaacaacgccagattgaagaaatgaaaaaattcggtgcagagagaattttcatcgagaaacaatctggcgcaacgattactcatcgacctgttttccaagaagcattagattacgtccgagatcaagatatttttattgtggaagctattgatcgacttggaagaaattatgacgagatcatcgcttcagtcaattacttgaagaagaaaaatgtgaagctgatcattactagtttaccgatcatggctgaagcaattggcaatcctctcctggataaattcattaaggatctgatcatccaaattttggccatgatcgctgaacaagaacggactgaatcgaaacgtcgccaggcacaaggaattaagatcgcaaaagcaaacggcgtctacaaagggcggcccaaattatacagtgcagacgcaaaagatccccaacgtcgccttgtttacaaaagcatcgttgaagatcttaaaaatggtgttgcgattgctaagattgctaaagactacaatgttacgagacaaaccgtgtatagaataaaaaaagacagcatggtcaatgacaaatag

SEQ ID NO: 3268 - DNA (genomic), 207 bp, Enterococcus faecium; double-stranded, circular
  misc_feature (B) LOCATION 1...207
  hypothetical: NO
  anti-sense: NO
gatttttactttattaggtatacaatgcctatcattttcttttatttcctatatcattgttttaattttcctcagtttcatagtatggatgttttatcttgtcaaaaaataaatgaatgtttcatgaacagtacttcatcacagcctaatttttttctttatgctatcgttatattaaagaaatcaatcagaagggaaagaaagtga

SEQ ID NO: 3269 - DNA (genomic), 711 bp, Enterococcus faecium; double-stranded, circular
  misc_feature (B) LOCATION 1...711
  hypothetical: NO
  anti-sense: NO
gaaaaagtttttttgttttgtctgaaaggaggcagatggatgaaaaaatggttatttggttttttaggagtcgctttaatcgtcttttgcagtgtgtttggctatgttagctaccaaaaacatgaaggagaggtgtttaagcaaaatatagaaaaaaagatgcccatagatcaaatcaatgaacatgcaaagagttataaggaggatgcaacgaacgttaataatgatatgtctttgggacaaatgttgtccatacaaaaagaagcaatcgaaatgggcgtcaataaacaagcctttgcacaaattcagattcctgcgcttggtttaacattgccgatttttaaaggtgcaaatcaatacacattgagtcttggtgcggctacttatttttatgaggatgccgaaatgcgcaaaggaaactatgttctagcaggtcataacatggaaattccaggtgttttattttctgatattcaaaagttgtcactaggggaggtgatggacttagttagtaacgatggcgtctatcgttacaaggtaacgcgtaaatttatcgtacctgagtactttaaattaatcgatggcgttcctgaagagaactctttcttgtctttaccaaagaaaggagagaaacccttattaacgttgtttacttgtgtttatacgtcacaaggaaaagaaagatacgtggtacagggagagctacaataa

SEQ ID NO: 3270 - DNA (genomic), 909 bp, Enterococcus faecium; double-stranded, circular
  misc_feature (B) LOCATION 1...909
  hypothetical: NO
  anti-sense: NO
ataaactactttggggtctttacctatatggatccagaaggtgggagcaatgtttcgacccatcccattaagaaggagaattatatgaaaataatgacgttgaatacgcatagttggttagaagaggaaccacaagaaaaattaaaacagatcgctcaaaaaatctgtcatgaacaatatgatgtgatcgcattgcaagaagtcaatcaaacgatggacgcaaaacgactaaccagtgagcagctgaagaattttagtcaggtgcaggaacaaacgcctgtccgctcggataactttgcctattgcttgatccagctcttagcagaacaaggtgaaacttactattggagttgggaaatgagtcatatcggctatgctatctatgaggaaggcaatgcgcttctttccaaacaaccactaactagtcaaacgcacctagtctccgaaacaaaagaaaaagaggattaccatactcgaaaaatattagtaggtcaaacctctgtcaaaacacaatgtattactgtagcaagttgtcatttttcttggtgggtagatgaaaaaagcggatttgcatttgagtggaaagaattagaagcaagtttagcgcctcttacaacaccactgtatctattaggggatttcaacaatcctgctgaaggcagcgggtacgatttagtggcaaaaagtcagttgcctattcgtgacgcttatctaatcgcgcaaaaaaaacaagctgaagcaacgatcgaaaagagaatcgatggctgggaaaacaataaagaggggctacgtatcgactatatttatgtaccacaagattgctttgttacaagttatcaacgtatttttgacggggaaaatggcccgattgtcagtgatcattatggggtagcagtcacgttggagtga

SEQ ID NO: 3271 - DNA (genomic), 1023 bp, Enterococcus faecium; double-stranded, circular
  misc_feature (B) LOCATION 1...1023
  hypothetical: NO
  anti-sense: NO
aaaggagtttttgaacttatgacaaaatatatttttgtgaccggcggtgtcgtttcatcaatcggaaaagggattgttgcagcttctttaggacgcttattgaaaaaccgcggcttaaaagtaactatccaaaaatttgatccatacatcaacgtggatccggggacgatgagcccatatcagcacggagaagtattcgtaacagatgatggtgctgaaacagatttggatctgggccactacgaacgttttattgacatcaatttgaacaaatactccaacgtgacgacaggaaaaatctattctgaagttttgcgtaaagaacgtaagggcgaatacttgggagcaactgttcaagttattcctcatattacaaatgagatcaaagaaaaaatcatgcgagcagctaaaatgactgattcagatgtgatcattacagaagtagggggaacagtaggggatatagaatctttgccattccttgaagcacttcgtcaaatgaaagcagatgtcggtacagataatgttatgtatatccatacaacattgattccttacttgaaagctgctggagaaatgaaaactaaaccaacgcagcacagtgtaaaagagctacgtggtttaggtatccaaccgaatattttggtggtacgtacagagcaacctgtttctcaaagcgtgaaaaataaattggcacaattttgtgatgtcgaaccagaagcagttatcgagtcgccagatgtagatacactttactccatcccattagttttacaagcacaaggaatggatcaaattgtttgcgaccatttaaaactagatacaccagaagcagacatgacagaatggaaagaattagaagaacgtgtcttgaacttgaagaaaaaagtacggattgcgcttgtcggcaaatatgtcgagttaccagatgcatatatctcagtagttgaagcattgaaacacattctggtttcgcctataattcagacatcgagatcgattggatcaaagcacaagaattaa

SEQ ID NO: 3272 - DNA (genomic), 825 bp, Enterococcus faecium; double-stranded, circular
  misc_feature (B) LOCATION 1...825
  hypothetical: NO
  anti-sense: NO
ggaggagttttcatggagatagacaagcaagcagtcggcaatcgaattcggcagattcgccaagaattaaagttgagtatggagaaatttggcaaactaattggtgatttaccgcgaagtacagtcaataactgggaacgtgggatcaaccttccaaaaaccgaaacccttcaccaaatcgcagagataggtcatgtcaccaatgaatatcttttgtatggtgatcaagagaatcaatacattttagaaatgctccaaaaaaaggcaggtaagcttgatcctaagattgaaggtctcatagtagacgaaatcaaacacgctgaccttgttagtgaaaaagaaatggatcgaatgattgaattttttattacaaatctcattccaccaactgaacaagaccagtttactttccaatgtatcgatgaaaaaaagcagctttatcttggttcaactaattttggtaaggaagcccagctctatttgcaacatgataatcaaaatcatattctgcacatgatgccctttaccttctccaactttagtgtggatcgcatactcgtctatttagcaaatcaaaaatcctattcctattttgggaaacatttacccaaggaactaggtgagaaagccatccttctatactcaattaatcaattgaccagcgatgtgcgaattgccccgttggtctattcagaagaaaccgcttcttatcagtacacagaggacaatcaatatctactagaacagcaatatctttatctaccattcgtgatggaagtcgagaaagaacgcctgttaaatgcagcgtatccatcatcaaaatga

SEQ ID NO: 3273 - DNA (genomic), 663 bp, Enterococcus faecium; double-stranded, circular
  misc_feature (B) LOCATION 1...663
  hypothetical: NO
  anti-sense: NO
gtgatgtactttcctctaattgatttttccctcatgtggacttcacttcctttcgtactgcaaggcttggtatacacattagggattggcttcgtgtcgtttcttttaggaaatttggtagggttgcttttgacagttttaggtcttttggattggctgcctctgaatgtatttattcgtttttatttatcgttctttagaggcattcccgcactagtcctgctgtttctgttatatttcgggttaccttatcaattaagtgccttaacggcttcagtcatctgctttacgattaccagcagtgcatttattggtgaaatctatcgaggatcactagcaggcgtttcttcaggtcagtgggacgctggtttagcttctggtttttctttctttggggtattgaaatatatcgttttgccgcaagcttttcgaatctcagtaccggcactcagtaacgtagctatggatctagtgaaaggtacttcgttagcagcaacaatcacagtgccagaaatatttcaaaaagcaaagatcataggcggtcggacattcgattatttttctctctatattttagttgcactgatttattgggtcatttgtatcgggatcgaaaaagtgcaacagtatttagaaaaacgttctatccatcagtcaatctga

SEQ ID NO: 3274 - DNA (genomic), 236 bp, Enterococcus faecium; double-stranded, circular
  misc_feature (B) LOCATION 1...236
  hypothetical: NO
  anti-sense: NO
aaaaagtacttacgagaaatttttaaatgtgctacgatgattttcgtgacaaatttaaaggagtggtacagattgcctacaaataaaaaagaaggaataatttttacaacaatgatgtgttttttgatggtcttggggatgagcgcgtataatttatggctgcatcaagatcttcatttatcaagtttgttgattggtctagtgcctggattcgtggtggctttcattttggatgt

SEQ ID NO: 3275 - DNA (genomic), 1785 bp, Enterococcus faecium; double-stranded, circular
  misc_feature (B) LOCATION 1...1785
  hypothetical: NO
  anti-sense: NO
aactttcacttatgtttttcttgtaaaattcataaatattttcatgaattttctaatttcttgcctacctctcgcataggatatatgatgaatttatctaaagtttgcaaaggagttcgacaattgaaaaaatatggcccatttttagcaatttttttcattgctttggcatttctcatgcctcatttattcacacataaactaattttgggtgctgatgccccattccattacaatcggttctatgatgccgcgcaacaaattaaatatggggatttccattattttccttccctttatggattccagcaaagtggcaggatcgtgaatgccgtttacggcccatttttcgcttatttacaaggattgatcgtgttgcttgcaggtagctggtttcattatcagattctttcaaatttcattctttatcttatttcaggattttctatgctgattttactgagatatgtcaatgttcgaaattgggtaagtgtaccagtagccgttttattcatgagtacgtattctattcaatactggtctatcaaccaaggattcactagctgggggacttgtttttatcctttatgtatgatccctattgctgatttcgtccttcataaaaagttccctgttatcaaagtcgctgtctcagtgggacttatgacacagatccatttactgtcttcgatcatgttagctttgatgtatatccctttttatctttattacttttttaaccagactgaaaaaggaaaagcactgcttcaactgattaagtcggtcttgctttattttgttctgacagcaaatatttgggcaggattagctattgtttacagtgggaataagattcttcctccctttgttaacagagaaatgagtcaaaaggcgatagatctggatggcagttattggctccattaccctaaggcctttcctatattgatattatcaggttttttgctttttattttctttcaacaaaagaacaccttattccaaaaaatcgtgttgtacacaagtcttgttttcttttttctttctactagcttgattccatggacgacattgatcgaaaaaaatgtgccttttattagtttgatccagtttccatttcgatttttcgtgccatttacgctattgcttctactttaccttgccctttcactgaaccagtggtctgaacaaaagtggttccgtcttttaagtatatttggcattcttattttttcagcacagacgatccagaacttataccagcatctggaaaagtgggaaaatgaaacatttgtcagtcgacatacttatctattcgatacgccggaagaagcaaggaaaacattcttcagcaaagatatgtctaccagcttgttcgttttccaaaaaaccacacctgactatctgccaatctataaggagacaaaagacaataaatacgaccggtataacgaagaaatactagaaaacgaaacaacttttataaaaacacatccaggcggtcttttgacaatcaagtggaaaaacactggggacaaaactgttcatatccctgttatcgtctacgatcggactgtgctacagcaaaatggaaaaacattgactgattatgaagtaacagatatcgggaccccaatcgtgaagcagcaaaaaggaatcaacgagctcacgcttcattatcaaacgccaatctatttctatttcattctttctcttactttgattggctggtttaccttgctatgtttatttatttatcatagatacaagcttttacgtgcttag

SEQ ID NO: 3276 - DNA (genomic), 1608 bp, Enterococcus faecium; double-stranded, circular
  misc_feature (B) LOCATION 1...1608
  hypothetical: NO
  anti-sense: NO
aacttacactttcaattaaagaaggagacgttaattatgagtaaaattatcggtattgacttaggtacgactaactctgcagtagcagtattggaaggaaacgaagcaaaaatcatcgctaacccagaaggaaaccgtacaacaccttctgttgtatcattcaaaaatggagaaatccaagtaggggaagttgcaaaacgtcaagctgtgacaaacccaaatacgatttcatcaatcaaacgccatatcggtgaagcaggttacaaagtagatgtagaaggtaaatcatatacaccacaagaaatctcagcaatgatccttcaatatatcaaaggattcgcagaagactatttaggtgaaaaagtcgaaaaagcagttatcactgtgccagcttactttaatgatgcacaacgtcaaccaacaaaagatgctggtaagatcgctggtctagaagtagaacgtatcgtcaatgaaccaactgcagctgctcttgcctatggtttagataaaacagatcgcgacgaaaaaatcttagtattcgaccttggtggcggtacttttgacgtatctatccttgaactaggagacggtgtctttgatgtattgtcaacagctggcgacaaccatctaggtggggacgactttgataacaaaatcatcgactacatggtagcagaattcaaaaaagaaaacagcattgacttgtctcaagacaaaatggctttacaacgcttgaaagacgctgctgaaaaagcgaaaaaagatttatctggcgtatcaagcacacaaatcagcttgccatttatcacagcaggagaatctggaccattgcatttggaaatgacattgacacgtgcaaaatttgatgaattaacagctgacttagtagaacgtacaaaagtaccagtacgtcaagcgctaaaagatgcaggtttatcacaatcagaaatcgacgaagttattttagtcggtggatctactcgtatccctgcagttgtagaagcagtacgtaaagaaacaggtaaagaaccaaacaaatcagttaaccctgatgaagtagttgctatgggtgctgctatccaaggtggcgtgatcactggtgatgtgaaagatgttgttttacttgacgttacaccattgtcattaggtatcgaaacaatgggtggagtgttcactaaattgattgaccgcaatacaacgattccaacaagtaaatcacaagtattctcaactgcggcagataatcaaccagcagtagacatccatgtattacaaggtgaacgcccaatggctgctgacaacaaaactctaggaagattccaattgacagatattccagcagctcctcgtggtattccacaaatcgaagtaacattcgatattgataaaaacgggattgtaaatgtatctgcgaaagatctaggtacacaaaaagaacaaaaaatcacgatcaaatcttcttcaggtctaacagacgaagaaatcgaacgtatggtaaaagatgcagaagcaaatgcagaagcagataaagctcgtaaagaggaagttgacctacgtaatgatgtagatgcattgctattctctgtggacaaaacattgaaagaatta

SEQ ID NO: 3277 - DNA (genomic), 1206 bp, Enterococcus faecium; double-stranded, circular
  misc_feature (B) LOCATION 1...1206
  hypothetical: NO
  anti-sense: NO
tattctaacttgaaaggaggtgagaaagtggggatttttcaaaaggcggtaggatacttcacaaaaaaagcaacggttcctttagaagaatacttttgtaaattgcaagttgattttgtgtatcgaaaatttgcgattgaaacttgtattgatttgattgcaaatgcgatgagtaaagcggaattcaagtcatatgaagatggaaaaaataaaaagaatgatctttactataggctgaatgtagctcctaataagaaaaataatgcaacagaatttagaaaaaaactgatcaggagattaatattctacaatgaagtattgatcgtttctccgtctaataattctagcgaaatatttattgcggatagttgggatgtcacagaatatgcattgaaagatgatgtgttttctcaagtgcaaattaacaacatagtccttgatagagaatttctagaaagtgatgttatctatataaaatacgcagatcaacaaattaggcaactagtcgatgcgtattatcaagcgtatgggaaactcatttctagtgccatgaatgtttacaagcgctctaacgctcgtagatacgtactgaaagggaatttattccgaccgcaagacaatacaacacaagatcaaatcaataaaatgatgacatcacaatttaaggcttttatggaagctgataatgcaggtgcggtatttcaattacaaaatgagtacacattagaagatttcagcggaaacttccaaagcaattcaagagatataaaaaacttaatagacgacatctttgagatgacagcagcagcgtttcacgttccgaaaaacctactaaagggagacatgagtgggttatcggatcaagtggacgcttttttaatgttcgaaatcataccgattgctgaacttattcaggatgcgtttaacgctagtctctatgaagtagaagaatacttgtcagggaattttgtacgtgtggatacaactatgatcaagattactagcttcaaagatttggttgacgctattgatgtaggcattagaaatggagtatttacaatcaacgaaggaagagaacgcgttggaaatgatcgctctgataaggcgatggcagatgaaatatttataactaaaaacaatcaacaagtatcgaaaggaggtgaggcgaatgacgacaatgaaaacatttctagcagtaaagaatga

SEQ ID NO: 3278 - DNA (genomic), 954 bp, Enterococcus faecium; double-stranded, circular
  misc_feature (B) LOCATION 1...954
  hypothetical: NO
  anti-sense: NO
acattttttttgcgtaacgaagaatcaatcgaaactctgcagcgtgaacaaggaatgaatatcaatgatttaaacttagcttaccatcttcagacaccgccaaaaatccaccgaggggatctatttcaacagggaaatattcatatcagtaaacaccgtcgatatgcggaagttcccgagcatacacatgattttgttgaaatcaattatatgtatagcggtacatgtttacaaattattaatggagaaaggatagagatggaagaaagtgacgtggtgatcattgataaagaagctactcaaagaatcgaatacacagggcaagaggatattttaatcaacatcttattaaaagaagaaaccttatctacagagatattgaatcatttggcaagcacaaataatctactttcttcttttttgataaatgcatcaaaagaaaaaggggaacatacacaattcattcattttcgcggcggaaaaacaagtcgtttgacgcatttgattgaaaatatgctgttgatttattttgatacatacagtcataagatccgttcgttaaatctctatacatcactattactgatcgaattgactcatttattagaacaacaaagcttttcatcagcagatggatgcgcagaaaatgagatgcttagagtattagattatatcgataagcattttacttcttgtacgttaaaagaaacagcagctcattttggctacaatccggtctatcttagtaataaattgaaaatgtattttgatgcttcctttcaagaactggttctaaagaaaaaattcgactttgcgttggaactgattcaagaaacgagtttttcgttggaagaaatcgctaatcgtatcggatataaacaaacgacttctttattcaaattattcaagaagtattcaacatgtactcccaatgaatggagaaataaacattaa

SEQ ID NO: 3279 - DNA (genomic), 885 bp, Enterococcus faecium; double-stranded, circular
  misc_feature (B) LOCATION 1...885
  hypothetical: NO
  anti-sense: NO
taccgcaactttttttgtgtatgtaaggaagaaactagatttgccggtcagcagataatcatgtatcattgtactagttttgcctttgatattttcatcattggaataaaaaagtatgctacaatggaaggcgagaattttatagcagaaaggatcaaatatatgattacattaggaatagatactgcaaatcaaactttggcgatcggtgtggtggaagataaacaaattcttgggcaaatacagacaaatatcaaacgcaaccacagtgtgacgctgatgcctgccattgaccaattgtttgcagatcttcaaatgagtccccaagacattgaccgaatcgcggtttctgatggtcctggttcttatacaggacttcgtataggtgtaacgacagcgaaaacgattgcttatacactagataaagatctaataggagtatctagcctgaaagccatcgcggctaattgtgtcggggtgaataaaatgattgtgcccatgtttgatgctcgaagaaaaaatgtctatgctggggcataccgctggaaagaaaatagattagaaactgtacttgaagatgtacatattgctgcttctgatttgtttgcacaactacaagagctgaatgaagctatttattttgttgggagtgattgtcataaatttatctctgaaataaaagaaatgctgcctgatgcgatgattaatacagttccatcatgggatatcccaagcggtgtgactgtggctcaattaggtgcgttggatgaaccagttgcagataaacaagcttttctccctcgttatttaaaacgagtagaagctgaagagaaatggttagagacgcacacgcctggagacgaaagctatgttgaaaaaatttaa

SEQ ID NO: 3280 - DNA (genomic), 558 bp, Enterococcus faecium; double-stranded, circular
  misc_feature (B) LOCATION 1...558
  hypothetical: NO
  anti-sense: NO
ttttcaaacttcgcaacagaaccgagaaccttgggttttcaagtgctttttggttcattaatcttaaccatagtgtttttaaagtggaaaacaagcaacaaaaaaagtatgtggagccttgtaggaatagttcttattatttttactgtgactgcagcaacagaagcaaattattcgcataaaattcagtcgtataaaggtcgtttagttatgaccaaaaaagatgttacacgttatacatcctcaagaactggaggcctatatgactatgcaccattagatgcattgaaatataaagatcatttaaagaaacatgaagtaaaagttggtgatcggtgggagaatgcatctcataaagcatataattccaaaatagtctatacagtagaagatgccgatgagcaaaatatcacattacctgtattcaattattggggaacagttgtgaaagtaaatgggaaaaagagcactatagaaaatgacaatggtttagtgtctattaaaggtacggggaaaagaactatagttgaggtttcatctacgtatcaaatacgatga

SEQ ID NO: 3281 - DNA (genomic), 1842 bp, Enterococcus faecium; double-stranded, circular
  misc_feature (B) LOCATION 1...1842
  hypothetical: NO
  anti-sense: NO
ttgccaaacttatcaggagtttgcaaaatcacaaggaatatagaaagaagggatacgatggaaaagaaaaaaacgttgaacacgcgtgctttgatacgtttttggaaaatgatcaaacctgaacataaatatttttacggattgtttctatgcagtttattcgggaacctattagtcgtagccatgcccttgatcatgggaatcgggatcgatgatctcttatcagaaataagaaaaacaggtattggacagctttctttcagtgatatcaaacaagcattgttgttccctgtcttattgctgatcggctgttcagtcttaagcagcatcacttcatttattcaggaacggacaatggcagcgttaagcgaaaagatcacattgagggtgcgaaaagaaatcacaaaaaaattcaaaacattaccgatgtcgttttttgacaatcatcaagtaggtgacatcattagtcggacaactaccggtctcaatcaactttctcaagtgttattgacaggtatcaatcaattttttacttctgtcgtaacaatagctgctgctggtctgatgctgttttatatcgaaagcaagcttactttgctcgtcttattgctgatcgttggcagttcaattgttacaactaagattgcgaacaaaaacaaacagatttctgaacagaatcagtatgaactgggtgttttaaataatcgaatggaagaaatcttagctggtaatctagtggtcaaaacattcaatcagcaagctcatgcagaagctgctatacacgaagtaaataaaaagcaatacaacgcttttaaacgtgctcaatttatgaactttgctatctatccggccattcgtttcattaatcaactcgccttcatcataagtgcggtattcggtgctatgcttgttctatcaggtggtgtgacgatcggcttcttacaagcttatcttcagtacatcaatcagatttctgaaccaatttctaccgcttcttatgtgatcaactcgatccaatccgcaatggcagcaatcgataggatatttgagatattagatgaaacagatgaaattccagaccttccagatgcaagacttttagaacaaccgaaaggaaaaatagctttcaaaaatgtacagtttggttacacatcagataaaatattgatgaatcaagtcgatttttcagtaaagccaaaacaaacggtagcgatcgttggtccaactggtgcaggaaaaacgactttagtcaatctgctgatgcgtttttatgaactgaataaaggaaagatcgaattcgacggtcttgatattaccaagctttcacgtggagaactacgtcgttcttttgggatggttttacaaaatacctggctgtttgaaggaacggtagctgataatatcgcctacgggaaaatggatgccacaagagaacaaattatcgaagcggctgaaatcgcacaatgtgatcactttattcgaacactgccagacggatatgatacgatcatttctagcgaaaacggcacgttatctcaaggacagcaacaattattgacaattgctcgagtcattctagcgaatcctcctgtcgttattttagatgaagcaacttctagcgtagatacacgaacagaagcattgattcagcaagcaatggaagctgtgacaaaagataggacaagttttgtgattgcacaccgtttgtcaacgattgaaaatgcagacatgatccttgtaatgaagaatggcgatatcgtcgaaaaaggaacacattctgaactactccaatcaccaacgctttatgccagtctttataatagtcaatttcagatagcgtaa

SEQ ID NO: 3282 - DNA (genomic), 1071 bp, Enterococcus faecium; double-stranded, circular
  misc_feature (B) LOCATION 1...1071
  hypothetical: NO
  anti-sense: NO
catttttttgtcacagccccttttttatttgaaaaatatttctttctcaaaaaacaagcaaggcgcttcaaagttcttcttgtatgcgctacacttagagtaaagaaaggcgggaaattaactatgtcagaaagaatcatttatgcagatcgtccatttcgtgatgaatttatcgaagaaatccatactatagcgcctggttatatctttaaaacagaattacaaccagaggatctacaaaatgtagagatcagtttgggctggaactcagactaccaagaaaaactattagcctcttctaccttgaaatgggtccaatctatctcagctggtgttgatcagctaccccttgagactttttcaaagaaacatattttactttcaaatggtagtggcatccacagtgaatcgattacggagcatgtcttaggaatcatccttgggtattctcgtggtctttttcaagcacaaaaggcacagagtgacatgaaatggttaggttcatcggtccattaccaatctatccaagggaaaaaaatactaatcattggaactggccatattggaaaaatgattgcaaaaaaatgcaaagcattagacatgaactgctatggaatcaatacatccggtcatccagcagaaggaatggaaaagactttttctttaaatcaactaaaggaagttcttcctgaagtagatttcgtagtcaatatcttacctctaacggaggaaacaactgggctctttgatcagcatatgtttgaacactttgatccaaaatctgtattcatcaatgttggccgtggtgcttctgttaagacacaagatctggtgcaggctttaaataaccagcaactttcctttgcagcattagacgtttttgaggaagagcctcttccacaagatcatcctctttggaaaatggacaatgtactgattacttcccacattgcaggtttgacacctgattttcaaaagaaattaatggctatttttttaaccaatctgaaaagctactttgccacccatgagcttcaaaccaatcaagtaaaattgtctgcaggatattaa

SEQ ID NO: 3283 - DNA (genomic), 285 bp, Enterococcus faecium; double-stranded, circular
  misc_feature (B) LOCATION 1...285
  hypothetical: NO
  anti-sense: NO
cggaaaaacttgcaaaagcaaggaagttatataccaagcgtacgccctggtaaggggactgaagagtatgtctcaagattactgatgcgtttaagtacagttggtgcagtcttccttggtttagtggcattgcttccaatcattgctcaaatggtttgggatcttccacaatcaatcggattaggcggtacaagcttactgatcgttatcggtgtagctttagaaactgcgaaacagttagaaggcttaatgctgaaacgtaaatatgttggattcattgagtaa

SEQ ID NO: 3284 - DNA (genomic), 819 bp, Enterococcus faecium; double-stranded, circular
  misc_feature (B) LOCATION 1...819
  hypothetical: NO
  anti-sense: NO
gaagaaaacttgaaagagggtgacttcatgttagatgtggagcagatggaaatagacctttataatattattttaaatcgaaatacaagagaatgggaaagaacacaatttgaagaggcaaaagaagacctagcaaaaatgtcgataaagcaggtgatagaaaaactagaggtcaacttgcgtccgctagcactacgagataatttgacaccagatgcgatggatttttatttaagaatcacaggggagtcagcgagtgcaaaggcttatgattatgccaaacataagataacttcacccttataccaagaacgggcgatttttgccggtggctgtttctggtgtatggttgagccttttgaaacaaaaccaggtgtaatctcagtgttatctggttatacaggtggagagaccaaaaaaccaaattacgatcaagtcagtggtggatatactgggcatgttgaagctgttgagatcatatttgatacacgtcaaataacctatgaagagctgttggagatttattggcaaatttcagaccctacagatgcctttggtcaatttcaagatcgggggaaacaatatcgttcaattctatttgttgttaatgaaaagcaaaggcaattggctgaaaaatcaagagaacaactgattcaatctaaccgatttagccgtcctatcgttacagagattcgccaagcaaagactttttggccagctgaaaatcatcatcaacaattttatcagaagcaacctaaaagatataaaaagatcaagcattcgcatcagcttcatttattttttcagcgacatagatag

SEQ ID NO: 3285 - DNA (genomic), 522 bp, Enterococcus faecium; double-stranded, circular
  misc_feature (B) LOCATION 1...522
  hypothetical: NO
  anti-sense: NO
cggtattttgtttttttccttacaatagctttaacttatggtaaagttaagctgaagtatttattctttatagaaaggatgttttatatggaaaactgtattttttgcaaaatcatcaatcaagaaatcccaagctataaaatatatgaagacgacaaggtctatgcttttttagacatctctcaagcaacgaaaggacacacattagttgtgcctaaacgtcatgtagcagatatttttgaatatgatcccgaacttgcaggagaggttttttcgcgtgtgcctaagattgctcaagcattggaaaaagcttttccagaaatgaaaggtcttaatatcttgaataacaaccgtgaactagcctatcaatctgtttttcattcacatatccatttagtccctcgctacagcaaagaggatgatttttctattcactttgtcaatcatcaagatagttatggatcggaagaactaaaagctattcaagaaacaatcgtaaagcaggtgtcctgcgatgattaa

SEQ ID NO: 3286 - DNA (genomic), 195 bp, Enterococcus faecium; double-stranded, circular
  misc_feature (B) LOCATION 1...195
  hypothetical: NO
  anti-sense: NO
ttgcgttttgtaagagattatcaaaaacgcgctgcattttatcgacatcaaaacgaatcgaaagatcagcttctaactcactttctagagtcagctgcttggaagacaaaagaggcaaaaattcataacttagctgttctaacatcatcttcagatggacttttgtcggcatcaattcgatatttgataaattga

SEQ ID NO: 3287 - DNA (genomic), 1692 bp, Enterococcus faecium; double-stranded, circular
  misc_feature (B) LOCATION 1...1692
  hypothetical: NO
  anti-sense: NO
tccgactttgttgcttggattctttttttgtcagcatatttagaggtatttttttcttttttttgttcgtgctgtaaggttaaggcaagacaagttagttgggaaaaaggaaagaaatgtttatacttaaagaataacagaaaggaaggtcgcatgaataattttatacaaacattaagtgaaagaaaaggcgagttgctggaagctgcatttcaacatctgtccatttctctcatttctttgctgattgcagcactgattgctattcctttagcgatttgggcagccaatcataaaaaaatggcagaagtcttattgcagatcacgggtgtgctccaaacgattccttcacttgccttattaggtttacttatcccatttgtagggatcggaactgttccagcattgattgcacttgttatttacgctttgcttccgattttccaaaacacgtatattggtctagctgaaattgacccgtctattgaagaagcagcggtagcatttggtatgtccagaatgagacgcttgctgaaagtagagcttcccatcgcattacctgtcattatctcaggtatccgaactgccttagttttaatcatcggtacggctactttggcagcattgatcggagcacgtggattagggacatttattttgttaggtattgaccgaaatacacctgttttgacattgattggtgcgatcagttctgccttgcttgcaattatattcagcggactgattcgctggttgcagcataagaaacctcgatattccatcattactttagcaacagtggtgtgtttatttggcggcgtttctttatatcagtctgccttgtttaaaaatgaaaccatcacgattgctggaaaattaggagcggaacctgaaatcctgatccaaatgtataaagaattgattgaagacaacacaaaaacagaagttgaattaaaaccgaattttggcaagacgagttttttgttcaatgcactggatcaaggtcaaatcgatatctatcctgagttcacaggtactgtcctagaaagcttggtgaaggtacctgaagcaatgaaaagtgctgatttgacaaaagaaaaaacatatgacgaagcagaagaattattgaataagcaattcgatatgacattattaaaaccaatggcttaccaaaatacgtatgccttggcagtcaagagatcttttgcgaacgaacatcaacttaaaaagatttccgatttggcagctatctctgatcagatcaaagcgggattcacactggaatttattgatcgttcagatggatataaaggaatccaagaagcatatggcttgaatttttcaagtgtacaaagcatggagccaagtttgcgttaccaagcaatcaataatggagatgtcaatattgtggatgcctattccacagatagccagctcaaggagtacgatctagtgactctagaagatgatcgagggttattcccagcttatcaaggcgcaccgctgatgaaaaaagattttgctaaagaacatcctgaaatcgttaaagcactgaataaattaagcggaaaaataacagaggatcaaatgattgatatgaattaccaagtcaatgtcgaaaagaaaaagccgacagaagtagcacgaatcttcctgaaaaatgaaggattagtaaaggaggaagatcagtga

SEQ ID NO: 3288 - DNA (genomic), 468 bp, Enterococcus faecium; double-stranded, circular
  misc_feature (B) LOCATION 1...468
  hypothetical: NO
  anti-sense: NO
tgcagaaacttaaacggaggattttttatgagggctattttttctagtatatctgtagttggtctattttttcttttagcaggctgcggtagcgcagatagcaacacaggttctgttgattcgattgatgcgggtcaaacagtaaaaacaagcagtacgaaaacggagagacaaagcatatttgtcggaacgattgaaagtatcactcaagtagaagcagaagaagaaacgcttcagttgaaactcgtcgatgtcatggccaaagaagatccagcgaatatgggaacgtcattcagcaatgacggagtgatcttaaatgctactgctgaaaaaataagcgtggacataaatgaattgaaaatcggtgacaaagtccaatttacattagttgagatgccgatcatgacgatgtctatcccaccgcaagttcctggagattcgattattgatgtttcattgaacaaataa

SEQ ID NO: 3289 - DNA (genomic), 1611 bp, Enterococcus faecium; double-stranded, circular
  misc_feature (B) LOCATION 1...1611
  hypothetical: NO
  anti-sense: NO
ttagaatttgtatggatctgtgataactgtcacagatcctctttttcaaggatgagaaggaaacttctgctgttaaaatcagaaatgcttggaggagtggacttggaacttttcagtttgcttgaaaaaaatgaacaacggcaaatcaaacttttccaacttttattagaggaaaaaggagagatttccgttaataacgtacttacccgcttatcagttgatcgggctaccttgaaagaagatctgttttatttacaagctaacttggaaaatatcaaacaattggaaattgttatccaagaagggaatattttattaatcagacatggaaatatagcagcagtcgatgtttattatcattgctacttgcgctattctacaaaatatcagatacttctttatctgttggaaaatggctcatttgatcggcagaaacttgtcatggaacttaatatcagttcggctactttgtctcgcagagtgaaggaattaaatgattctttaaatgagtttcatctgaaaataaaaagcgggcggctgaccggtccagaaagtcaaatttgttatttttatttccaattattttggtttggacgtccttatcttgaaaacaaaaaagaatacagtgatttatcaggaaacacttttttagatctgctgcaaaaagagtttagttttactattacagaagaaggacgattgaaatttgaaatatggctttccattatgaagaagcgaatgcgctgtacgaaaaaatccaaaccagattatagcaatcttcctgttggattgtttcaaacgacacaatttttattggacctccatacatttttgacccgttacttctttcaatatgcctttccttggaatcaaaatgaaacgttggttttttatcttttcatgatcagtaactttacattagatacacataactcgcatgtccaggagtttttgataagcgaaaaatacaaagacgacgtagtagctcaattgaatcgaacgtttaaacaatcgatagaagaatatttctctttttatgtttttccagaagagatttcgcaaaagattgcgttgacagtgatgcaaaatcacgctcattttgcctattttagaggatggatgaatatttttggccaagaaggattaaaacagcggttaactgaagtagaagataaacaattcctggttttatgtgaaagattggtcagacaaacatttgctattgttgattttactgaagtagacgaggaaaatgcccgctttgaattatttgctcgctatgcatctattttgcggacgctgatcaagcagttagaattacgtctgcaaattgcttatgatcttccttatgaaaggctaatggcggatatcgtgaaagaaatcatccaggaacaattgctgaatacgatcaaatatgatttagtcgaatacgagaaagaaaagcagtatgatatcattttgactagccaattgaaagagtacccgtcacagaagtccgctaaagtttttgtattcactagcaacgaatataattatgatttcccctatttgaaccaatttttaaaagaatgttatttagaaaaattgaatttaaggatgaataaaacatga

SEQ ID NO: 3290 - DNA (genomic), 258 bp, Enterococcus faecium; double-stranded, circular
  misc_feature (B) LOCATION 1...258
  hypothetical: NO
  anti-sense: NO
tataagtttgtcgagaacactcctagaaggaaaataattatgagccagtatcgtcatcttactatactcgaacgagaaagaatctttctgcttcacgaagaaggattttctattagtataattggcaacgacattcagcatagcccgtttactattttacatgaactgagaagaaacaagaaaaaaactattcaccttccaaagcggaaaaaaattatgcttatcgaagaaaaaaatgcggacgttatcacattctaa

SEQ ID NO: 3291 - DNA (genomic), 1479 bp, Enterococcus faecium; double-stranded, circular
  misc_feature (B) LOCATION 1...1479
  hypothetical: NO
  anti-sense: NO
aaaaggtttgttatactttttgataaaagcggttttattttggaggatgcttacatggatacagagcaacagaaaaaaggaattggtttaattccacttgctgccttagtaattggttcagcgattggaggtggcgtatttggtattatgacggacatctccggatcggctggcggcccagctattttcagttgggtactcgtaggaacagcaatgttgatgctctccttgtcgatcaataatatcaataaaaaacgtccagatttaaaaggcgggatctttagttacgcagaagaaggttttggccgtttcgctggttttatcagcggttggggttactggctcacatgctggttaggcaacgtagcttttgcaacattgttgatgagcgcattaggatatttcttcccagtatttgaaggtgggcaaaatctggcatcgatcgtgatgagtacagtctttttatggggatatgcatggctagtgaatcggggagtcgaaaatgctagtttcgtcaatgctatcgtcacattctgtaaattagtgccattatttttatttattgtagtagctatcagcacgttttcgatccaacaattcattgataacttttctagcgacattatattgaatgcgaatggacagccgatcccgttttccagtcaagtattgagttgcatcatggtgatgctttgggtatttgttggtattgaaggagcctctgtcgtaggttcacgagcaaaaaaacaatcagatgttgggaaagcaacgattctagggatattcggcttgattattatttacgtcttggtttccatgcttccatatgggacaatgacgatgaatcagctgcaaacgatcaaggcgcagcctgctatgggctatgtgtttgaaatgatggttggtaaatggggagcagtcgtgatcaacggcggtttgatcatttctttagttggtgtttggctctcatggacgatcttaccgattgaaacaatgggaaacatggctgaagacggacttttgcctaaagcatggggaaaactcaacaaaaatggggcaccaacttatgctatcgtattgacgacgttatgtacgaatgtctttttactttcattattattcactgacagtgcttataactttgcttacacacttggtacagcagctattttcttcacgtggcttttcttaggattgtaccaaatgaaactttcttatcagcggaaagaatgggtccaatttttagtagggcttttagcaagtgcctttcaagtatgggctatgctagtcgtagcctttaatgaagtaatgcttgttcttgttcttttcttgccaggcatttatttttacctcaaagcacgtaaggagcaaaacgagcctgtacaacatatccacttagataagattttacttataggtgtgacgatggtcggagtgattgcaatggttttatttgccactgggatgcttcacgtatag

SEQ ID NO: 3292 - DNA (genomic), 2190 bp, Enterococcus faecium; double-stranded, circular
  misc_feature (B) LOCATION 1...2190
  hypothetical: NO
  anti-sense: NO
tttttgaactttggtattgggatttgtctgttatttgtaggtgcgtattccaacatggcgtatttagcaattattgtcgtcaatatcgttattggaatttatcaagaaatacatgcaagaaatcttgtacggaaattatcgattgtttcccaatcagaagtactagtgatccgggacggtaaagaacaatcgatttctactaaagagctggtattaggagatttggtaaaaatcggagcaggagaacagataccagccgatttacaggttatatctggacgggcagaagcaaatgaagctcttttgacaggcgaatctgatttgattgtcaaagaaactggagctgaattgctttctggaagctttttgacaagcggttctgtcatggctgaagttatccgagtaggtgcagataattatgctgtccgcttgactagcgaggcaaagactcacaaagctattcgttctgaacttgtagattcgattcgcaaagtatccaaattcactagtttcgtgattattcctttggggatcatactatttttggaagcactgttcatccgcgatgcttctatcaaaatttctgttattgcatctgcagcagttttgttaggcatgcttccaaagggtttggtattgctaataagtattgcattaacgacaggggtaaccaaactggcaaaaaaacgaatccttgttcaagacatgtattcaattgaaacgctggcccatgtcgatacattatgcttggataaaacagggaccattactgaagggaaaatgagtatccagcgggtagaagcactacatccgctgtacgagaaagccatcccagaaattatggggacgtatctggcagaaagcagtgataacaacatcactatgcgggctatgagagattattttgagctttctaatcggtatgatgtgacaaacaaagtcgcattttcttctgatcgcaaatggggcgcgatggaatttccagaactgggagtcgtgtacgtaggagcgcctgaacgtttggtggaagaagatcggcttccggacagtctaaaaacagcccaagcgaatggctatcgcgtacttatgttggggatcgctccaaatcagcaattgaacgaagaaaaaccagcatttgttgagccggttgctctgtttgaaatcgatgatccaatccgaaaaaacgctcaagaaacactagcttatcttcatgaggaaggtgtggatctgaaagtgatttctggagacaatccttttactgtctccaatatcgctagacgtgcaggattaccgaattatgatgcgtatgtcgatctttctcaaattactgaagaaatggaagtgcgagaagctgctcatcgctatacggtttttggacgagtgagtccgcagcaaaagaaattgctggtaaatgaattgaaagaaagcggcagaacggttgcaatgacaggcgacggtgtgaatgatgttttggcgttaagagaagcagattgcagcattgctatggcagaaggtgatggagcaacacgtcagattgcgaatctggtattgttggactctgattttactacattgccagaagtcctgtttgaaggacgccgagtggtcaacaatgtgacgaaagtctcaggcatcttttttatcaaaacgatttattcatttattttatcgattatatgtgccgttacagcaattggatttccgtttatccctatccaaatcacgctgattgatttagcgattgaagggtatccttccttctttttatcttttgaacaagataaaagaaaaatcacttaccgttatttgcctacagcacttattaatgctttaccaaatgccttgcttgtagtagtgaatatcattgcggtgtatctacttggaaaaacattcgcatggggaaatgctgaaactactactttgatgtattacttgctgattgggatcagttgcatggcagttgtaaaagcttgttattccttcaacccattgcgcatcttcctagcagtaacgacgatcgtagggatatatgtagctgcaatgctgttccatggaattttggaagtaaacttagggttgggagagagcgtaggatacttctttgtattcatgctcgtaaatattgttcttcgagtattgtactggaaggctgatattcaaaatcagttactgaaaagagtagcaaattga

SEQ ID NO: 3293 - DNA (genomic), 1020 bp, Enterococcus faecium; double-stranded, circular
  misc_feature (B) LOCATION 1...1020
  hypothetical: NO
  anti-sense: NO
acacaccttgtttttctgttatataccgaaaaacggccattcagttcaaaacaaggctctaaacaaaaacagtcgatcacccattcattgatggatagcgacgattcgtttactatttatcctgtttctaccttttcggaagaatccggctatgtaatcaatactgattccaaagatacacttaggaagtttgttcaaaagtttcgtcaagaagtttttccaggtgatttttttgttgtttctgattcttttgcaatccaagatatcaatgaaatattccaagagatcagaaattgcaccaaaggacaacgtttctatcataagggaaagaaccttgcttatcagcatgaacttcttccgttattaaccaaccacgagcagcaagcaagtagttatttaacaaaaatcgttcataaagactacgctttagctgtcaaagaacttgagaatttcttcacgacgatattggaacagcctattgatccagcttatttgaaacatgaggcaatcaatcgtttctatgcattactcaacgctttggctgacgagcatgttgggaatgaagaactttctttgctcaagatcgcccttccttctttattagccgatgctgagtatttcgaagatttttctattcttgtcaaagaaacacttgagaaactcacccacttttctgcaaatgcaaaaaaagacaatttcgatatcttgactttgatctacgagttcgtccaggaaaattatgagaaagaaatcaatttacaacttttatccgaaaaatatcatttttcatatagctatctctcagccatctttactgaaaaatttggtatcaacttttcaaaatatctaaaaaaagtccgtatcagtaaagccaagctctttttgacggaaacacggcttactttgacggaaatctgtgagaaagtcggctataccgaactgggttatttctccagagtttttaaagaagagacaggaatgacaccttctcaataccgtaaaggaacttttgtaaaatga

SEQ ID NO: 3294 - DNA (genomic), 225 bp, Enterococcus faecium; double-stranded, circular
  misc_feature (B) LOCATION 1...225
  hypothetical: NO
  anti-sense: NO
gctttgcttgtccgcaggaaaacttcttttcaaaaacggattttcttaggaaaaatggcgagtttgactagtcaatcacttgattttgttttacaattaaaaagaaacgacagaacaaaggagagcttaaaaaatgggcaaatttcaagtgatcgatcatccattgattcaacacaaactaactattattcgggacaaaaactgcggaacaaaggtttttcgtga

SEQ ID NO: 3295 - DNA (genomic), 528 bp, Enterococcus faecium; double-stranded, circular
  misc_feature (B) LOCATION 1...528
  hypothetical: NO
  anti-sense: NO
atcgctattgtttttcaagaggtaactttgtttaatacaagtattttggaaaatatacgtattggaaatagtcaagcgtcagatgaggaagtgaaaaaagcagctcgtttagctaactgcgaagactttattgaaaaactacctgacggttatcatacattggtcggagaaaacggaagttcactttctggaggagagcgacaacgcctatccatagcacgggcttttttgaaaaatgcgccaattttaattttagatgaaattactgccagtttagatgcggaaaatgaaaaacgtattcaggaaagtttaaatcgtttaatacaagataagacagtactaattatatcgcatcgcttgaagtctattgaaaaggtaaataaaattgtagtgatggatcaaggaaaactagttgatcaaggtactcataatgagttgtatcgaaggtcagaaatatacaaaaatctcataaagaaaactaaactatctgagaaattcgtctatgaaaaagaagctcaatcacgatga

SEQ ID NO: 3296 - DNA (genomic), 1047 bp, Enterococcus faecium; double-stranded, circular
  misc_feature (B) LOCATION 1...1047
  hypothetical: NO
  anti-sense: NO
ggagccattgtcatgttcgaaaaactcaaacgatttgggcgtaattttacacaaacaacgccctttatcttaagtaacacggttatttttattccttatcttttatttttgggactaacagactcgcataattggctgacgattttgccatttacgctgttttatgcctttcggatgactggactatttttagtcaacagtctacgatttggtctagatagttacacgttgctgatgatcgctctgctgattggtggtgctggttcattgcttggaatattaggcgtattttattttcctttattttatttttcaagtgttttgctagggctgagtgcagcatggcttgtacctgctaataccacggtcaattttcacgaaaagacgcaaggttttatcaatatggatgggaaaaagtacttatttgcagctatctggctatttctcctgtatcaagcgattgagttgcctgcaccgactcagattgcagcaagctttactatttatacacttttttacgtcatggcctaccatacggttagtcattatccgcgttacgaactggatttcaaagacatcaaaagaaatctggtagctacgcgagagcttgttttatttttgatattctttggcttattgtttcttttgagaaatgcccgattgttattcgatgaaaggctttttgatcttgctatttatggtttcttgctgctgttcatcttgttcgtgtttgttttaggacaccaaaaaaaggaatggaagttgccaagctggctaaatctgtttacttttctaaatggaatgctagggaatttcctttttttatttagcagtttttatgttggcatactgtacggattagaaaaactttcgatttttatgtatttgccttatgcagcaggcttgattgcagcaaaaatagtcggaccatggattttgaaacgtttaacatggtctccattggctatgcaattgcttggactgagttcttctttattggtcctcttgattccaaatgggtttggcgataggtgtctttctggctaa

SEQ ID NO: 3297 - DNA (genomic), 729 bp, Enterococcus faecium; double-stranded, circular
  misc_feature (B) LOCATION 1...729
  hypothetical: NO
  anti-sense: NO
gtgcggaacttgtggtgcagactggcgaaaatcatgatggaaagcaatgcggagatgtatcgggtagaagatacgatgagtcgaattgctttagcttctggaaatttccgtttggtcagctatgtcactcaaaccggtctctttattggtcttgatcgtacctcgaccatccgaatggaacaaattaccaaccgttcgattaatttagaaaaagtagtaaaagtaaatgatctttcacgtaaatatgttgcttcagagctaacattagaagaactttactgcgaactgcaagcaatcgaccgagaccgttctttctttcctgtctggttgcaaatcgttagcgcggcagtgatcagtggaacaattatggtgttatttggcggaaagatgaccgatttacctgtgactttagtcattggaggattgggatacgcagcttatctatatagtttgaaattttttagaatcaaatttttatcggaatttttatcttctttattgattggcatagccgctatctacagcgtacgttttggcttaggaagcaatcaggatctaatcattatcggatgtgtgatgcctttagttcctggagttcaaattacgaacgctatccgtgatttgctagctggacattatgtctcaggagtttctcgcggaacagaaacgatgatgactgctacgatgatcggttttgcgattgcttttattttccagcttttttattag

SEQ ID NO: 3298 - DNA (genomic), 621 bp, Enterococcus faecium; double-stranded, circular
  misc_feature (B) LOCATION 1...621
  hypothetical: NO
  anti-sense: NO
attatgattgttgctgaaagtaatgaaaataaattaagtggtgtttttgacaaattcttagaactagttattccaaaagataaagatatgtgtgaacttttaccatataaaaaaatattgaaagacggaacgttagtgactaatgacaataagtatcaagccttttttaaagttaaaacaactgacttaacttctatttcagaagatggatttatgcgtatggtaaacaaactcacttatttaaatcgagtatatttagaaccatataaaatttattcattaacttatcctactgaaacagtaaatcaagcgatttattggaagcatagaatacaggaggcaaagagaagtttattgagtaataatgatcccaatttagaaacgtatctgaagtggaatctaaagctagcttacgataattatgaaagagttgatctagtatcgactttaccagagttgatgttcgttatttgtgtttatggaaaaacacaaaaagaagtgaaaaatcatgccgatgtaatgaaacaggccggtggtagagaattagatttacaaagaattactgaaggggatttaatcaatgtgataactaaattgatgaatcccaatacttctttataa

SEQ ID NO: 3299 - DNA (genomic), 417 bp, Enterococcus faecium; double-stranded, circular
  misc_feature (B) LOCATION 1...417
  hypothetical: NO
  anti-sense: NO
agagtgattgtcatggctaaaaatagttgggagctaaaaataaatggacatgatgaacttcttgtgcggatggaacgctattcaagcgagagcgaacgactgattaacgaagcattgaaatcaaaaggttcggctattgcagtggataggattacagaaaaaattcctgtttctgaagcagatttaagaagagggcaccaacacgcaaaaaatagtcgtccacttaagactcaatacattaatttgggtttcatcattagacctacaagaaaatttgagtatttaaaatatcctgatttggggataggtacttctaaaagaaatcagccggacgaatttatgagaagaggattaggtcttgcacttgatccaattacagaacttctgattcgtcaattcgataaattaaataaatag

SEQ ID NO: 3300 - DNA (genomic), 942 bp, Enterococcus faecium; double-stranded, circular
  misc_feature (B) LOCATION 1...942
  hypothetical: NO
  anti-sense: NO
accaagattgtatattttatcaaaatgaaagatgaggtggactatatgaacggattcaccaaatattggaatcgtcctgatcgtgctgcgtatttgtttttaactccatcttttttagttttattattatttactgtcataccgcttttaggaacatttgctattagttttacagatttgaatattttctttacatcaagaaattttgtaagttttgaaaatttcacacgtatatttagtgatgaacgagcagttaattcgttgattcattctttatatttcaccgtactcgaaacgccaacacaaattatcgttggtttattagcagcagtagcattatctaaaaataccagattcaatcgtttttgtcgttcgacattttacattccagttatttgttcattgacgtcaattgcgattattttttctatgttgcttgatccgaatgtaggggcgattccttacttgttttcacaagtcggcttgccgatccctcaattttttcgcgatccaacccttgctatgccgacggtagccatcatgactgtttggaagaattttggtgttactatgacgattctcttgactgctattcagggaatctctccctctttgtatgaatctgctcaaatggatggtgcaacaaatcgacagcagttttttaacattacgctacctcagatcgttccctccttaggtttttgtattttaacgaatctgattggttcgatgcaagtgtttgaccaagtatatgttgcaaccgctggtggcccacaatttaagacagaaacagctgttcaatatatttacagtcgaggatttacagcaccttatgaattgggctatgcatcagcactgtcttcggttttgtttatcattgttgcaactatagctatctccactaatgtgtacatgtcacggaaagaaaaacaaatgaaatag

SEQ ID NO: 3301 - DNA (genomic), 1188 bp, Enterococcus faecium; double-stranded, circular
  misc_feature (B) LOCATION 1...1188
  hypothetical: NO
  anti-sense: NO
ggaggagttgttttgtcaggaaacaaacaacacccaagcaaagacaaaaaagaagccagtaaggcagctacagcagatataatcgacaagcggagaaatctgcgtaaaaaagaagataagatcgtgaggaagatcattttagtgatcgctcttacattattgattattggcggatttctcgggtttaccgtatatcgttatgtagatagcgggttgaagcctttagataaatcggacgaccaattagtccaagtggaaatcccaagcggctcttctaataagcagattggcgaaattttggagaaagacaatattattaaaagtgggattgttttcaattattatacaaaatttaaaaacttaactggctttcaagctggttattatcagttagcgcctaatatgactcttgatgagattggcaagcagttgcaagaaggcggcacatctgagccaacaaaagttgcagatgggaaaattgccattccagaaggctacgacatcgatcagattgctgagcgggtagcgaaggtaactggtaaagacaagaaagaatttttagatttagtaaatgatgagactttctttaacgagttgtatcaaaaattcccagaattgttggaaagtgcctctaaagctgagaacacaaaataccgtttggaaggctacttattcccagctacttatgattactacacgagtacttcgcttaaggatcttgtgattgagatggtgaacaaaacaaatacggtcatgcaaaactattattcagctatcaaacagaaaaatttgactgtacaagaagttttaactttggcttctctagttgaaaaagaaggcgtaaaagaaaatgatcgtaaaaatattgcacaagtcttctttaaccgaatcaaggcaaatatgccacttcagtcagatatctctgttttatatgcattaggagaacataaagaattggtgacgtatgaagatacagctgtagattcaccatacaatttgtataccaataccggctatgggcctggtccttttgacaatccaagcgaagaggcaatcaaggcagtattagaaccagcagaaaatgactattattatttcgtagcagatacgagcactggaaatgtttatttcgctaaaacgtatgaagaacatatggaactagtgcaaaaatatgtaaataattcttag

SEQ ID NO: 3302 - DNA (genomic), 513 bp, Enterococcus faecium; double-stranded, circular
  misc_feature (B) LOCATION 1...513
  hypothetical: NO
  anti-sense: NO
tgcggttctgtgcatgaaacgctgggaggaataattttggatatcaatgaaatcagagaattagtcagtcaatttgatcaatcctcgctaacggaattcgatttgcgtgaaggtcaatttgaattgtatatgaataaaaataaaacaagtcgaggcatgaatatggttcaaacaaacgaaacgttgccagtttcggagccagtcaatgtcatatctgaacaagcaacaactgctccagaaataatgaaagaaaaagaatcggcagtatttgatggaatcgaggttgtttcgccaatcgtgggaatcgtttatctgcaaccagcgcccgacaaaccagctttcaaaaaagtaggtgatcaagttgccaaaggagaagttatctgcattattgaagcgatgaaactgatgaatgagataactagtgaggccgacggagtgatcacagaaatccttgtagaaaacgagtcagttgtcgaatatggacagccactctttaggattcagcaaaaataa

SEQ ID NO: 3303 - DNA (genomic), 207 bp, Enterococcus faecium; double-stranded, circular
  misc_feature (B) LOCATION 1...207
  hypothetical: NO
  anti-sense: NO
ggaatacctgttatctattgttcggattgctttctatctactacttttttacaggaaatttacctattagttttctctgctgtaatttttgacttctgcttccatagcatcaataaagatattcaaatcttctacagctgtttctttacttccataacgacgtacgttcactgttgcatcttccaattccttgtctccaacaactaa

SEQ ID NO: 3304 - DNA (genomic), 216 bp, Enterococcus faecium; double-stranded, circular
  misc_feature (B) LOCATION 1...216
  hypothetical: NO
  anti-sense: NO
attttgactgtaacgaaaaatggcgaaatggaagagcaccagcaagtgattgaccggatctacgaagcgacacgatatctgcctttggatcgtttgtgcttaagtcctcaatgtggatttgcttcaacagaagaagaaaatgttttgtttgaagaacaatggaaaaaatttcttttgtcaaaagcattgcagaagaagtttggggaaaatcattaa

SEQ ID NO: 3305 - DNA (genomic), 231 bp, Enterococcus faecium; double-stranded, circular
  misc_feature (B) LOCATION 1...231
  hypothetical: NO
  anti-sense: NO
atatctgctgttttgactaatgcccgtgcaattgccagacgctgtctttgtccaccagagaagtttcctcctccttgttccacatggctatctaagccatcttccatctctgaaacaaaatctttagcttgtgcgatttctaatgctttccaaatcatttcatctgttgcatccggcttaccatactgcatattgtctcggatcgttccagagaacagaactgctttttga

SEQ ID NO: 3306 - DNA (genomic), 195 bp, Enterococcus faecium; double-stranded, circular
  misc_feature (B) LOCATION 1...195
  hypothetical: NO
  anti-sense: NO
caagccgctgtgcttccgcctccggctgttcccgcaaaaggcggtaaaggtcgcccagcaccggcattttctccggcttcgggtcttgcaggtagtcccggtagaccatgtggacgcagcggtcaaccactgtcttttccaccggctccaggccggccttgccgcccacaatcagctccatcagggagaggataa

SEQ ID NO: 3307 - DNA (genomic), 519 bp, Enterococcus faecium; double-stranded, circular
  misc_feature (B) LOCATION 1...519
  hypothetical: NO
  anti-sense: NO
cgggtttatgtaaaacaaggaggaagaagtgtgacaaggaaaatcagtaaaattggagcatcgttgttagtgttggcagtggcaacgaccatcgattatcgccaaagtgaggcgaagacaattggaaatgtcgtttatcgagaaacagccaaaagtatgttgaaaaaagcaatggacaatcaaccggagtcgtcttattggttcccagaggattcgttggcatggtcttttggaaaagatacagatacgaaatacaataccagtgtcgttcctttagcagagcgggtatccaaagcgacattgccgaacatgaatgtcactcaaacggaagaagttaaagtcgtggcgctttcggccatgaatagcagtatcaacggcaatgcatcacgagggatcgatatcttttacgccaatgtcttttcttattggcaatatatcgatcaattggtttacgggggtgctcttctggtgaaggatcatcgtatcgccaagtctagttgcgacggatgcagtccataa

SEQ ID NO: 3308 - DNA (genomic), 213 bp, Enterococcus faecium; double-stranded, circular
  misc_feature (B) LOCATION 1...213
  hypothetical: NO
  anti-sense: NO
cagagagactttcttgtacgatttttgttaaggcatacccatacatatcttcgttgcttaatgctgctagcacagtaccatcaagaagaacagttggaatctggatgtgcattacgtcaccttctattctcaagtgtaatattttatttcaatgtatattatacaacatataatatagtttcgaaatcagtttgtcaaatacaaaaaaactga

SEQ ID NO: 3309 - DNA (genomic), 243 bp, Enterococcus faecium; double-stranded, circular
  misc_feature (B) LOCATION 1...243
  hypothetical: NO
  anti-sense: NO
agggcggactttttccgtttgtcccaccaaactttttttcccccacccgggggtttttctcgggggggnntgcnnnnccccccgnggccgcccgcccttggtgggtggggngggggngnttttntggggggggannnnnngnnnnnnnnngtnngnnntnnnnngnnnnnnnnnnnnnnnntnnnnnnnnnnnnnnnnnnnnnnnnnnnnnnnnnnnnnnnnnatccttccttctttatctga

SEQ ID NO: 3310 - DNA (genomic), 192 bp, Enterococcus faecium; double-stranded, circular
  misc_feature (B) LOCATION 1...192
  hypothetical: NO
  anti-sense: NO
cctgctaatgtaaagcaagcatacttggagcttggaggactaccggagctggatggtcgttatactgtttttggacaggtataccaagggttagaaatcgtagcagcgatcgcagctcagccgacaaacagtgaagatgtaccgattgagccagtgttcattcgacaaattaacttcgaaaaaacatcgtaa

SEQ ID NO: 3311 - DNA (genomic), 288 bp, Enterococcus faecium; double-stranded, circular
  misc_feature (B) LOCATION 1...288
  hypothetical: NO
  anti-sense: NO
ataaataatgtgaatccaataacgctaagggcaatcagtccgatcagcgataaaataaagcgtcctgtaaaatatcgtttcatcatcagtagatttttgatatcgaccattgggccaaagaccaaaaaggcagctacaggtgctgtgccgaacagacttaacaaagaagatcctataaacgcatctgcttctgagcaaagagacatcgtaaaggccaataacagcatgatgataatggctaaaatctttgttgagccgagcgttagcataattctagttggtaaataa

SEQ ID NO: 3312 - DNA (genomic), 1236 bp, Enterococcus faecium; double-stranded, circular
  misc_feature (B) LOCATION 1...1236
  hypothetical: NO
  anti-sense: NO
gagtacaatgttttttgcagaaaacatactcgaataggactgatatcaatgactcaagtacattttacttttgaaagcgaagaaattcaagcaattataaacgaaagcggtgcgaatgataccgcaaaaacacttatgactatcatgtttaatcagctgatggaagaacaacgaaatcaatatattcaggcaaatgcctatgaacgttcagaagaacggcaatcacaaagaaatggttactacgatcgttcgtttacaactcgaattggtacgttagaacttcatgttccacgaaccagagacggtaagtttagtcctactatctttgaaagatatcagcgaagcgaaaaagctttgatcgctgccatgattgaaatggtcatttctggtgtctccactcgcaaagtaactaaaacagttgaactgctaacggatggtgcgactgtttctaaatcattcgtttcaaatctgatgaaacagttggatccatttgtttttgagtggagaaaccggagcctagaaggctcggaatatccatttttcatgtgtgatgccctgtatatgaaagtaagggaaaatcatcgtattgtctcaaaaggtgtatatattggtatcggcattgattctgatggacgacgtacgattcttggttttgatgttcaagacggcgaatcggaagataattgggataccgtttttcaatcgttcgttcaacgaggtttgttcggtgtaaaactggtcatttctgatgcacacaaagggttagttaaggctgttcgcaagaactttttaggtgcgagctggcaaagatgccaagcccactttttgagaaatatttttgataagctgccaaagaaagtttcttctgatgtaaaagacgagttgaagagtatctttaaagcctctgaacttgaattgacacgtgaaagaaaagagcacttcttggaaaaatatggttgtgattcaaaattaagtgctgcttgcgacattttagaaaacggctttgaagatgctattcaaattttgtcttttcctgaaaatatccgccgaaggattcgtacaaccaatgtgttggaacggttgaacgaagagattcgccggagagaacgagtgattcggatttttccaaatatcaattccatcactcggataattggaacacttttgatggaaaaagacactgagtggctggcttctccacgaaaatatttagaatttaattcgaataacatttag

SEQ ID NO: 3313 - DNA (genomic), 384 bp, Enterococcus faecium; double-stranded, circular
  misc_feature (B) LOCATION 1...384
  hypothetical: NO
  anti-sense: NO
ttgataaatgtgatccccacgaagaagaaacctaagatcaatgccatcatcgtcaatgtagcagcggcattttttgctcttggcttcttaaagaatggtacagcattactaatcgcctccaccccagttaaagaggaagaaccagaagaaaatgctcgtaaaatcaaagcgatagaaacacccggcacagccgctcctggaagtgcagtagcttgcaatggcacagcacctgtcacgatattatataaaccaacaacgatcagtaacgagatcacaaggataaatgtgtacaccggaaataataggaacgatgcagattccctcagcccacgaagattcagcatcatcagtagcaaaacgattgtcacagaaatagcgacttga

SEQ ID NO: 3314 - DNA (genomic), 483 bp, Enterococcus faecium; double-stranded, circular
  misc_feature (B) LOCATION 1...483
  hypothetical: NO
  anti-sense: NO
atgacaaatgtcaaaatggcacaacttgaagtagatttgtcttttgagcaagtagccaaaaacagtcagctgaatgtagcgatactagatcctgatgggaaggaaatctatcaacagcaatatccgttaaaagagcaaatgacgattcgcatcgatggatttgaaaatgtggcactgtgggggcattttcagcccaatttatataagcttgaattggagacgatagacgaagaaaaaagagtaacggagtatattgactattccttcggttttcgtaaaatcgaaatcaaagataaaatcatctacttcaatggaaaacggatgattatcaacggggtaaatcgacatgagtggcatccgaaaaaaggacgcgccatcactatagaagatatggaaaaagatttggctatcataaaaaatgcaaagatcaacggcgtagggccatctcattacccccccgaatggccagatccgcacaccgcc

SEQ ID NO: 3315 - DNA (genomic), 360 bp, Enterococcus faecium; double-stranded, circular
  misc_feature (B) LOCATION 1...360
  hypothetical: NO
  anti-sense: NO
attaaaaatgtacgtgcgcactcgaaggttaagagtgctaacagattaaaaaaagagttatcggagggatttatcgtgttaaaaccattaggtgatcgcgtcattatcgaagtcgcaaaagaagaagaaaaaactgtcggaggaatcgttttagcttctgctgctaaagagaaaccccaaactgggacagttgttgcagtcggtgaaggccgtttgttagaaaacggtgaaaaagttcctgccgctgtaaaagcaggcgaccaagttatgttcgaaaaatacgccggtacagaagtaaaatacgaaggaaaagaatatctgatcgtcgcaggaaaagatatcatggcgattgttgagtaa

SEQ ID NO: 3316 - DNA (genomic), 1695 bp, Enterococcus faecium; double-stranded, circular
  misc_feature (B) LOCATION 1...1695
  hypothetical: NO
  anti-sense: NO
ggagcgaatgtgatgctacaagaaatcagtattactaactttgcgattattccggaattgcggctttcttttcacgaaggaatgaccgcgctgaccggagagactggtgcgggtaaatccattattatcgatgctttaggtctgttagcaggaggaagaggttcaagcgattatatacgtcaaggagcagaaaaatgtgtgcttgaagggttgtttgaactaccaaaacaagaaggattctctgaactgatggttgaattagggatcgaaacagatgaggacaatctgattgttcgacgggatatgtccttaactggaaaaaatgtttgtcgagtgaatggtcatattatcacattagctaatctgagaagaatcggcagttatttagtagatatccaaggacaaaacgaacatcaggaactgctccagcctgaatcacatcttgctttattggatcgttttggagatgtagctttccaacagaagaaaaagagttatcagcaagaatatatctcttatcgtgagctggaaaaaagggtacgaaaagtgcagcaaaatgaaaaatcctatgttcagagaatagatatgctccatttccagcaagaagaaatagctgctgctgatttgcaagtcggagaagaagagaaattaaaagaagaaagagaaaaacttagcaattatcaaaaaattgctgatggattagctgcaggttacggagcactgacgaataatgaacaaaacagtgtagatggtgttggcttggccgtttcagaactgcaagggatcgcccatctagatgtggagtatgaagcaatttatgaaaatatccaaagtgcttactatttgctgcaagatgcaatcggcgatatgagtcgtcagattgatttattggagttagatgagagtcgtttagaagaagttacgcaacgtttagaattaatccgacagttgaaacgtaaatacggcgaatccattgagtcaatattggcttactatgacgaaatcaccgaagagctagcttcttctgatttttcagaaggtcaattggacaaaatgaaagaggaactagagcaaaaagagcttctacttcagcaacaagccgcagatcttcatgaagcgcgtaaaaaaatcgcaaaagaattggaaaaatccattctgcatgaattgaaaagtctgtatatggaaaacactgagtttgaggtacgtttcttaaaagaagaaaatagacaattgaatcatgatggatttgaccaaatcgaattttacattacgaccaatccaggagagccactgaagcctttggtgaaagtcgcttctggtggcgaactgtctcggatgttgcttgctttgaaaactattttttcttctgagcaaggtgtgacaagtattatttttgatgaagtggatacaggtgtgagcggaagagttgcacaggccatcgcagataaaatttctcaaatatcgaaatactctcaagttttgtgcatcactcatctgcctcaagttgctgcagtcgccgactatcaatattatattgtgaaagcagtgattgatggacgtacgcaaacttctgtttcagagttgaaaacaaaagaaagagaagaagaaattgcacgtatgctggctggaagtgagattacaaaactcacactcgaacatgcaaaagaactattgaaactcgcaaaaaggacctga

SEQ ID NO: 3317 - DNA (genomic), 318 bp, Enterococcus faecium; double-stranded, circular
  misc_feature (B) LOCATION 1...318
  hypothetical: NO
  anti-sense: NO
aaggagaatgtcgggatgaataagaaagcggcaatgcagcgaattatcgaattgacttattcagaagattggcaaaatgacaaagaagctgcttcagaagtgatgagacttggaagagcgatgtgggcagacaagagcaacaagccaagaccgcgaaaaatcgcaatttggcacggtgacaaacttctagtgacagggacagctgaacagttagcaagtctcacaggcttgcacgagaaaatcgtgagaaaaagagctaggtgtggatacacagacgttaagaagagaacgtttagatacgtggagggatcgtcatga

SEQ ID NO: 3318 - DNA (genomic), 318 bp, Enterococcus faecium; double-stranded, circular
  misc_feature (B) LOCATION 1...318
  hypothetical: NO
  anti-sense: NO
aaggagaatgtcgggatggataagaaagcggcaatgcagcgaattatcgaattgacttattcagaagattggcaaaatgacaaagaagctgcttcagaagtgatgaggcttggaagagcgatgtgggcagacaagagcaacaagccaagaccacgaaaaatcgcaatttggcacggtgacaaacttctagtgatagggacagctgaacagttagcaagtctcacaggcttgcacgagaaaatcgtgaggaaaagagcaaggtgtggctacacagacgctaagaagagaacgtttagatacgtggaggaatcatcatga

SEQ ID NO: 3319 - DNA (genomic), 987 bp, Enterococcus faecium; double-stranded, circular
  misc_feature (B) LOCATION 1...987
  hypothetical: NO
  anti-sense: NO
aataggaatgtctcggcctttttgaataggaagaatcaaacatatattctggatatattggagaaaaacatgaaaacagcattcttatttagtggccaaggtgcacaatatcaaggtatgggaaaagatttatatgaagaagccgttgtaaagcagacatttgatgaagcaagtgagattctcggctacgatatggctgaactttgctttacagaaaatgaacgtttggatcagacgcaatatacacagccagctattctaacagtcagcatcgcgtattatcgcttattgaaggagcatggaatcatcccagatgcagctttaggactgagtttaggagaatattcggcattagtagctagtaatgcgctatccttcactgaagcagttgcgttagtagcaaaaagaggcgcttatatgacagaagctaccccagctggaagcgggaaaatggttgcagtgatgaatgcgccgattgaaacgatcgaggaaagctgtcatgaagctagcaagtacggcatcgtatctcctgcaaattataatacacctcagcagatcgtgattggtggcgaagaaaaagcagtagacgaagctgttttactattaaaagaaaaagggttcaaaagaatgatccctctaaatgtcagcgggccttttcatacagctattttagaaccggcagcaaaaaaactggcgaaggacctaagtcagattcaattctctgaaccttcttttcctatcataagcaacacaacaacggaaataatgaagaaagaaacaatcgcgggactacttgaacagcaagtcatgcaacctgttcgtttctatgagagtatccataagttaaaaacaatcggcatcgaacaagtcatcgaagtcggccccggaaaagtattaagcggatttatgaaaaaaatcgataaaacaataccagttctgcgtgttgagaataagcagacatttgatgaaacaatagcaatactataa

SEQ ID NO: 3320 - DNA (genomic), 291 bp, Enterococcus faecium; double-stranded, circular
  misc_feature (B) LOCATION 1...291
  hypothetical: NO
  anti-sense: NO
atcgggaatgtaaagatcgttgttgataagaaactagcagtgtctcctaccaaattatccggagaaaaacctgtagtcagcagatgtaatactgaacgcaagaacgctgttgcaactccggccgctggaccgaataagaacatgctgatcaataccgagatatcactaaaatcgatcttcaaaaaactaaaagccggcatgatcggaaaagcaaaatactgtaaaactaatgcgatcgcagcaaacatcgctactgcaaccattttctgtacacgggtgttcttcatttga

SEQ ID NO: 3321 - DNA (genomic), 960 bp, Enterococcus faecium; double-stranded, circular
  misc_feature (B) LOCATION 1...960
  hypothetical: NO
  anti-sense: NO
gaaggtgatgtgaaaatggaagctaaaatcgaagaatccaaacaaaaaatcgatcagttgatacaagaattagaaaaagcggtcatcggtaaacgttccactatccaattgatgatcgttgccctgctagcaggtggtcatgtcttgttcgaagatattcccggtgtaggtaaaacattactagtcaaagcactagcaaaggctgtgcaaggaacctttagcagagtccaatgcacacctgatcttcttcctagtgatattttgggcttttccgtctataactcacaaacaaaagagtttgaatttcgtccggggccaatctttacaacgatcttgttagcagatgaaatcaatcgtacgactccccgtactcagtcagcacttttagaagcaatggcagagaatcatgcaacgatcgacaacaatacataccccctagacaatcatttttttgtcttagctacacaaaatccaatcgagtatgaaggaacatatcctttgccggaagcacagctcgatcgttttttattccgactacaaattggttatccttcttttgacgacgaacttctgctacttttggataaattcgaaaaagtgttggataatttgaaggtcgtcttgaacagtcatgaaatagaagaaataaaaacaagagtggcgaatgtctttgtcagcccagaagtggcatcttatgccttgcagttagtatccgcaacaagaacccactctgctattcagattggtatcagtccacgaggaagccttgcctttattcaagcagcaaaagcctatgcattaatccatgggagaaattacgtcacgcccaaagatttgcaggagttagttcctttcgttttttctcaccgcttgattttttacgatcgttcattgaaggaagacgaaaagacacaaatgatccatacccttgttgcacaaatcccaattcccgtgaggtag

SEQ ID NO: 3322 - DNA (genomic), 303 bp, Enterococcus faecium; double-stranded, circular
  misc_feature (B) LOCATION 1...303
  hypothetical: NO
  anti-sense: NO
ttaatcgatgttacatcgcaaagagaaattgattacatcaaatttagtgatgaagttaaatattactatgacaaatctaaggggcgttacggtgctattaagatacagcgagatcttgaagaagctggtatcccttgttctgttaaaagagtgcaaagacatatggctaagcttggtcttcgcagtgttgtagtacgcaaatataagtatcaaaataaccaaggtaaggttccagacgataaggaaaatatactaaatcgtgattttactactacaacaataaacccaaaaatgggttactga

SEQ ID NO: 3323 - DNA (genomic), 729 bp, Enterococcus faecium; double-stranded, circular
  misc_feature (B) LOCATION 1...729
  hypothetical: NO
  anti-sense: NO
tctatagatgttttcagctatttacttaagaaagaagtggaacgaatggataaattacaagtgatcgctgattatagtatggaccaattagcgcatgatcaaacaggacatgggagcgatcataccaaaagagttgtcaagttagctgaaaaaattttggagacggaaccgcaggcagaccgctttgtgacgcttgcagcagcttacctacatgatacgattgatgataaagtcgttaaaaatgagaacgaggcaaagcaacagcttcgtgtattccttcgctctttgccaatagtagaggaacagatctcgatgattttttccattatcgaaaatatgtccttttctaaaaatctctctgaagcggccgaactatctctggaaggtaagatcgttcaagacgctgatcgtatcgaagcattaggagcaatcggcattttgcgtactgcttatttcggcggtggacatgggcacccgatttttgatcctgaactgtatccgcaaacattcaaggacaaagaaaattaccgaaaaggcacgacagtgatcaatcatttttatgaaaaactgttcttgctgtctgataaaatgaatactgattacggatatgaagaagccaaacgaagagaaaccttcatgcgtgaattcttagaagaattttttctggaatggtctattgacgatgaaaattttactccagacaattggatcaaaaataacaaaaaatga

SEQ ID NO: 3324 - DNA (genomic), 1053 bp, Enterococcus faecium; double-stranded, circular
  misc_feature (B) LOCATION 1...1053
  hypothetical: NO
  anti-sense: NO
gagaaagatgtgaatggcatgtcattaatccaactaacgaatgtcaaaaagacattcaatgggaaaaacggaaacatccaagccgtcaatgacgtttcactaaacgttgaaaaaggggatatttatggaatcgtcggctattctggcgcaggaaaaagtacattagtccgtctcctgaatggacttgagcttcccacgagcggcgaagtgatcgtaaacgatcaagatattacaaaattaaaaaacaaagaattacgtacattccgaaagaaaatcggtatgatcttccagcatttcaacctgttatggtcaagaactgtacttgaaaatatccagctgccgctggaattagctggcgtaccaaagagcaaacgtaaagaacgggcagaagaactgttgcgtttagtcgggttagaaggacgcggacaagcatatccttcacaactttccggcggacagaaacaacgcgtcggtatcgcacgagcattggcaaatgatcctgagatcctgctttgtgatgaggctactagcgcattggacccgcaaacaacagaagaagtattagacttattgttagcgatcaataagaaattgaatttgaccatcgtcttgatcacacatgaaatgaatgtgatccgcaaaatctgcaacaaagtcgctgtgatggagttggggaaagtcgtagaagaaggagacgtattgactgtcttcagacaaccgaaaaaagaagtaaccaaacgctttgtacaacaagacatcgaaccagaagctgattcgacagaactattagctgaactcatcaaagaaaatccaagcggccgtttggcaactttgacctttagcgaaagaaatgccaacgagccagtcatttcccaagcgattcgacgctataacatcgatgtcaacgttgtgtatggaaagatcaaacaagtgaaagaaggttcctttggttcattgactgtcttgatgactggtgaaaccaaagaattagatcaagcagaagtgttcatcaaagaacaaggagtaggaattgaggtgatccatcgtggataa

SEQ ID NO: 3325 - DNA (genomic), 708 bp, Enterococcus faecium; double-stranded, circular
  misc_feature (B) LOCATION 1...708
  hypothetical: NO
  anti-sense: NO
aaaggagatgtttttttgggaaaacgattgatcaaagaagtacctactagctctttaccaagggaacgtatggaaatttatggcgcggaagctttatcggatcaggagcttttggcaatcttactgcgtaccggtcaacacccttatagtgtgatgtcgattgctggaaatctgttaaaaacgtttggaggactggcctctttacgacaggctactttgcatgagttagaagagattcgagggataggacgcgtgaaagcaatcgaaatcaaagccttgatcgaattaggtcgacgaattcagacggatcatgaaagagcggctccaccggttcgtaccagctacgaattggcccagcaattgattctggaaatgaaagatcacaaacaagaacatttggtttgtatttatttggacacgaagaatcaagtgatcttaaaaaaaacagtgttcatcggttcgctgaatcagtcagtcgctcatcctagagaaattttccattatgctgtacgttattgtgcagcaaggatcgttttagcgcataatcatccttctggtaatgttattccatcgcagcaggatatgaattttaccaaaaggatacaaaagtgtggagaaatgatggggatcactgtactggaccacttgatcatcggacgcaaacgatattttagtttgagagaagaaggaatgatggaagagaagtaa

SEQ ID NO: 3326 - DNA (genomic), 297 bp, Enterococcus faecium; double-stranded, circular
  misc_feature (B) LOCATION 1...297
  hypothetical: NO
  anti-sense: NO
aacaaggatgtgcaagacaacatgtataaaccctacatgattagttatgatcttaataacccagggcaaaagtatgataaagtatttgaaataataaaagaatttggggcatatataaagctacaaaaatctttttggttagttaaaactaatttgaatccaaatcaaatgtgtgaaaaattaaatacagtacttgataataacgattccttattcatctgtgaactgcaaaaaaattatcaaggtagagctacagaggaaaattggaaattcattaacgaacatattttctcttag

SEQ ID NO: 3327 - DNA (genomic), 534 bp, Enterococcus faecium; double-stranded, circular
  misc_feature (B) LOCATION 1...534
  hypothetical: NO
  anti-sense: NO
ttgtcttgtgtttgttcgtcaaatcctaaaatcaatgtacctacgaatgcaagaacaaaagcaattcctgtagctattactgctactgtcacatttgactctacaccatccaccgtattaatgaaagtcggaatcgtcaataagctgaccaaactgctggagaaagcttttactccggaaaatccgataatagctccaccaatacctccagaaatacaagcggcaatgaatggtttcttcaaaggtaatgtcacaccatacacagttggttcagtgattccaaataacgaagtcactgtagaagaaatccctaatgctcgaagtttcgtatcttttgttcgcaatgctacagctaaagcagccccaccttgtgccaagatggctggaagaagcattggcatcaatacatcaaacccatattgttcgatattcaaaaacatgatcggtacgaatccccaatgcatgccgaacatcacgaatacttgccataaacttcccatgattagacctgctacgattggactaaatccataa

SEQ ID NO: 3328 - DNA (genomic), 285 bp, Enterococcus faecium; double-stranded, circular
  misc_feature (B) LOCATION 1...285
  hypothetical: NO
  anti-sense: NO
atcgcatgtgtcgggtcaccagtctgcagctttttttggatgagtttatcattggcaacgattttagcaatgctagagattttatctgacacactagatcggttcatcgaaagaataaaattcctgatcaatatggcagaaacaatcaaagaaacgaatgtggagaaacaaacgacaaggatgatcgtgttctggagctttaatggttttttcttaaaaaaaggaaacataggctacctcgaaagaatttattgtgaaaattttaacatgaaaacaaaaatttaa

SEQ ID NO: 3329 - DNA (genomic), 672 bp, Enterococcus faecium; double-stranded, circular
  misc_feature (B) LOCATION 1...672
  hypothetical: NO
  anti-sense: NO
gaacctcgtgttctggctaatcgaacatccttgcagttggggttacaggcaaatatctttggaacagtcctagggacgattttaggaacgatctctgccatgaagcaaaatacatgggcagatacatcttctacactcgtagcgatattaggtcgttccattccaaactttgtatttgctgttttattacaatatatctttgcaatcaaattacaagttttgccaatcgcaaaatgggatggctttgtgtacacaatcttaccaacaattgcgttggccatgtcgccgcttgctgactctgctcggtttatccgtacggaaatggtggaagtactgcatagtgattatgtggaattagcaaaagcaaaaggattgagccgttgggaaatcgcctttaaacatggtcttcgaaatagtttgattccattgatgactttattaggaccgttagctgtagcattgatgaccggatcactggtggtagaaaatatctttgctattcctggtatcggggaacaattcgttaagtcaatcacaacaaatgattatcctacgatcatggctgtaacgatcctttactcatttatgctgatttttgttattttgatcgtggatctattgtacggtctagttgatccaagaattcgtgtttcagaagggagccgaggataa

SEQ ID NO: 3330 - DNA (genomic), 192 bp, Enterococcus faecium; double-stranded, circular
  misc_feature (B) LOCATION 1...192
  hypothetical: NO
  anti-sense: NO
tttaaacgtgtgattttcataccagaagcaataaaaaaaccgacagctaatgctataccgaaaatcagacaagaaatacccatgaacacatatcctgctgaacaaaagaaaagaaaacttgcaaaagataagctaatgaatagaacacctgatgccacttggagacttgccgctctgtattctttccagtag

SEQ ID NO: 3331 - DNA (genomic), 342 bp, Enterococcus faecium; double-stranded, circular
  misc_feature (B) LOCATION 1...342
  hypothetical: NO
  anti-sense: NO
gcagaacgtgtatgctctgttttacaaaaaggggagagatccatggaacaattagcttataaatatccaacgaaacagccgatcaataagaaaatccatgtaggagtggtcggttcaggagatttggaaatcttgatgtttccaacagaaaaaacagaatctactgtaaaaatttgtacaggaagcgatggcttcggcgaagtatggaacaatgtattaacgagattttttgatcgttatccaatttcagcagatatcgtgatcaatgacttcggtgctacaccaggagttgtgtacctacgattgacgcaagcaatggaggaactttcagatgaaaaatag

SEQ ID NO: 3332 - DNA (genomic), 1419 bp, Enterococcus faecium; double-stranded, circular
  misc_feature (B) LOCATION 1...1419
  hypothetical: NO
  anti-sense: NO
aatttgcgtgttgtagaggaaaagaagatttctccaaaaatcgaggaaactcctaaaagtaaaattaatatcgcaagtattattaaaaaaaatggaattaaagaaaactctgaagcgatagaaggaaaccttgattttttaactaagcttttagaagaagatagtggaaattatgaaccaccaattgaagatgcaaaattaaatatgattcgtgatgatttaaccagaaactattcccaagaagttttacaagctttaactgatgatgaaattaggcgaaaacttgtacaagttgttttgaaagaacatggtactttctttaaaaaagataaagaggttgcagaatatgtagtacgtgaatgtattggaacagggattattgagcgaattatgaccaacgatgaaattacagatgttggttggaatggctctcaacttagcattgaaactaactctaacaaatggttgtttgacggtgataaattaaatatcacgcaagagtatattgaacgtgttatttctaaatatgctgttgtaaatgatcgggcttttaatagtggtaatcctatcatggatggaatgtttaaaaatgttcgtatatcagctacacacatagataattcaccagatggctctacgttttctatgcgtgtggcaaggcctagattagcattgaataaagaaaactttgaagattttgctcctgattatattttggagctatttgagaaaatgatgaaaacaaaagcaaatatctgtatatcaggggagacaggtacaggtaaaacggaacttcaaaaattactgctaagttttattgataatcatgatcgtatgattatgattgaggacgttcaagaaactcacgctaaagaattatttccggataaagatattttctcttggatcactactcccaaaaaagcaatttcagatttagtaaaagcttctcttagaaataatccacgatggatcattgtttcagaaacacgtggttctgaagcttatgaaatgcttcaagcggttttgtcaggtcactatgttgtaacgacacttcatgcggttaatgcacgtgcgatacctagacgttttgtaaatatgtgtgcaagtggttttaaaataaacgaaaatgcggttgaggaagacataaatcgttatttcgattttggtgtccatatcaaaaaaacagtggttgatggtaaagtgatccgttatttgaatgaaattgttgaattttctgctagtgaaccgactacagtttttaagcaaaaatttatcaatggaaagtttgtcattgaaaatggtagtctttccgaagattttaaagaaaaaatggctgaaaaatttattacgtttgaatttcctgaagatcaaactaatacagaagaatcacttcctgaagaagaagaggtgatttaa

SEQ ID NO: 3333 - DNA (genomic), 666 bp, Enterococcus faecium; double-stranded, circular
  misc_feature (B) LOCATION 1...666
  hypothetical: NO
  anti-sense: NO
ataatgcgtgtccgaaatcgtccgggagcagcggaaatgttagcggctcacccgaattttgtaattagtgatccaacattgtggaagggaaaatggaatgaattgtttgaaaacgatcatccaatccacattgagattggtatggggaaaggccagttcatcactggaatggcaaaagcccatcctgaaatcaattatattggagtagaaatgcaggtcagtgttgtttcgattgcactagacaagttgatcgaacaaccgcttcctaacctgaaacttctacatgtggatggatcagcgttgacagagtatttcgctgacagcgaagtagatcaaatctatctgaatttttccgatccatggccaaaaaaacgtcatgaaaaacggcgattgacatataagacttttcttgctgtagatgaacagattcttcgtccaaatggagaaatccatttcaaaacagataatcaaggattgtttgagtattctctggcaagtttttctcaatatggcatgatcctcaaacaggtatggttagatttacatcaaagtcaatttgaaggcaatattatgacggagtatgaagaaaaattttcttcaaaaggtcaacgtatttatcgagtagaagctcaatttcaagataagaccaaaaagaaaagtctgtga

SEQ ID NO: 3334 - DNA (genomic), 249 bp, Enterococcus faecium; double-stranded, circular
  misc_feature (B) LOCATION 1...249
  hypothetical: NO
  anti-sense: NO
tttgacagtgtgaggtgcgacatggcaattatcgttaatttagatgtagtattagctcaaaaaaaaatgagtgtgactgaattgagtgagaaagtgggcattacgatggcaaacatctctattctaaaaaatggaaaagcaaaagccatccgtttttccactctcgaaaaaatctgccaagttttggagtgtcaaccaggtgatttgttgacctataaaaatgactcgaatactataccagaagaataa

SEQ ID NO: 3335 - DNA (genomic), 228 bp, Enterococcus faecium; double-stranded, circular
  misc_feature (B) LOCATION 1...228
  hypothetical: NO
  anti-sense: NO
aaaaaaagtgtcgaaagaaatggaagaaaagttactaaaaacaatgaaacaaaaacaatgaaacaaaaacaccttaaaagattatctgtcgcgcaatatatcaatgatatgcagttaacaggaaaagagaaagcttgtttgttaggttcaatgaaaaactttgaacagttgagacgaacttatgtgaaaaaaagttctaattgtcaactattgttagaagtctcatga

SEQ ID NO: 3336 - DNA (genomic), 390 bp, Enterococcus faecium; double-stranded, circular
  misc_feature (B) LOCATION 1...390
  hypothetical: NO
  anti-sense: NO
aatgagagtgttctaaatttattgaaaagagaaaagcatatgataaaaggaattgggatcgatgcagtcgaacttcctaggatcactcggctgatcgaagaaaaaccaaaattcattgcacgaatcttgacctctgatgaaatgaaactattccagtccttgccttttcatcgccaagtagaatttttaggcgggcgttacgcttgcaaagaggctttctctaaagcttggggaactgggatcggaaaagttacctttcaagatgtcgagattttaaaaaatgaaaatggtcagcctgttgtgacgcgttcacctcatgaaggcaatgtatgggtcagtattactcatacaaatgaaacagcttttgcacaaattattttggaagactag

SEQ ID NO: 3337 - DNA (genomic), 1497 bp, Enterococcus faecium; double-stranded, circular
  misc_feature (B) LOCATION 1...1497
  hypothetical: NO
  anti-sense: NO
aataggagtgtaaaacatatggaaaatttagcagtaaatataacaaatctacaagtcagctttggcaaccagctagaactatctattgattctcttcgtgtctatcagcaagatcgtatagggatcataggagaaaatggtgtcggtaaatcgactttgctcaaactaatagccggtgaactttttcccgatcatgggaaaatccaaacagagatcaccttcaactacctgcctcaattaacctatctcgctgaagcaaaggacctaaatttggaattagccagtcatttccagttaagactggaagaaacttcagagcggaaatggagcggaggggaagaacgaaagatcgagttgatacgtcttctttcttcttatgaacaagggatgcttctagacgagccaacaacccatctagatagaaaaagtattgatcgactgattgaagagcttcgttattattatggtacgctggtttttgttagtcatgatcgctattttctagatgagctagcatcgaaaatctgggaagtaaaagacggagaaatccgagagttttcggggaattatagtgcctatctcactcaaaaggaattggagaaaaagactcagctacgagaagcagagtcgatcatgaaagagaaaaaacgattggaaaaatcgatccaagaaaagaaaaaacaagcggaaaagttggaaaaagtgtccagtaaaaagaaaaagcaacaaatcagaccggatcggttgtcttcctctaaacaaaaagacagtgtacaaaaagccatccaaaagaatgcgaaaacattagagagaagactccaaaaaataggagaaacaaccaagccgcagcagatgaaacaaatccgttttccagtaccaaaatctcttgaactccacagccgctatcccatcatgggacaaaatgtccaattggaaagaagtgggagaacattactggtaaatggtgattttcagttttctttaggtaaaaaaatcgcgattgtcggtgaaaatggttcaggtaagacaaccttattagaacatatccgcaaacaaggagaaggaatccttctctctccgaaagtaagctttcaagtatatcagcaaaagggttatcaaatgacatctgaagaatccatcattcgttttgtcatgagacaaacagagttttcagaatcgcttgtccgtagtttgctgaatcacttagggtttgctcaggaaactttgacgaaaccgttatgtacattaagtgggggagaagcgacccgtctgacgattgctttgctttttactaagccaagtaatgtgttgctgttagatgaaccgactaattttattgatatggcaacgatcgaagctttagagaagctaatgcaaatatatccgggaacgattttgtttacttctcatgattcttactttgtcgagcgtacggctgatgaagtttatgaaataaaagggcagaaaataaaaaaagtacttacgagaaatttttaa

SEQ ID NO: 3338 - DNA (genomic), 1227 bp, Enterococcus faecium; double-stranded, circular
  misc_feature (B) LOCATION 1...1227
  hypothetical: NO
  anti-sense: NO
aagaggagtgttcttgtgaaatacagtgaaattatggtccgttatggggaactttcgacaaaaggaaagaatcgaaaaagctttatcatgcaactagcacaaaatgtcagacaagctttgaaagactttccagaaatcaaaatccatgctgatcgggaccggatgcatcttttattgaatggcgcagacgggcagctagttattccaaaactagcaaaaatatttgggatccaaaatttctctccaagtattcgtgtagaaaaagatgtcgaagttttgaaacaagctgttcaagacatcatgaaagaaatttatactgggaaagaaacatttaaaattatcgctaaaagaagcgatcaccaatttgaattgacaagtaatgaattgaatcaaacattaggtaatgctgtttttgatattttcccgcatatccaagttcaaatgcgtcaaccagatattccattacgtgtagagattcggcgtgatggcgcttatctatcgtatgaaacgatcaagggagctggaggattgcccgtaggaacaagcggaaaaggaatgcttatgctttctggggggattgattctcctgtagcagggtactttgccatgaagcggggagtggaaattgaagctgttcattttgctagtccgccgtatacaagtgaacaagcactgcaaaaagcaaaagatctaacagccaaactagcaccttatgtgggaacgatccattttatcgaagtgccatttaccgagattcaagaagaaatcaaaaagtcagtgccacaaggatattggatgacaattactcgtcgaatgatgttgcgtttgaccgatgaaattcgccgtattcgtcatggtttagtcattttgaatggtgaatcattaggtcaagtggcttcacaaactttgcaaagtatggtggctatcaatgaagtaacgaatacgccaatcattcggcctgtagcgacaatggataaacttgaaatcattgaagtagcagaacagatcgatacatttaatctttctatccagccttttgaagattgctgtacgatttttgctcctccacagccaaaaacacgccctcaactggaaaaggtccatcaatatgaagagcgtttagcaatagatgaaatgatccaacgagcactagctggcttgaagatggaagagatacaagcagaatcgtctaatgaaaaaactgaagaattttcagaattgctataa

SEQ ID NO: 3339 - DNA (genomic), 894 bp, Enterococcus faecium; double-stranded, circular
  misc_feature (B) LOCATION 1...894
  hypothetical: NO
  anti-sense: NO
tccgctggtgtattcagaaagttggtgaaaaaaatgggtaaagaaagaacaaacaaacatcaatcgaaacgtggatttgaagacaaaaaacaaaatagatattcaaataaaaagcaaactggacgaaatcagtcagtttctgatcaaaatgaagaagcattagaagataatttcgtctttgggcaccatgccgcagtagaagcgctacaacaagggcgagggaataaactctttcttcaagaagattcacgaggagaaaaagtagaagaactgaaagaaatcgcacgtgaacaagctgtgccagtcaaatgggttcctaaacaaaaattagaaactttgagcgatcacggcgtgcatcaaggagtcgttcttgcgattacaccttatgaatatttatcccttgaccaactgattgaacgaacaaaagagaaaaaagaagaccccttctttttgattttggatagcatcgaagatccacacaattttgggtcgattttacggacagcagacgcaagtggcgtcgatggtgtgatcataccaaaacaccgagcagttggaatcacacctatcgtaacaaagacttccactggggcagtcgaacatgtccctgttgcacgcgtgacgaatttggtacaagctgtgcaacagctcaaagaaacaggattttgggtatttggcacagatatgaccggcacaaacttccaaaaatggaatgccaaaggatcaattgctttagtcattggtaatgaaggcaaaggaatgagtccaggattgaaaaaagaaatggatgaattgctgacgatcccgatgaccgggcacgtccagagcttaaatgccagtgttgctgctggtttgcttatgtatcaggctttttcccaacgtcagggggagtag

SEQ ID NO: 3340 - DNA (genomic), 486 bp, Enterococcus faecium; double-stranded, circular
  misc_feature (B) LOCATION 1...486
  hypothetical: NO
  anti-sense: NO
gagcgtggtgtaacggcgttctcaaaatgctacactttgctgcgaggtgagggaatggaaaaactgtatgatgtgatcgtagtcggcgctggaacaagcgggatgatggcagcgatcagtgcagctgaacaaggcgcacgcgtacttttgatcgaaaaaaacaaaaaagcaggaaaaaaactactgatgacaggtggtggtcggtgcaacgtcacgaataatcgtcctgttgatgatttaatcgcacatattcctggaaatggaaattttttatatagtacatttgcgcaatggaataatttcgatatcatgaacttctttgaatcacaaggcgtacatttaaaagaagaggatcatggacggatgtctcctgtgacaaataaatcaaaaacaattatcgaagcattacttaatcgtctgaaagaactaggatgtgacgatcctattctctactcgagtagagaaattgatccacaaagaacataa

SEQ ID NO: 3341 - DNA (genomic), 1134 bp, Enterococcus faecium; double-stranded, circular
  misc_feature (B) LOCATION 1...1134
  hypothetical: NO
  anti-sense: NO
tgggcaggtgttaagttaatggtttataaaatgaatgaatcgatcattgtgattcaagcagaagccactagtccaaacaggacgaatgttgttttttggtcgcatgatcgaggaacagctaagcttcgaatgaagttagttcggaaaaacggcatccctcaaagcttacccgaagggacaactgttccgattcgcttgatgttcaaatctgcaacggcagaaggtggttatggtaaacatgactatctagctacggtagaagatcctgtgaatggtattgtatttatcgtattagaagataatattttaggatatgtcggtaaagtagaaggtagcgtatatattgattttccaaacgaccgctcgttagatacagctggtcgttttactttttatatcaaacgcagtccaattgatgatagtacgccagagctggaagattattatttcaatgggtttagccagacaatcgataaaatcgaaaaaattctagctgatggaaagctagagattgaaaagaaaattgcggaatccgaaacgcagattgatgcgaaagtaaaagacacaaacgacaaaatcacgaaagctaatcaagatgtcgcaactctcaatactaatattgataaagcgaatgatcgtattgatcaaaccaatcagcaaatcggcgacctcggcaagctgaaaaagatgtacagtaacagcattgacttcggggactatgattattcgggaagacctaacttattcctaaatttagatttttcaaaactaagtaaaaatgcttcagagattacagaacctcctgcttatgttaaagacggcggttcgcattttgtacttgactttagcgatccgtcagcaaacgatgtaagtagaagcgtatatattccatctgtaggacggttagaaaaaggctctacttatatcgtaactgtgcctataatgattagtgaggatttctccacaaattacggctcttcgcctatctatccgtattgtgtatcagctaataacgttgtgacacgtgtcacttatttatatccagataatagttgtaggggaaaatgggggttcattaaagagacatttactgtacctgaaaacgtgtcagacggagaatttacttatttttag

SEQ ID NO: 3342 - DNA (genomic), 273 bp, Enterococcus faecium; double-stranded, circular
  misc_feature (B) LOCATION 1...273
  hypothetical: NO
  anti-sense: NO
gtcagaggtgttacgctctggtgggtagtcggtggagtattcagctgtctgcaaacattcatcacaaacgttatgatgaaaccacgtttgaaagcacaagtggcagaagagttgaaacaaaacccaccaaaacaagtcgtcactccaagaaaagatgtgacagaatcagctaaaccagctgacagcaaacaagcaaccaaacaaatcaagcaaccgaaaaacagtacaaacaacaaaggccgcaatgcaggaaagcagcagaagcggaaataa

SEQ ID NO: 3343 - DNA (genomic), 387 bp, Enterococcus faecium; double-stranded, circular
  misc_feature (B) LOCATION 1...387
  hypothetical: NO
  anti-sense: NO
aaagtgggtgtcgaaatgtttccagaaaaaatcaaagaattgaggctttcaaagaaaatgacgcaacaagaagttgctgataagttaggaattactcgccctgcttatacagcctatgaaagtggaaagagagagcctgacttttctattcttcaatctttagctaatatttttgatgttactactgattatttattaggaagaaataaaacgccaaaatgggccgatgaaaatgatttaattgaattagataaaatgctcgattccaacgttaacatggcttatggtggtgaaacattaacagatgaagagaaacaacgggtaaaagatgttttgacaggtctattttgggaatttaggaaagaagacaaaagtaaagagaagtga

SEQ ID NO: 3344 - DNA (genomic), 840 bp, Enterococcus faecium; double-stranded, circular
  misc_feature (B) LOCATION 1...840
  hypothetical: NO
  anti-sense: NO
cataatttcgtgagaaaaaaatacaattttttcttgaccatctcgttacgtaaaggattatgcttacatttgtcaggaggaaaaataatggagtacacaataaagaaaatgtcagagatatcaggagtcagtccgagaaccttgcgcttttatgatgagattggactgctaaaaccagctaggatcaattcttcaggttatcggatttatggcaaaaaagaagtcgatcgtctgcaacacatcttattttatcgaacaatggcattcaagttggatgatatccaagaggtcttagacaatccatcttttgaccaccagaaagctttaatcaagcatcagcaaatgttgctggaaaaacgggcacaaatcgataccctcttgacaactgtccaacagacacttgatatgtacgaaggaggaagaaaaatgagtgacaaagaaaaatttgaagggtttaaacaacaaaagttgaaagaaaatgaagaatcctatggacaagagattcgacaaaaatacggaaaaaaaaaggttacagcatccaatgaaaaatggatgaatatggataaagaaacgtatgaagaaatgcaaactgttgaaaagcagatgttatttgatctcactctttacttaaaagaaccagaagatgaaagcttagcagaccgtatcttccaagctcataagaagtggttctcttacagctggcctgaatatcagccaaaagcgcataaaggactaggaatgatgtacgaagccgatgaacggttcactgcatattatgacgagcgaagtggtcatggtgcagcaaaagctttaaatgaaattatccaaaaaaaggcgtaa

SEQ ID NO: 3345 - DNA (genomic), 2196 bp, Enterococcus faecium; double-stranded, circular
  misc_feature (B) LOCATION 1...2196
  hypothetical: NO
  anti-sense: NO
gttttatttttagttaaaataggggagatagaaaaaatgaaaaagtgtagaaatattattttatcaatgttatttattattactaatataacatcactgattcctgttcatgtctatgcggatgcaggcagagatatcagcagtaatgtcacttcgttgaccgtggacccaacgaatattacagatggaggaaacataaaagtaaaattctcgtttgacgaaaaaaaacaaaatatccaaccaggtgattatctttggatcaattggccaagtgaaggaaatattcgcggtgaaggattccaaaaagaaatcccattaatgattgaaaataaaaatgttggaactttaacggtcagaaaagattctgcgcaggttgtgtttaatgaaaatattaaaaacctagactcagtagaaggttgggggcaatttgagatacaggccagaaacgtaaccgataccggtgaagaaaatacgggaccattcaccgtgacgagcggtgataaaacagctactgtaaatgtgacaaagccagcttctggttcttcttctagcgttttttattataaaacaggagacatgctacctgaagatactaagcacattcgatggtttttgaatattaacaataacggcacttatgttgaacaaccagttaaaatcagtgatgaaatccaaagtggacaaagattagatccaagtacgtttgaaattaatcaaatacacttaggtgaacagaaggtttatagaggagaagagggaatccaacaatttttacaagatttccccagcgctacatttaatttttcagtaactgataattacattgaaataactataccaaaaaactttgtcaatcttaggaaaataatggtgagttataagacgatcatagaaaacccagaacaaataaattttgagaatcattcggaagcttggtttaaagaatttaataaacctgctgttgatggagaaagtttcaatcatacagttaaaaatatttcagcttctggtggagtcaacggtacagttagaggcgaattgaagattttcaaatatatcaatgacacagagattggtatcccaaatgtgactttcgaattaagacgagcagatgaacagcctattcaaggacagtctagtatcctgttgacttcgaatgaacagggagaagctagtatcaaaggcctgcaagtaggagactatgttgtaaaagaaaaagaagcacccaattggattgattttgatccactaagttcaaatgaactcaaattctccataaacgaaaatgatacagagggagtcagtttacctatttataacaagaaaaaggttacgaacatcacagcaactaaaatttggaacggtggaaccactccaagaccgagtatttattttaaattattcagagcaagtacaaacaattgggaaccagttcctgatgcagaaacaaaacgattagacaatggaataacttcagtgacttgggaagatatccaacagtatgatgatagtggaaacgaatatacgtttaaagtgcaagaagtagatcaaaacggaaatgattatgtcccttcaggttatcaaaaaattgaaaacgggctagtcgttacaaatgagaataaagaagtcatttcagtctcaggacaaaaaacatgggaagacaatgagaaccaagacggcaaacgaccgacgacgatcacagtaaatctattagccgacggtcaaccgatccaacacaaagaagtaagtgaaaaagatgattggcgctatcgtttcacaaatctgccaaaatacagagacgggcaagaaatcatctatactgtaacggaagacaacgtgcccgaatacagtacgacgattgacgggtataacatcaaaaacagttatacaccggaaaaaacaaatatatctataccaggtagccatataacaccgtggaaaaattttccagagaagacagagagagagaaaattagaaatctattctctcaaaaattgcaaatatttgctcatacaggagaatccagcgaacaaagaagcaattatattagtaagagagctgtacctaaacagataacaaataaatcaaaaagcattcttcctaaaacaagtagtaaaaaatctagttttgctgtaatcattggtttattgatagtaactatctgtgcgggagcgtcaataattttgtgtaaataa

SEQ ID NO: 3346 - DNA (genomic), 369 bp, Enterococcus faecium; double-stranded, circular
  misc_feature (B) LOCATION 1...369
  hypothetical: NO
  anti-sense: NO
ataaagttcgtgaaaaggggtaatcaaatgaagaatgatctgcaaatttcacaagaaacagagctagaaccgattgttgaagtggctagtaaattagatcttaaggaagacgatttggaactgtatgggaaatataaggcgaaaatcaatttttctggaatcaatcgatcaaaggataacgctgaggggcatttgatcttagttacttccatcaatccaacaccagctggcgaaggaaagtcaacgatcactgtagggttaggagacgcgctcaataaaatcaataaaaaatctgttattgcattgcgagaaccctcacttggtcctgtgatgggaatcaaaggttgtgctgccagcccggatatgcac

SEQ ID NO: 3347 - DNA (genomic), 540 bp, Enterococcus faecium; double-stranded, circular
  misc_feature (B) LOCATION 1...540
  hypothetical: NO
  anti-sense: NO
atatttctcgtcagacctactattatcaagcgaaaccgaaaggcttacggtacccgaaaattgaagaagtgtttagcaaagcgtgggcttcaactcagtcggcgccgaatcggtcgaatcatgaaacgccgcggattgacatctacctatacgatcgctcattttaaagggcaacgaacagcttgtaatgaagcgaaaacagcgaatgtattagatcggacctttacacaagaacagccattggaagccatcgttacggatcttacttatgttcgcgtggggaaaaagtggcattatatctgcttaatacttgatttgtttaatcgagaaattattggttattcctgtggtgagaagaaagatgcctcattggtaaaagaagcctttggacggataccgtattctttaacagacgtcaagctttttcatacagaccgtggaaaggaatttgataaccaaaccattcatgagattctgaatggtttggttatcaaattcttttccacgatccgtatggaagagttcgatttcttgaagtga

SEQ ID NO: 3348 - DNA (genomic), 636 bp, Enterococcus faecium; double-stranded, circular
  misc_feature (B) LOCATION 1...636
  hypothetical: NO
  anti-sense: NO
cagttactcgttactgcgggaatagggattttcgggaacggaaaactagtcaaagccgaagaagtcgcacaaaaaccaagtgaagtgacgattacattacacaaaaaaggtttctcatctgttccggaagaacgaccgaatagcggattggtttctacggattttggtgaagaaaatattccaggagtcgattttgatttgtttgacgtaacggaagtatattacgatttgattcgagataatcctttaacaccggaacgagaagacggtcttaattctgccgaagcgattgaatggattcaaaaacggcacacagaaagttggtttttaaaatatcgactgacaagtattgacaaacaaacaacgaatgaagctggagaagcggtattctctaccgtccaagtgacggaagaagcaccttcttctagagataaagtctatcttttcttagaaacttattcgccagctcatatttccagaatcgcgtctccaatggttgttatgatgccagtgatgatgcctgatatggtggatggcgtgtgggatggttctacatggaaagacacatacaatacagatgtgcatttgtatccgaaaaacgaaatcagagaagcagataaacagatgaatgtatag

SEQ ID NO: 3349 - DNA (genomic), 183 bp, Enterococcus faecium; double-stranded, circular
  misc_feature (B) LOCATION 1...183
  hypothetical: NO
  anti-sense: NO
gcaaaaatcgttttcaaccaaagtaaaacgactagtaaagaaaaaaatccgagcctcttattcaaaaaggcaggtgtttttatatatttcaagataatcttcctttctgcacttcttaatcacagaagtgccatgaaaccatgttacacagctcacttattctcatttattttactagtatga

SEQ ID NO: 3350 - DNA (genomic), 243 bp, Enterococcus faecium; double-stranded, circular
  misc_feature (B) LOCATION 1...243
  hypothetical: NO
  anti-sense: NO
aaaagtgtcgttattttttatttcgaaaagttgttaggtatctttgacaaccgttattcgcacattgaaagagttgagaagctatttaccaaagtcttccaaaagaattctgtcttgagtgttgagggttgtgaatttcgttctcacgtttccgttgaggataaactgagttttatttccgcggatggcgagacagaaaaattaatcgagaaaatttacctacacaaaaaattcctcgattaa

SEQ ID NO: 3351 - DNA (genomic), 270 bp, Enterococcus faecium; double-stranded, circular
  misc_feature (B) LOCATION 1...270
  hypothetical: NO
  anti-sense: NO
ttgaacgtcgttacgattagaggtgccacaacccaaggaataaggattgttgcattcaatacgatcggtaaaccgaaaatcgctggttcatttacattgaaaataccaggtgctaaagctaatcgtccaacatcacgatactgtttctttttaagaacaaaggccatcaataaaacgacagctaaagtcattccagagccaccaataccaacagtgaaggtttccatgaatggttttgtgatgatgtgtggtaattcttttccatgttga

SEQ ID NO: 3352 - DNA (genomic), 627 bp, Enterococcus faecium; double-stranded, circular
  misc_feature (B) LOCATION 1...627
  hypothetical: NO
  anti-sense: NO
aaggacgtcgtcatgtcagagcgtggattattaatcgtgttgtctggtccatccggtgtaggaaaaggcacagtacgaaaagcaatttttgagagtgaggataatgattttcagtattcgatctcaatgactacccgtaaaatgcgtgaaggggaggtcgaaggcgttgattatttcttccgaagcaaagaagagtttgaatcaatgatcgaagctggagagatgctggaatacgcagaatatgtcgggaattattatggaactcctttgtcatatgtcaacaagacattggatgaaggaaaagatgttttcttggagattgaagtccaaggagcaaaacaagtcaaagaaaaagtgcccgatggtgtattcatctttttgactccgccagatttagcggaattaaaatcacggatcgtaggccgaggaacagatgcagatgaagtaatcgaagaacgaatgaaagttgcaaaagaagaaatcgaaatgatggctctttacgactatgctgttgtaaatgatgaagtgccgctagcagttgaacgaatcaaaaacattattgccagtgaacattttcgagtagatcgcgtaatcggtaaatatattaaaatgttaaaggagatgtag

SEQ ID NO: 3353 - DNA (genomic), 566 bp, Enterococcus faecium; double-stranded, circular
  misc_feature (B) LOCATION 1...566
  hypothetical: NO
  anti-sense: NO
tgagggtcgtttgttccgaaatattgtttattacgcgcctgtttgncgngatnaaagaagatcaggaacattgtctanaaaaattggagaaagagaacttagaactcaaagagcgaataagatactatgaaaccaaattctgtaaaagaggtgattgtatgaaaccaaatcctgttgaaacaggtaaaagaattaaatcaattcgttctaattttggaatgactatggaacaatttgcagatttaattggaaatgctcaaaaaggaaatattaataattgggaacgaggattctcccttcccaacaaagaaagattaattaaaattgctgaattaagtaacaaaactatcgactggattaaatggggaactttagaagaatatataacttcataccttatcggtataggatatgagctatatattaaagactttccagagatacctcacaaagtctttaaagacattcaagaaaaatatagtgatacgttttcgttagataaagactatgaattattggattctataataaaaaatatatttacaaaatattactcaaacggttga

SEQ ID NO: 3354 - DNA (genomic), 222 bp, Enterococcus faecium; double-stranded, circular
  misc_feature (B) LOCATION 1...222
  hypothetical: NO
  anti-sense: NO
aacgaatgcttactgtacatgttgataacccaaaaatacgatattcatattgaaaaaggcgcactagaaccggctggatcatggttccaaacgatttggagacctcaaaaagtagctgtgatcactgatacaaacgttgctccactatatgcagaaaaaatcatgttccaattgagacaagctaattttgaaccagtcctttcaatccgtaccggcgggtga

SEQ ID NO: 3355 - DNA (genomic), 795 bp, Enterococcus faecium; double-stranded, circular
  misc_feature (B) LOCATION 1...795
  hypothetical: NO
  anti-sense: NO
agaaattccgttatagttagagtaaggaaggaaggtgtggctatgaattttacacgtaaagataaatatacgattaaagaagaagtctttcgattgatcagccagcaggaaaataccgacaaggatcaagaccttcaatttcttgaagcagaattagctaaattattcatagcaaatcaaaatgagacaacagaaccagatgaagagctgtacataggcaaatggttgtttgatgaatttcagcctttagatgaaaataccggtatcggttattttgtgttcctttctccagtcggcttcacacctggcgtattagttaaacaaaacgacgaaataaccgtcaaagcatggcctgcattattttcagtcatcaaagcagaaggagtaatcaaaaagatccagtcggcctattataaaagtcaatttattgccaacagcaaattaatgaatatgttttataatcgtctagtagaaattgctaggcctgggaaaatcccgcaaacattcacgtacacacagcaaaaaaatctctatgaagaagtattgtattcccgcgatctgtctgagttttcgccatgggaagaggtaaggctccatgaactgttaagtacaaaaccagtttcattgaatttttttaatgcattagataacaaaagaaaattaatttcaacaaattattgggaagtatttgctgcaagaaaaaaatggatggaagaaaagaagattgccgatcagcagatccagtttgtccagctgaaaaaagaaaaactatattatgggttatacagccgttaa

SEQ ID NO: 3356 - DNA (genomic), 1437 bp, Enterococcus faecium; double-stranded, circular
  misc_feature (B) LOCATION 1...1437
  hypothetical: NO
  anti-sense: NO
gggcaatccgtggtgtcgactnttgatagcctttcttgtagagtcaacaacgagagcagtttttgtatggaagaagaaaagttaactcgaagtcttagtgcccgtcatatccaaatgatcgcactaggtggaacgatcggtgtcggtctgtttatgggtgcctcctcaaccatacgttggacagggccctcagtgatgggagcctatgcgattgcaggattctttttgtatttgattatgcgtgctttaggcgaaatgctttacgttgatccttcgactggttcttttgcaaattacgcgagcgagtacatccatcctgtggctggctacttgaccgcttggagtaatatttttcaatatattgtcgtaggaataagtgaagtgattgctgtaggatcttatatgaattattggtggcctgatttgccggcaattattcccggaatcattgtcgtcttgtttcttatgctggcaaatcttatttctgtcaaggcgtttggcgaattagaattttggttttcgatcatcaaagtcataacgatcattttgatgatcattgcaggtcttggggtaatcttatttggatttggtaatcatggtcaggcagtagggatttcaaatctttggaaaaatggtggattcttcactggaggcgtcaaaggatttttctttgcattatcgatcgttgttgcttcctatcaaggaatcgaactgatcggaatgactgctggtgaagcagagaatcctaaaaagacgatcattgaagctgtccagtccactatcggtcgaatcttgattttttatattggtgctatttttatcattgtgagtatctatccgtggaatcaattgagtgagattggttcaccttttgtacaaactttttctaaagtcggcattacatttgctgcaggactgattaattttgtcgtgattacagcggcattatcaggttgcaattcagggattttcagcgcaagtcgtatggtctatacacttgccataaatggaaagatgtctaaaaaatttctgaaactatctcgtcacggtgcgcctttttatcctgtcgtagcaatctcaggtggaatcttaattggtctgatcttaaattatcttctaccaatgttcatcaaccagtcagaaaatattttcgttttcgtatacagctcaagtattttgcctggtatggttccttgggtagtgattttgatcagcgagattcgcttcaaaaagaagcacgcagataaaatgcatgatcatccttttaaaatgccactatctccttatacgaattatgtgacacttgcttttttagctatcgtattgattttcatgtttatcaatcctgaaacgagaatctcattgattattggactcgttttcttgctttacatgacgatccattactttgtacgcgaaaaaagaaccggaaaataa

SEQ ID NO: 3357 - DNA (genomic), 885 bp, Enterococcus faecium; double-stranded, circular
  misc_feature (B) LOCATION 1...885
  hypothetical: NO
  anti-sense: NO
aagaatcccgtctgcctcttgctaattatttacaaaaaggagtttgagatgtttccattaaatttaggcatccgtgcccacgatttagatgttcgaaatcgtgaagaaatcgttcaaaaagtatcacagcttcacttgtcccatatccaatttgcaccacaaaaagcatttcctgaacaacttaaattaactgacatgacacttgggagtgctgcctattttggtgaatacttccaaaaaaacaatatcgaactttccattttaggatgctatatcaacctatccagcaaaaatcaagaagttcgtgcacaagcattggcaactttcaaacagcaaattgctctgtgctctgcctatcaagccaagatgattgctacggaaaccggtagtgtctctgtcggttacacaaaagaaaattttactgaagaagcttatcagatcgccagaaattctatcattgaattagtcgctcatgcagaaaattttggcgtaactgttgctgttgaagcagggatcaatcatccaatctataactatcagttagctaaacgtttaatcgatgaagtagcttcaccaaatttaaaaatcattttagattgtgcgaatttgatgcataaagaaaatcatgctgatcaggaaaaagtgatccgaggtgccttggacaatttacatggttatattacagcgcttcatctcaaagactatatcatggaaaatggaaagatccgcatggtacctgttggcaagggctgtttagatttccgcccggtactgcattatatcaaatatgagcgtcctctaatgtacgccactcttgaagctactcctgagatttatgttcctgaagcaatagaacacttgcagtttatttaccaagattgttaa

SEQ ID NO: 3358 - DNA (genomic), 849 bp, Enterococcus faecium; double-stranded, circular
  misc_feature (B) LOCATION 1...849
  hypothetical: NO
  anti-sense: NO
aaaaagtgcttatggattggtcacaccttttgttattttctttattgtgacgattttgagttccccatcattatctcgtttgcttttagttttatgaaaattggctactcatttgaatttgttggatttgacaattatctagctatcttccgagatccattgtttattaaatcttacacgaatgttttgattatcatggcaggatcaattccaataacgatgctattagctatttactttgctgttttattgaattcagcacagttaaaaggaaaaggattttttagaactgtctattatattccaaccattacatcaacggtggctgtagcttccgtattcatgacttttttcaatccgactgggttattcaatggatttttgaatgcgctaggaattaacggtgtacagtggttaacaaatcctttttggatacgaatatcaatgatcatcacgatgatttggcttagtgtaggatataacactattttatttttagctggtcttcaagggatttctaaagagatatacgaaagtgctgaaatagatggagcatcgaaatttcggcaattctttttattaacgatccccatgctaaagccaatcattttaatggccacagttttagccactatcaatggcttgggtaatttcaatatcccaaatatattctttgggacttccaatggaccagaaaattcagctttggtcgtaggagtcaatttatataaaacaagttttgaaatggttgattttggaaaagcctctgctattgcctggacgatggtgtttgtatctgttatattatcggctattcaatttaaattcggaggtgataaaaatgactaa

SEQ ID NO: 3359 - DNA (genomic), 222 bp, Enterococcus faecium; double-stranded, circular
  misc_feature (B) LOCATION 1...222
  hypothetical: NO
  anti-sense: NO
aggaagtgcttaaagatggagagcttatatgatgtacagcagctgttcaaaaaatttggcatctttatctatgtgggtgcacgcatctatgatattgaattgatgactattgaattgcggaatctgtatgatagccgtttgatcgatcatgatacatacatgacagcgtggcgcatattaaaaagagagcaccgaattgaagaaagccgaaagaaaagatna

SEQ ID NO: 3360 - DNA (genomic), 813 bp, Enterococcus faecium; double-stranded, circular
  misc_feature (B) LOCATION 1...813
  hypothetical: NO
  anti-sense: NO
tattcttttttttatcctttttttatgaataacaaaaaaaagaaaaacattatgacagaaatattttttgatacatggtatattggtgttattaaagaaaaggagggaaaaatcatgcaatcttctgcagaattaaaacgccaagcaaaagagagtctaaaaggacgttggggacaagctgttttactaaatctaatccctacattgattggtattgctactattcttcttattatgattcctattatcttgtttgccaccaccatatatgatggatcagcgagcgtctcagaagcgacaacttcaggaggcggtagttcaggaggcggtggcggaattatttccagcatcattagcgctttgttcatgagcggtatttcttggacttatcttgatattttacgtggacaaaaagatcagatcgaaccattcaaagatgcatttcgtggattcaaaggtttgtttatcggcggagtgatcagcttagctgtgctgatctcgatctttacaacattatggggtttgctattagttattcctggaatcattaaaagctattcttattctcaaagctattttatttactacgatatcgtccaagaaacaggacaaacacctaaagtactggatacgatcactgcaagtcgaaaattgatggatggttataaaggacaacttttctggttagatctttcatttatcggctggcatatcttagcattagcaactgctggtattggttatctatggctcagcccatacatttctgcaacaaaagcagcattttatgaacaattgccaaaagatatttaa

SEQ ID NO: 3361 - DNA (genomic), 297 bp, Enterococcus faecium; double-stranded, circular
  misc_feature (B) LOCATION 1...297
  hypothetical: NO
  anti-sense: NO
ttgaacaccgtttattcggaacaagggactttgacacgacttttgtcacagtcccttgtttttttgtggcattataagtggtatgatcgaaccaaattccaaagagaagtgagggaggaaaatgaagatcatcgtgattggacaaagtgggtcgggaaaatcgaccctcgcaaggaagatcaaagaaatcaccggctttccgctactgcctctagaccttttatggcatacgacagattacagtattcaggcaaaacagtggtttttacaagaacagcaatcgtttatggtatctaa

SEQ ID NO: 3362 - DNA (genomic), 228 bp, Enterococcus faecium; double-stranded, circular
  misc_feature (B) LOCATION 1...228
  hypothetical: NO
  anti-sense: NO
ttgaacaccgtttaccaagaggttgtgagcctaccatttaactccgaatcacaagaaataatttcaaaaacaacttctcctgtttttggttcggttggcttattatcgagaagtagctactgggagtctatttatcaaaaaaaggaatgcgacataggtcacaccccttttttattttctttgaaacatctttcggtactcgacagcatacaagacaaaagattgtaa

SEQ ID NO: 3363 - DNA (genomic), 1090 bp, Enterococcus faecium; double-stranded, circular
  misc_feature (B) LOCATION 1...1090
  hypothetical: NO
  anti-sense: NO
ggctgccgtggttatgacctncngnannatnatggcgatgggtccaaaagaaatgggctttaaagtaggtgtgctggatcctgtgagcgattgtccagccgcacaagttgcagattggcacattgaaagtgtctatgatgacacctttgcgctgaaagagcttgccagaagaacagatgtcattacctatgaattcgaaaacgtcagtgtagaggcgttaaatgcgattttacccatgtcatttattcctcaagggacagacttgcttgcgattacgcaagaccgcctgttagaaaaatcttttttggaaacgaataacatcgtgattgctccttatgcaacgatcgtcagtccgacggatatccaagatgcgattgacgggatcggctatccttgtgttttgaaaaccactcgaggcggctatgatggcaaggggcagtatgttttgaaaagtcgggcggatctagctcctgccatggaccttttaagagaaggaacctgtgttttagaagcatggatcccgtttgaaaaagagatttcgatcatggtggcaggaaatggtcaaggaaatttcacgacttttccggtcgtggaaaacatccaccacaacaatattcttcatgaaacgattgctccagccgcgattgatcaggatgtgatcgaggaggctgaacgtattgcccgtgtgattgcagaagcagtgagcctttcaggtgttttaggggtagaaatgtttttaacaaaaacaggcgggctatatgtgaatgaattagctcctcgtcctcacaattctggacattattctattgaagcttgttctatgagtcagttcgatgcccatattcgaggtatttgtggttggccattaggagaaaaagtacgtttgataagcaatgcagtaatggtcaatgttttgggagaacaactgctggaaagctatcgcttgattgagaataagccagactggcaattccatttctatggaaaaaaacaagcaaaaaaaggtcgcaagatgggacatatcactatcttgacagaagacatccagcaaacgctggaagaaatcaaacaaacgaatatttgggattag

SEQ ID NO: 3364 - DNA (genomic), 240 bp, Enterococcus faecium; double-stranded, circular
  misc_feature (B) LOCATION 1...240
  hypothetical: NO
  anti-sense: NO
aattctttttttatttttagattagagaaaatctcgtcctgtttttttcattttacaatcattgaaaaattgaatttcattgcaaaaaaaataataaacacttataaatatccattatctatccttcaatttttgtgtattttatttctattagaaaaaggtatcctgttggacaattttgttatatcaggtaaacttcattgcaataatgataacaaatgtactataattactttgtaa

SEQ ID NO: 3365 - DNA (genomic), 234 bp, Enterococcus faecium; double-stranded, circular
  misc_feature (B) LOCATION 1...234
  hypothetical: NO
  anti-sense: NO
gaatcggccgtccttcaaaaatctatcagctcaagccggggcaccatgaataaggttgtgagcaaaagattcagacctaatcattcaagaaaaaacgcaaaaacaactctttgtgagttacgttttttgtttcagaattttgatgtattcgtaaactttctgaataaaaaattaacaatagcagaaaaagctcgtacgaactttttctgctattgttttattggtttgtcataa

SEQ ID NO: 3366 - DNA (genomic), 228 bp, Enterococcus faecium; double-stranded, circular
  misc_feature (B) LOCATION 1...228
  hypothetical: NO
  anti-sense: NO
gccctatttttgtctattcttactgacaaaaacgttttcttaaaaaagaacaaaaaaactggcgtagctcttttacaagccacaccagcttttgatacgttgtttattttacatattcatgaacaagttcaacgacttcttccatcatatcgcattctttcaatgcacgatcagcaagttcagccattttcgctgtgtccaagcgtttcattaaactacgcgttttaa

SEQ ID NO: 3367 - DNA (genomic), 1038 bp, Enterococcus faecium; double-stranded, circular
  misc_feature (B) LOCATION 1...1038
  hypothetical: NO
  anti-sense: NO
aataagtacgtgagggagaaattgaaagggggaaatataatgaaaaaatggctgttattactaataggaatgggaattttattcactggttgtacatctgagaatacgaggactaaagcgactatagaaactgatacaacaattgagactaaaaaaagtaaaacgcaatcaactgaacaaactacaacagaaatgaagcaatctgtggaaacaagtgcaagttcaatcactgaatcttcttctgaagaggttaagaatactttgtgggatacgaataaagcttccaaattagaaacttttgtcacacaatggggaaagacattaggtcaagaatataaaagctacaatcttcagaataatgtaagtctgtatggcactcctttaccacaagccgtgattaatggcgattggaaaatggcaatcaatgaagcaccagttaccgtacaatggtcagaagatggaactggtcatgcagatttcaatttagtagcagtttattctgatgtagaaactggagaatatttagggcagcatgtttactttttcggttttcaaaatggacaacctaaagtttatttaacgcaacaaaatcaaggtaatgaaaataattatctgtactttaacgaaactcaaaatcaacagttaaaacaaggtttcagtgatattgtgaatggacaaactcctcaaacaccagtagtagaagaatctactcaacaagcaacaactacaacgacacaatctacaagtagttcaggaatttcaagttgggaagctgctaaagaatctgtgctaaataataaagctttatggttgtatgattctcctgataaaaatgtatcaaatactaatttaattagcacaaatgaatatatgaaagatctaatgcaagatgaaaatggaagctactattcaattaatattgtaacggatgatgatggaaacacgaccatggctggtggaaaacaatttcgtgtttatacagatggaagaatttctcaacgtattggaatgactaacaattttcaaatgattaaataa

SEQ ID NO: 3368 - DNA (genomic), 570 bp, Enterococcus faecium; double-stranded, circular
  misc_feature (B) LOCATION 1...570
  hypothetical: NO
  anti-sense: NO
ctagttcacgttaaaataagtcaaaggaggttttcttatatgtttgagacgattaaacaaaatattcaaaaatacgccttattaagagctgctgtttatattatttctgggattgcgattgtgctaaacccttctgctgtttttcattttatcggttatctgatcaccgcctatcttgttttgcttgggttgttgaatctttttgaggcttaccgttttaaaaggaaaacaggttcttggagtatcggtctgttcagtggtctttttttcctgatcttagctctgatcgtctatgcttttgcacctgcaatcgtttctatcctgccgattcttcttggattagctgttatcatcaacagcttgttccagttgttcttcagcatgaatacaaaagctaaaagttggagtgtttatagtagtattctgttgttgattggcggattcgtcttattgttcaatccattcaaaagtttgatgcttctattccaaatattcggctttattttgattttcatgggcatccaggagattatcaatttcatcagaataagaaaaatgactatacgttaa

SEQ ID NO: 3369 - DNA (genomic), 423 bp, Enterococcus faecium; double-stranded, circular
  misc_feature (B) LOCATION 1...423
  hypothetical: NO
  anti-sense: NO
atatctaacgttcaacgttcacttaatccatctaaacaatctttcaatttgattttttccccacttcttttacgcgcgcctagctctcctattgcagtaaacaacagatcacttgacgaatttaaggcagtttccattgaatcctggataacaccgataataaatccaataccgacgatttgcatcgcgacatcattagagataccaaacaaactacatgctaatggaatcaataacagtgaaccgcccgcaacacctgaagctccacaagcagctaaagcagacaaaatacataaaaggactttcaaaacaaaaggtgcttcaatccctaaagaatgtacagcagtcaacgtcatcaaggaaatggtaatcgcggcaccgcccatattgatcgtagcacctaacgggatcgatatggaataa

SEQ ID NO: 3370 - DNA (genomic), 300 bp, Enterococcus faecium; double-stranded, circular
  misc_feature (B) LOCATION 1...300
  hypothetical: NO
  anti-sense: NO
ccggtcaacgtaccagtaatagtagagttctggccagaagcaagaagtgctacagcaaataaagtggacaagataccagattttgctacagcaatcaaaataccattgctcatagctgatggatcagataaagcttcatacagaccaaaaaaggaaggatcttggacagaaccggttttgaagacagcgacacccatgatcaatagcagtgcattgactagaaaagccattgacaactggatattagaatcccaagtagaaaaacgtacagcttgtgctacatcttcttcgttttggtga

SEQ ID NO: 3371 - DNA (genomic), 246 bp, Enterococcus faecium; double-stranded, circular
  misc_feature (B) LOCATION 1...246
  hypothetical: NO
  anti-sense: NO
gcaaacaacgttgctaacaacgcactgctcaatccttcgacaaaagtaacatcttttccagcttcgattggaaataactggacagttccttgtcctggggtcaataatccccatatgacaatcacagcaattggtattaatttaacaatcaacgtcactgattgtacagaagcaccgacttttgtccctaacaaattcaaccctgtcacagaaacagcggtgatcactgcaatcaacaaaagataa

SEQ ID NO: 3372 - DNA (genomic), 714 bp, Enterococcus faecium; double-stranded, circular
  misc_feature (B) LOCATION 1...714
  hypothetical: NO
  anti-sense: NO
gcacttgacgttgaggatgctgacaaattatttgtattagattctaaagaaaagatcaaacgattcagtgagatagtctcgcagattccaatcgaatttatggattttgcggaagaagtgattgaactgataacagctaggatctcctctccattagattcaaatatctatattacattgacagatcatatttattttgctattcaacgaaaaagagaagatagagatgtcacagcaattatgttgccagaaatgagattcctttatccaaatgaatatgatatagcagtagaagtggtcgagcgaatcaatcatcgatatcaaaccgagttagggtcaaatgaagtaggattcatcactatgcatatcattaatgctgagctaggagagcctaatagtttaaagagcttaaaaatagtagaaatgacgaccacgattttgtcccatctagaaaaatcctattcaaacgtttatgataaagaatcactgacttatcatcgcttaatggttcatatcaaattcctggttaaacgcttgatttatcaggaagaaacgccagtagaaaatattggtttttttactgaaacatttaaacatagcaaagcgtattgtacagcactaaagattaaagatatcatcgaacagcaatttcaacttgccattcaagaaaatgaaatcatctatttggcaattcatctagcaagaatctattaa

SEQ ID NO: 3373 - DNA (genomic), 1797 bp, Enterococcus faecium; double-stranded, circular
  misc_feature (B) LOCATION 1...1797
  hypothetical: NO
  anti-sense: NO
tattgccgcttctcaattatcaaaggaggaattagcatgaaaaaaaccttttcttccttaaaacgtttagctcgatatatcagaccgtatcgtgagacttttcttttagtgatcctatttacagttctgacagtggctttcaacgtggctttgccatatgttacaggacttcctactacagaaatcagccgtaatattgccaatggcgaatcaatcaatttttcttatatattcaaatgtctcatttggatcacagttgttggaatagggtattgtatttcgcaattactttctggtgttttgatgacaaatgtcgttcaaagtgccatgcatgatttgagaagagacatagaagaaaaaatcaatcgtcttccggtttcatatttcgataaaaaccagcaaggaaatattttgtctcgtgtgacgaatgatgtagatgcagtcagcggtgctttacaacaagcttttattggtatcgtaaatgcgatattgggaattacgttggctgcagcaatgatgttttatatccagccgatgatggcgctgatctctatgatcatgattccaacatcgatctggatctcaaaacgagtgatcaatgcttcgcagaaatattttcaaagcatgcagaattctcttggtgagctaaacggctacgtccaagaaaatatgacaggttttagtgtattgaaagtatatggacgcgaaaaagaaacattggaaggattcaaaaaagttaatcacagcttgaaatactttgggtttcgtgcagcattcatttctggcttgatgatgcctctagttcaattaactgcctatgctacttatattggtatggctgttctaggaagcttttatgttattactggggcgatcgttgtcggtcaactacaagcattcatccaatatatttggcaaatcagtcagccaatggggaacgtgacacaattgtcttcagttttgcaaagtgcatcagcggcaacgaaacgtgtattcgagattttagatgagccagaagaaaaagaaaacaaagtagatgcttcactgccagaaacgattttaggagatgtgacattcgatcatgtcgattttgcatatgatccgaagaaaccattaatccaagatttgaattttgaagtgaaagctggtcaaaccgtagctgtggtcggtccgaccggtgccggcaagacgacattgatcaatctattgatgcgtttttatgacgtagacaaaggagcaataaggattgatggaatcgacaccaaatcaatgagtcgcagtgatgtgcgttcgctatttggtatggtcttgcaagatgcatggctttatcaaggaacgattgcagataatatccgcttcggaaagcttgatgcgacagattatgaagtagttgatgctgcgaaaacagcaaacgtagatcattttatccgaacgatgccagatggatatgatatggccatcaattctgagggagacaatgtgtctttaggacaaaaacagttgctgacgattgcccgagcagtggtctccgatcctaaaatcttgattttagatgaagcaacaagttcagtagacacccgtttagaagcgttgattcaaaaagcaatggatcgcgtgatggagggacggacaagtttcgtcatcgctcaccgtttatcgacaatccgtgatgcagatctgattctagtgatggatcaaggtcagatcattgaaaaaggaacgcatgagagtttattggcacaaggtggattttatgaaaaactgtataacagccaatttgctgaggaagcagaataa

SEQ ID NO: 3374 - DNA (genomic), 207 bp, Enterococcus faecium; double-stranded, circular
  misc_feature (B) LOCATION 1...207
  hypothetical: NO
  anti-sense: NO
gcacgccgctttcacctaatgaaggcaatacagtcgagatgtaatcagaaaacaaatggttgggtgaaaatagaagaacgttttcagcctcgagccacttgcgattatgatacaacagaaaagcaatacgttgaagcaaagcggatgtctttccacttccggcgattccttcaatcagcattactttacttgttgtgtcccgaatga

SEQ ID NO: 3375 - DNA (genomic), 249 bp, Enterococcus faecium; double-stranded, circular
  misc_feature (B) LOCATION 1...249
  hypothetical: NO
  anti-sense: NO
gacaaatgcgtatttgtcttagggtcnntcttttttttcccagaaacagggacttangggggccnnnagattaatatanaaaattggggggggggggagaaaatttttgtgggagaaagagggggagaaaaaccccccccccgggggggggttaaaaaaaaaaaaaaaaatcctctttgtggggcgcacccgaaatcatcccccgggtatgagcaccccgcccccgaaagaaaaattttaaagagatag

SEQ ID NO: 3376 - DNA (genomic), 498 bp, Enterococcus faecium; double-stranded, circular
  misc_feature (B) LOCATION 1...498
  hypothetical: NO
  anti-sense: NO
aaatacagcgtatactatataagggagcgggaagtaatgaaagcagaaataatagctgtcggaacagaacttttactaggacaagtcgtgaatacgaatgccactttcttgtcagaacagctagctgatctaggtatcgaagtttattatcaaacagttgtaggagataatcagcagcgtttagaagatttgattgctctagctgaaacaagaaatgaactcatactcttatgtggcggattagaccgaccagaagatgacttgacaaaagaagcaacggcggctcacctcggtaagtttttcatacaaaatacggaaggatacaaaaaattattggcatatttggaaacaacccttccaaaaaatgaccaaaaacaatttgcaacagtcccagattatcgaaggcggggttcctctaccaaatcgtacagggcttgctttagggactttttatcaaacagatacacatgcgtatatccctcttcccggtccgcctaa

SEQ ID NO: 3377 - DNA (genomic), 1035 bp, Enterococcus faecium; double-stranded, circular
  misc_feature (B) LOCATION 1...1035
  hypothetical: NO
  anti-sense: NO
taccaaagcgttatgaaacagttgcagatatccctgcggatgaatttcttccattacaaaaaaataccgaaggaagaacgtgaacagattactgcaccttctttgaattttatccaagattcatggcgccgtttaaagaaaaacaaagctgccgttatttcaatggttttactattggtcatcattttgatctctgtgatcacaatctttgtttctcctcatgatccaactgcccaaaacgtggcttatatcaatttgcctcctcgtattccgggaatcaatatcgatggattgaatggaaaagcaatggttggtggtgaacttgttgataaatatgctcaagcaaacgtcccttcaaacgtaaatttctttttaggaacagacggtttgggacgtgatgtattaagccgcttatttatgggaatgagaatctcgttgctgatcgcatttattgctgcattactagatgtaacgattggtgtagcttacgggttggtttctggtttgttaggcggacgtgtcgataacgtgatgcaacgttttttggaaatcttatcaggaattccaaacctcgttgtcatgattttgatgttggtcgtttttgaaccacgaattttttcaatcgtggctgctatggccatcacaaactggataccaatggcacgtatcgttcgtgcacaaacaatgaaattaaaagatcaacaatatgttttagctggattgacattaggtgaatcaagaatgaaaattgcattcaaacatattttgccgaatatctctagtgtcattattattcaaatgatgtttagtattccatctgctattttcttcgaagcctttttaaactttatcggtttaggtcttacgcctccgtcagcttcattaggaacgatgttgagcgaagggtacaagacattcctgtatctgccttatctattatggattccggcagtaactttatcggttatcatgattggctttaacttacttgctgatggattgcgtgatgcctttgatcctaaaatgaaagagtga

SEQ ID NO: 3378 - DNA (genomic), 1062 bp, Enterococcus faecium; double-stranded, circular
  misc_feature (B) LOCATION 1...1062
  hypothetical: NO
  anti-sense: NO
ctggaaagcgtgaatcaaatgaaagctaaacaatggttgaaaacagtactgattatcatatttggaatgttgatcattggatttgtagtagttcccttgccgtattatgtagaatcaccgggagccacgatcgatctgaaagaactaattacggtcaatgataaggaagataaaggttctgggtctttctctcttacctctgttggtatcaggcaagctacaggtttcttagctttaaaagctaaaatgaccccttttgaagaattgatcagtgaagaagaattgactggtggggcgacaaatgaagaatataatcaaatgcaacagtattatatggattcttcccaaaatgcagcaatcgaacaagcgttaaaacttgcagacaagccttataaaatggaattcaaaggcgtatatgtcatgagtgtagagaaaacatcgaatttctttggcaagctttcagttggagatacagtaacaaaagtagacgggaaaagctttcaaagtacagaagcatttatggattatgtaaaaagccaaaaagttggacaaacaatcgaaatcagttatttgcataatggtgaagaaaaaacagcttctggtgatctgatcgagttaccaacagataaaaaggcaggaataggtatcacgcttactgaccataccgagatcgaatcagatacagatgttcgtattaattctggctctatcggtgggccatcagcgggattgatgttcactttagaaatctatgaacaagtcactggtaaaaacttgcgacatggtaagcaaattgcaggaactggaacgatcaacagtgaaggagaagttggccgaatcggaggaatcgataaaaaagtggcaagtgcggataaagctggcgtagagattttctttgcaccagatgatacgatttcagacgatgttaagaaagaatatcctgaaataaaaaccaactacgaagaagcaaaagctgccgctaaaaaattgaattcctcaatgaaaatcgtaccagtaaaaacagtacaagaagcgcttgactatctagagaaaatgaaatga

SEQ ID NO: 3379 - DNA (genomic), 873 bp, Enterococcus faecium; double-stranded, circular
  misc_feature (B) LOCATION 1...873
  hypothetical: NO
  anti-sense: NO
ggtggaagcgtaatgttatatacaatgaaagagttattgaaagtggctaaagagaatcaatttgcagtaccagccttcaatatttgcagctatgatatgatgaaagcaatcatcgaagaagcagagagattagaagcaccagtaatcttagaaattcatcctgatgaaatcgcctatttaagtgttgagtttgttgcggcagtaagagcctatgcttatacaagtaaactgccgattgttatccacttggatcatggcggtacgatagaagatgtcttacgggcgattcgaaacggctattcttctgtgatgatcgatgcgtctttgaaatcattcgacgacaatgtacagattacgaaaaaagtggttgcgttagctcatgcggtaaatgtctcagtggaagctgagcttggaacgattgggaataatggttctgctgaagggggtgctgaaacaatcatttatacagatcctgatcaagcaaagatttttgtgaaagaaacaggcatcgatacacttgctgtagcaattggaacagcgcatggcttgtatccgaaaaacagaactccaaaattaaatatcgacttactgaaagaattgaaccaacaaatcgatcttccatttgttttacatggcggttcaggtaatccggacgcagaagtcagcgaagctgtaaaatacggagttgccaaagtgaatttgagctctgatcttaaaagtgtctttttcaatgctttgagagaaatattgagtgaacatccatcgatgtacgagccgaatgcaatttatccagcagctaataaaaaggtacaagaagtagtcaaacataaaatggaaattttgaacacagtaggcaaggctagtttatactaa

SEQ ID NO: 3380 - DNA (genomic), 1551 bp, Enterococcus faecium; double-stranded, circular
  misc_feature (B) LOCATION 1...1551
  hypothetical: NO
  anti-sense: NO
aaaaggagcgtgagaaaaatgcagttagtgatcgcggaaaaaccgtcggtcggaatggcgctgtctaaggtattaggcgcgaaaagccgtggcgatggttacatggagggcggcggctggctggtaagctggtgcatcgggcatctggtggaacttgcccccgccgatgcctatgacccccgttattccaaatgggaattatccggacttccggattttacccaaaaccttgggcagtttccaggtgctgccggacaccaaaaacagtttgaagtttttaaaaccgtgatacaccggggcgatgtcaccgccttaatctgtgcaacagacgcaggacgcgagggggaactcattttccgcctgacttaccatctgtgcggctgcaccaaacccgtcaagcggctgtggatttcctcaatggaggaagccgcaatccagaaaggcttcgacaacctgctggacgggaagaactacgacaatctctacgccgccgctctctgccgcgccaaggcggactggctgatcggcatcaacggtacgcgcctgtttaccacactgtaccagggcaagtccctgaacgtgggccgggtgcagaccccgacgctggcactgctggcagaacgggaagccgctatttccggctttcagaaagagaaattttacacggtggagttggaactggagggctttcgcgccgccagtgaacgctttgcatccaaaacggacgcaggcaggctgcgtaccggctgtgtgggcaagcctgcaacggtacagacggtttcccaaaaggagaaaaccgagcgcccgcccaagctgtacgatttgactaccctccaacgggaggccaaccggctgtttgactacaccgcccagcagacgcttgattatctgcaagccctctatgaaaagcggctggcgacctacccccgcacggacagccggtacttgaccgaggatatggcggcggggcttcccgcgctgtgccagtccgtcgctgcggcgctgccctttgcggcagatttgtccttgccggtaaatgccgcgcaggtaatcgacaacagcaaagtcaccgaccatcatgccatcctgcccacgacagaagcggcaaaaaccgacctgtccgcgctgccccccggggagacacacatcctctttctggttgccgcccgtctgctgtgcgcggtaggcgaaccccatacctatgcggaaaccgctgtcacactggaatgtggcggcgctgtcttttccgcaaaaggcaaaacggaaaccgccgcaggctggacggctatggagcagggctttccatgccacactgaaaaagaaaccgaagcagcccgaaccctccccgccacttcctgcactcaccaagggccagaagctgaccgccgggggtgcatccatcaaagagggcgcgacctccccaccggcccattttaccgaggacacgcttctctccgcaatggaacacgccagtgcaaaggagtttgcgaaactggaagatgtggaacacaaaggacttggcactccggccacccgtgccggcgtgattga

SEQ ID NO: 3381 - DNA (genomic), 1122 bp, Enterococcus faecium; double-stranded, circular
  misc_feature (B) LOCATION 1...1122
  hypothetical: NO
  anti-sense: NO
aaaggtggcgtaaagatgattattaaagaagagatttttgtacctaaagaattagtgaaagaaaaaattgacctgctcgttgaaaacctgacaacgatcaaagacgataatggtgaatttttgttggactttgatggactgaaagtagatgacaaaagctggacagtgtggaattggccacaaggtgtcggtctatatggtatttataaaaattaccagatgacaaaaaatcctcgcgcttatcaagtggtcaatgaatggtttgaggatcgtatggaagaaggcgctccgcccaaaaacgtcaatacaatggcaccgctattgactatggcttacttgtatgaagacacgaaagattcacgctatttgccttatttagaacaatgggcagaatgggtcatgaatgacatgcctcggacaaatgaagacgggttacagcatgccacatatggaccggaaaataagaatcagttgtgggacgatacattgatgatgacagtgcttcctttggcaaaaatcgggaaactgttgaatcgcccagaatatttagaagaagctcgttaccagtttatgatccatatcaaatacttgatggataaacgaacaggattgtggtatcacggctggacgtttgaaggaaatcataactatgccgaagcattttgggctcgtggaaactgctggttgacgattgctattccagagatcattgaaatcttagaattatcgaaagaagatgcattgcgcaaattattgatcgaaacacttgaagcacaagtgcgtgcattaaaaacttatcagtctgaaagcggtttatggcatacgttgttggatgatccttcttcttacgtagaatcttctgcaactgcaggatttgcttacggtattttgaaagcggtccataaacgttatttaccacaagaatataaagaagtcgcttatcgtgctatccaaggattgcttgaacaaatcgatgaaaaaggagaagttcaaaacgtttcaatcgggacaggaatgggggacagtttagatttttatcggaatatcggaatcacagcaatgccttatggacagtcgttaacggtgctttgtttgacagaattgctcgtctcttattgttaa

SEQ ID NO: 3382 - DNA (genomic), 2175 bp, Enterococcus faecium; double-stranded, circular
  misc_feature (B) LOCATION 1...2175
  hypothetical: NO
  anti-sense: NO
aggttgggcgtacgtatgagtcttaaaaatttacaagatgtcagttatttcaagctgaataatgaaatcaatcggccagtcaatggtcaaatccctttgaataaggataaagaagctttagttgccttttttgaggaaaatgtcaaaccaaatacgatgacttttccatctattatggaaaaaatcaattacttgatcgatcaagaatatatagaagcagaattcattcaattgtattcaccatcatttattgaaaagctatatcaatttttggacgagcaacatttttctttcaaatcttttatggctgcttacaaattttattctcaatatgcgttgaaaaccaacgacggttccgcttatctggaaacttatgaagatcgagtagccttcaatgcgctttactttgcgaacggggatgaagaattagcacttgctcttgcagacgaaatgatccatcaacgatatcagccagctacaccttctttcttgaatgctggacgtaaacgtcggggcgaattggtgtcttgtttcttgactcaagtcactgacgatatgaactctatcgggcgctcaatcaactctgctttgcaattgtcccgtattggtggcggcgtagggattactttatcaaatcttcgtgaagccggcgctcctatcaaaggatatgagggtgctgcaagtggtgtcgttccagtcatgaaattattcgaagatagtttcagctattctaatcaattaggtcagcgtcaaggagctggcgtggtttatttgaacgttttccatccagacattattgctttcctttcagcaaaaaaagaaaatgcagatgaaaagattcgcgtaaaaactctttctcttggcgtgatcgtacctgataaattttatgaattgacacgtaaaaacgaagatatgtatttatttagtccatatagtgtcgaaaaagaatatggtgtcccattctcttatgtaaatattacagctgagtatgatcatctagttgcaaatccaaacattcgcaaacaaaaaatcaaagcgcgtgatcttgaaaatgaaatctcaaaattacaacaagaatctggctatccttacgtaatcaatattgatacagcgaaccgcgagaatccaatcgatggcaagatcatcatgagtaatttatgttcagagattttacaagttcaaacgccttctgtgattaacggcaaacaggaatatgaagtattaggaacagatatctcatgtaacttaggctcgacaaatatcgtgaatttgatgcaaagccctaactttggtcaatctgtgcgtacgatgactcgtgcattgacatttattacagatgcatctgatatcgatgtcgtaccaccgatccaaaacggaaataagctgaatcatacgattggattaggtgccatgggcttacacacttatcttgcaaaagaacaaatggaatatggctcagaggattcattagactttacaaatatttacttcatgctgttgaattattggacacttgttgaaagcaacaatatcgctcgtgaaagaaaacaagttttccataattttgaaaaatcagcttatgctgacggcacttatttcgaaaaatacgtaactggagaattccagccaaaatcagaaaaagtcaaagcattgtttgaaggcatttttatcccaactgctgaagattggaatgctttgaaacaagcagtaatgaaagatggactgtatcatcaaaatcgcttggcagtagcaccaaatggctcaatttcatatatcaacgatacgagtgcaagtattcatcctatcactcgcatgatcgaagaacgccaagagaagaaaatcggtaaaatttattacccagcgccttatctatccaatgagacgattccgtattacacttctgcttatgatatggacatgcgtaaagtaatcgatgtttatgcaacggcacaacaacacgtcgatcaaggcatgagtttgactttattcatgcgttctgaaatcccagaaggcatttatgaatggaagacaacaacgaagcaaacgacacgtgatttgaatattttaagacattacgctttccacaaaggaatcaaatccatttattacgtacgtacctttactgatgatgcagaagaaatcggaagcaatcaatgtgaaagctgcgtgatctaa

SEQ ID NO: 3383 - DNA (genomic), 753 bp, Enterococcus faecium; double-stranded, circular
  misc_feature (B) LOCATION 1...753
  hypothetical: NO
  anti-sense: NO
gaggagggcgtgtttttggcaaaaaaatataccaaaaagcatgaagtttcatattatgagtgtgacatcaaccaaacgatgacatttccttcgatgttaggagtagttatcaaaacgtctgaagatcaaagcgaccagttgggaagaggcagtgaattcgtcaatagctttggacttacttgggtcatcacgaattattccatggagattaatcgtctccctagagtcggtgaagtaatctcagtaacgactcaagccatggagtacaataagtttttctgttatcggaacttctggatccatgatgaagatgggaaagaattagtcaaaatagaatctgttttcgtattgatggattttgtgaatcgaaaaatgagcagtgttaatgaagagatcattgctccttttgagagtgagaagatcaagaaaatcaagcgtcaggaaaaaattgaaaagattgattcgggcttcatgttgccatatcgtgttcgtttttatgatatcgatagtaatcagcatgttaataatgcgatgtattttaattggatcattgacgtattaggatatgactttttgactacgcatgttccagaaaaagtaattattcgatttgataaagaagtagagtacgggaatgagatcgaaagccattttgaacaaatccctatcgaaaatggtgtcaaaacaaaacatgaaatccgaatgcaagaacagctgtattgtgaagcaaatattatatggaaaaataaataa

SEQ ID NO: 3384 - DNA (genomic), 990 bp, Enterococcus faecium; double-stranded, circular
  misc_feature (B) LOCATION 1...990
  hypothetical: NO
  anti-sense: NO
ctatttttagtaataaattttatcttgaaaagaggagaaaaaatgttgaattacttgattaccggtggcgccggcttcattggctcgacgctcgcgaattatctaggaaaagaaaacaatgtagttgtgatcgatgatttatcgatggggaaaaaagagaatctggatgaatcgaagcacatcacgtttattgaaggggatgtcgctgacaaaaatttgatggaaaaggtcatgaaagaataccatttcgattatattttccatctagctgctgtagctagtgtggcagattctgtagaacgtcctctagaaactcatcgtgtaaattttgacagtgcgcttttattgcttgaattggtacgaaaatatcaatctggtttaaaacgattggtatttagttcatcagctgcagtttatggcgatgaaccaacgttgccaaaaaaagaagaatcggtcatccgtcctttaacaccatatgccatcgataagtttgcagcagaacaatatgttttggattactgtcatttatatgatgttccgactagtgctgtccgattttttaacgtttatggtccaaatcaaaatcctaactctccatatagcggagttatttcgattctagtggaccgatacaaaaaacaattggcaggagaaaaaacagaatttactttatttggtgatggtagccaatctagagacttcgtttatatagaagatgttatacaagcacttttacttgttgctaaggaagaaaaagctttaggacagcaattcaatgtcggtacaggaaaaagcactacgctacttgaattgattcattcaattgatcaaatcttaggaacagagctagcgcttaaatatgaagcggagcgttcaggggatattcgtgattctttagcggatatttcaaagatccgttctttaggttatcaacccaaatttgatatattgaacggaatggaacgttatttaaagacagaaatcgattga

SEQ ID NO: 3385 - DNA (genomic), 318 bp, Enterococcus faecium; double-stranded, circular
  misc_feature (B) LOCATION 1...318
  hypothetical: NO
  anti-sense: NO
ataactttagttactttaatgcgttcttactttatttttatattatcatttttcttattcacttctttggtttatactattcttataaataaaaatgaggtatgtcctatgatgaaaagattgtactattcattgatcataacgattggctatttgattgtatcaaatctaggaaatatggtatgtggtatcagtaaagaattcagttggactactacattatgggaatctctattcttgttcatcttgcgtatttttgttacaaaatgttcgaaaaaaataaacatgtggccactaacctgttggcacatgttttaa

SEQ ID NO: 3386 - DNA (genomic), 924 bp, Enterococcus faecium; double-stranded, circular
  misc_feature (B) LOCATION 1...924
  hypothetical: NO
  anti-sense: NO
tcttgtttagtatatatttttagaaaaaggagtggggtttttatggcagaaatcgtcaaagtcacacatttgaaaaagagctttggtcgtttcgaagctttaaaagatgtctctttcaccgtacattcaggtgaagtcgttggatttatcggaccaaatggttctggaaaatccacgacgattcggacacttttagggattataaaaaaagacggcggaacggcaacgatttttgggcaagatgtatgggaagatagtttatctatccatgaacgtctttcttatgttccaggcgatatctctttgtggggaaatttgactggaggagcgatcatcgatctcttcatgaagcttcatggaaaagggagtgctcaaaaaaaagatgaactgattcaacgtttctctcttgatcctaagaaaaaagcaaaaaactattcaaaaggaaatcgccaaaaagtgggcttgattgctgctttggctgttgattcggatctctatttatttgatgagcctacttctggtttagatcctttgatggaaacgattttccaagaagaagttgaaaaattgaaagaacagggcaaatccatcctactttcttctcatattctcagtgaagtcgagcgactagcggataaagtcgtgatcatacgcgaaggaacactcgatgaagaaggaacactcgatgaattgcgtcatttgactcgttcgaccatcactatagaaacagaagcagagaatagtcacttagcacaattgaacggtgtccatgactttgtgcaaaaaagtcacctcgctcaatttgctgctgataacgaagctttcgatgtgattttagctgaagcgtccaaattaggtgtgaaaaaatttgaatctattccaccgactcttgaggatttattcatgagacattatgaaggatga

SEQ ID NO: 3387 - DNA (genomic), 915 bp, Enterococcus faecium; double-stranded, circular
  misc_feature (B) LOCATION 1...915
  hypothetical: NO
  anti-sense: NO
ctatacttagtggtatgcttttttaaaaacaggagggaaaaaatggatattcgtatactgacgtattttttagcagtagctagagaaaaaaatatcagccgagcagcaaaatctctgcatatcacgcaacctactctctcaaaacaactgaaagatttagaagaagaacttggtgtgacacttttcactcggggctcccgagagatacagttgacggattctggtcgatatctttattcaaaaggaaaagaaatcttgtcgttggtagaaaaaacggcgaacaatttaacaaatgacgcaatcatctctggagaaatctacattggcggaggcgaaactaaagcaatctctttcatttctgatagccttcattcgttgatcaaggcgcatcctgatatccagtttcatttatatagcgggaatgcagatgatatcatagacaaactggatagcggattacttgattttggactcgtaatcgaaccgacaaacaaacaaaaataccagtcatttcgactgccagcccaagatcgttggggacttttgatacatcgaaatcatcctttagcaaagcaaaccgtcatccatccgcaggaactgaaaactgttcctttgatcatttcccggcaaacgtcagtggacagtcaactagctgaatggctaggtttcagcatagatcagttatcgatcgtcggaacatataacttattgtacaatgcttctttgatggtcgataacgggacttttggtgcattagctctagatgggatcatcaatacttatgggacggaaaaaatattcatcccactcgatccgccattacaagcttcactgaatctcatttggaaaaaagaccagcctctttctcctgctgctcgtaaatttttagatgtcctaacggagaaatacagttaa

SEQ ID NO: 3388 - DNA (genomic), 612 bp, Enterococcus faecium; double-stranded, circular
  misc_feature (B) LOCATION 1...612
  hypothetical: NO
  anti-sense: NO
gatttattagtttgcaacagcataatttttgacgttatttataagagggagtactataaaactgtaaaagaaatgaaagaaggattgaaaatggatgaaaaaagaaccatcgactggggctcattgattttgggaattttatttgtacttgtctcattgttatcatttcaagaccctgtcggaaatttagttgcaattgtagtagtctttgcgatttttgcctttattaaagggatatttgaactgtttgtacggaacagattaaaagagctaacaggatataaaggaaagatgcccttaataatcgggatcatcgatattctagttggcgtctttttcttattcaatattggtgcaggagtcgcagcattgccttttgtttttgcagtatggtttattgctgattcagttttagcgttatttactgctgacttggcaagaggagtaagtgaaggatattattggtttacgatcatcgtcaatattttaggaattttattaggaattttcttattgtttaatccaatttcttctgcgttgacattaagctttttagttggattctattttatgttatttggtatcacacatatcgtctatgcatttagataa

SEQ ID NO: 3389 - DNA (genomic), 186 bp, Enterococcus faecium; double-stranded, circular
  misc_feature (B) LOCATION 1...186
  hypothetical: NO
  anti-sense: NO
atcgtatttttgtttcctttttatttagaaaagccctttcaaaaaccaataaaaaaagaaactgggacaaaagtcaaacaagctcacaatttcagcctcattgtaggtagctttgagccgtttggacttttaccccagcctctttcaagaatggttattcaaagatgtcagcgtctagttctttga

SEQ ID NO: 3390 - DNA (genomic), 393 bp, Enterococcus faecium; double-stranded, circular
  misc_feature (B) LOCATION 1...393
  hypothetical: NO
  anti-sense: NO
gtatttctagtttatcctaggattaattataaaaataaaacattcgttgattcgaaggaggttaaacagatgtttgaaagttttgatagcagccgcaaccgttacgcttcagttggtgtcgtatcaagtttgccagatgaattgattgacagtatatggtttattattgacctagatcttaagggagtcattccattagaaaatatattaacctttgatttgatcgaaaatcgtggaaaagtgacgatgcatttttctcaagcaggaagcaatgtggaaatggatattgatttgccgtttgcctattcgaaccaatttcctgctcaagtatacgcctatgatgacggtacgagagaaacgatccttttaccaagtgagattagacaatattaa

SEQ ID NO: 3391 - DNA (genomic), 1191 bp, Enterococcus faecium; double-stranded, circular
  misc_feature (B) LOCATION 1...1191
  hypothetical: NO
  anti-sense: NO
taccatctagtggtaagtactccttgtaaactaagaagagatgatttcatggcaaaaatatcaaagtacaaaaagaaaaacggtcaagtggcgtggatgtataaaggacacattgccaccgatccacgaactggtgaaaaaataaatactacgagaagaggttttagtagcaaacaagaagctcaaaaagattatgacgagtacagacatcaaatattatacggtgttaaaaagaaagcacctgatatgacatttgaagacctgtataatgaatggataactcatcagcgtaccagtgttaaagcttcaacaatcgcaatctcagtaagatacgcaaataatcaaatacttccagcatttggtaagcttaaactatcgaatatctctgtcccatattgtcaaaaagtggtagatgaatggcacagtaaatatgaaagttacgattatatgagaaaacagactgcacaaattttacgctacggggttgcaatgcaatatattgacaataatcctatggaaaaaacacttcttccacgaaaaaaagagtatgagaaaaatcgtaaattttactcaaaagaggagcttaataatttactggatgcttttaaagattttggtaacatgaaacaatacgccttcttcagattattggcatacacaggtatgagaaagagtgaagtactcgctttacagtggaaagacatagacacgtttaataaagaactacatgtcaataaaactcttgctgtagatgaatttggtaaagttataattcaatctccgaaaacaagagcttctagacgagttatctctttagatactgagactctttctatcctcaacaactggaaattacagcaaaaagaagagtatttaaaacttggatacaatactagctctaaagagcaacatgtttttacaacagttaaaaacactctatacattccaaacactgttaatgattggttaagatatattttgaaaaaatataacttgcctcgtattacacctcatgggtttagacatacacatgctagtttattattagaagcaggagaatctgtcaaggtagttcaacaacgattagggcatgaaaatagtaaagtgacattagacatctatgcacatattacaaataatgcacctaagaaaacaggtcaagactttgctgatatgatggctcatcagtaa

SEQ ID NO: 3392 - DNA (genomic), 726 bp, Enterococcus faecium; double-stranded, circular
  misc_feature (B) LOCATION 1...726
  hypothetical: NO
  anti-sense: NO
aagaatctagtcactagttgtatagaatctattttgggggagattcatatgatcgaaatctatttatttgttaatcctttaggggaatactgtttcgaaatggaacaacagttattacaatttatcgaagaagagtacgggacaccatcaaaagaaaagatgcaatttcgctttcttcctttggtcaatttgcagacaattggggatgtcatgcaacaaaaaggaatttctcagaacaatcttgaggaacgtaatcacttattctcaatgacttattctgcagcattggactgcaaagcggcgcagtttcaaggaaagaaaaaaggccgccgttttttgatcaaattgcaagaagcagtcggctgtaatgacataccatattctcaagaacttgctgaatccatatttgaagaaatcggcggcgatttgaatatgtttaaagaagatcgtcagtctgacttcgttaaagaagtattcttttctgatcaaaaaattgctcgggaaatgggcatcacaaaacacccttctgcagtcgtttacaattatgcctgcgaccgtgattttggtgttttagtagaagtaaaaggtacaagtagcctttggagaatcacagagctgtgtaaaacaacagataactcatatcaagtttttaatggtgaacatttacatacaaatgattctcagttccattcaagaactagccatttacacttgctttctaattaa

SEQ ID NO: 3393 - DNA (genomic), 189 bp, Enterococcus faecium; double-stranded, circular
  misc_feature (B) LOCATION 1...189
  hypothetical: NO
  anti-sense: NO
acggatctagttgtagagactgataaaaatccacctgttgtcgtcctttctttttacttttattttttacagtcatctatgacaggttgtaaatactatggaacatcatatggcgttgtcattttcttgtcaactatttttcctattcatgtttttataaaaaaacatatcgttttcttgtatgattaa

SEQ ID NO: 3394 - DNA (genomic), 1122 bp, Enterococcus faecium; double-stranded, circular
  misc_feature (B) LOCATION 1...1122
  hypothetical: NO
  anti-sense: NO
tatatactagtaagaaagaaaggaggaaatctattgtttgaaaaacttagacagtctaaactaatgttttggtcgcttgaattattgatcatagctgcattgatcatgatttcatcagaaataaactttattttcgaaccgatcggaacatttttttccacgttatttgcacctgtactgattgcaggctttctttactatttattgaatcctattgtcaagctgttgatgaaagcaaaaatcaaaagaatatgggctgtcgcaattgtgctgctccttttagttgcagcaattatttggattttacttagtgtcatcccaagtctagtacagcaaatttcctcattggcatctaatatgcctgatttcatcaaacaggtagaaagctggttaaaagaggtagccgaattgcctttgttcaaggaagtagatatcaataaatattttgagcaattagacatttcttacgggacaatcattcagcaattccttagtggagtatccaatagtttaggttcgatcgttggaacgatcgcttcggcaaccgtagtaatcattacagcaccattcatcttgttctatatgttgaaagacggagaaaaactagtgccaaacatccaacagtttttcccagaaaaaagaagaaaccaaattgtggagttattggggcaactgaataaaacattggctaattacattagcggacaagcaatcgaatgtttattcgttggtaccttcacatttttaggatatatggtaattggtgtggattatgctttcttatttggggtcattgcgggattgacaaacctaattccatatttaggaccttatctaggactagcacctgcatttctagtaacagtcttcaatgatccggtaaaagcattactttgttgtgtggttgtgctaatcgtccaacagttggatgggaatatcatttatcctaatgtaattgggaaatcactgaaaatccatccattaacgatcattatcgttcttctagtagctggaaatattgccggattgcttggtatctttcttaggtgttcctttttacgcaatctgcaagacgatcatttcctatataatcaaaatcgtcaaagaagacaagcaaaatga

SEQ ID NO: 3395 - DNA (genomic), 186 bp, Enterococcus faecium; double-stranded, circular
  misc_feature (B) LOCATION 1...186
  hypothetical: NO
  anti-sense: NO
tacacactagtcacgcaacccatcaaagaaatgacgattgccattcctaatgaagcacgcaacagcatcaattttcttcctttttggtcggctaattttccccaccaaggagagataagcgtagtcaccaagaaagtagatgaaaaagccaatccgctccaaaagttcaatggtgacgtactataa

SEQ ID NO: 3396 - DNA (genomic), 1002 bp, Enterococcus faecium; double-stranded, circular
  misc_feature (B) LOCATION 1...1002
  hypothetical: NO
  anti-sense: NO
tttaaactagtgtgtaattcaaaaatctatatggaaggaacagtattaagaatagaacagggttctctacatgatggtgctggtttacggaccgttgtttatttaaagggctgcccattacgctgtgcctggtgttcgattcccgaatcacaaagcaagcagattgaaaaaggatttggccagaccatgaccgctgaagaggtaatggatgagattgagaaggatgctgttttttactttcactcggatggcggagtgaccattatcggaggcgaggcactggttcaggcggattttgctaaagaaattttgcaaaaatcgaaatacattggaatcaataccgtactggaaaccagcttttgtggtgcttataatgaaatccaaaaggtagctccctatgtggatacattgtttgtggatgtaaaaatgtttaccagcaagctccacaaacaatggaccggcttagataaccaacaaattttgaagaatattcgtcgctttttaattgagtatcctaactgcgaagtgcgaattcgagttcctgtggttccaggtatcaatatgaacctgaccgagctgctgacgattgcttgttttgtggcagatcttgatcggttcgtaccgttagaattactaccgtaccactgctatggtatgcacggttaccaagcattgggactggagtatccgttggcagacacgccagcgccttcacctaaagaaatgtttgcattggcagatcaactggctcgcacggttcctcatttgctggtcacagctttaaccaaaacatttatttatttattgaatccaagctttatcttatggataaatgaaagacactcactagctgcagccagctcaagaatagagcttttgctgaagtcagtgagtgtctttttacgatgttttttcgaagttaatttgtcgaatgaacactggctcaatcggtacatcttcactgtttgtcggctgagctgcgatcgctgctacgatttctaa

SEQ ID NO: 3397 - DNA (genomic), 246 bp, Enterococcus faecium; double-stranded, circular
  misc_feature (B) LOCATION 1...246
  hypothetical: NO
  anti-sense: NO
aaacagagcttgacttttagaaaggcagatcatcggatctgccttttcaagaggtttttttgtagaatcagcaaattgaaaaataaaaaagtatttgattttatttatattttgaaagatgaatggcaaaagctagagaaagaaaaaactgcacttatttatgaagaaattgaaatgattcataaaattgaaaatatccgaactattccgaactatattgaagcgaaaatattttttcatcactaa

SEQ ID NO: 3398 - DNA (genomic), 1440 bp, Enterococcus faecium; double-stranded, circular
  misc_feature (B) LOCATION 1...1440
  hypothetical: NO
  anti-sense: NO
atgaatatagttgaaaatgaaatatgtataagaactttaatagatgatgattttcctttgatgttaaaatggttaactgatgaaagagtattagaattttatggtggtagagataaaaaatatacattagaatcattaaaaaaacattatacagagccttgggaagatgaagtttttagagtaattattgaatataacaatgttcctattggatatggacaaatatataaaatgtatgatgagttatatactgattatcattatccaaaaactgatgagatagtctatggtatggatcaatttataggagagccaaattattggagtaaaggaattggtacaagatatattaaattgatttttgaatttttgaaaaaagaaagaaatgctaatgcagttattttagaccctcataaaaataatccaagagcaataagggcataccaaaaatctggttttagaattattgaagatttgccagaacatgaattacacgagggcaaaaaagaagattgttatttaatggaatatagatatgatgataatgccacaaatgttaaggcaatgaaatatttaattgagcattactttgataatttcaaagtagatagtattgaaataatcggtagtggttatgatagtgtggcatatttagttaataatgaatacatttttaaaacaaaatttagtactaataagaaaaaaggttatgcaaaagaaaaagcaatatataattttttaaatacaaatttagaaactaatgtaaaaattcctaatattgaatattcgtatattagtgatgaattatctatactaggttataaagaaattaaaggaacttttttaacaccagaaatttattctactatgtcagaagaagaacaaaatttgttaaaacgagatattgccagttttttaagacaaatgcacggtttagattatacagatattagtgaatgtactattgataataaacaaaatgtattagaagagtatatattgttgcgtgaaactatttataatgatttaactgatatagaaaaagattatatagaaagttttatggaaagactaaatgcaacaacagtttttgagggtaaaaagtgtttatgccataatgattttagttgtaatcatctattgttagatggcaataatagattaactggaataattgattttggagattctggaattatagatgaatattgtgattttatatacttacttgaagatagtgaagaagaaataggaacaaattttggagaagatatattaagaatgtatggaaatatagatattgagaaagcaaaagaatatcaagatatagttgaagaatattatcctattgaaactattgtttatggaattaaaaatattaaacaggaatttatcgaaaatggtagaaaagaaatttataaaaggacttataaagattga

SEQ ID NO: 3399 - DNA (genomic), 1794 bp, Enterococcus faecium; double-stranded, circular
  misc_feature (B) LOCATION 1...1794
  hypothetical: NO
  anti-sense: NO
aagaagatagtacggaggagagaatgtattatgagtacagtattacatgtattggatgcaatcaatagccccgcagatgtcaaaaaattatctgttgaggaaatgaaacagttggcagaagagatgcgccaaaaaatcttgcaaaaggacagcgatgtaggtgggcacgttggtccgaatctaggtgtagtagaattaacgattgcgtttcattatgtatttgattcaccaaaggataaaatcgtttgggatgtttcccatcagtcttatggtcataagcttttaactggtcgaaaaaatggttttgaaaaaggacattaccgtgaagtgagcggatattccaaccaacatgaaagtaaacatgactattttacagtggggcacacatctacatctatcagcttagcaacaggtttagctaaagcgagagatctgaagaaagaatcaggaaatgtggtagcatttatcggtgacggctccctaagtggtggcttagcttttgaaggattgaacaatggtggtgttttacaatccaatctaatcgtattagtaaacgataatgagatgtctattgatgagaatcatggcagtttatataaaaacttagctgagcttcgtcaaaccaacggtaaaagcagcaataacctatttaaagcaatgggatttgattatcgttacgtggataatggaaacgatctggaaacggtgatccgtttatttgaagaagtaaaagatattgatcatccgattgtacttcacgtccatacggaaaaaggtcgcggttatcagccggcaatcgataataaaatgaaatatcattggcatgtaccatttgatctgtccaccggggaggcaaagcaagtaacttctggagaaacatttaatatgatcatcatggattatttggataagaaaatgcaaacaagtacagctcctattgccgcagtcaatgcagcgataccaggcgcctttggactgaaaacattccaagaaaaacatccagatcattattttgacgtggggatcgctgaacagcactctatcactttcgcttctgctttggcttctcagggagtacgtccagtcgtcttccaatcaagtactttcttgcaacgggcatatgatcaattatcacatgatttagcgatcaacgagaatccagtgattattttagtcggtggcggaacgatctcagctagtgaccgaacacaccaaggaacatttgacattccttacttatcaagtatcccgaacatcaaatatcttgctccagcaacaaaagaggatatgatctctatgctagattgggcgttcgaacaaacagcgcagcctgtagcaatccgaattcctacacatggtgtagaacatggtacagctatcgcaaatgattatagtattccagcctatcaaacagtaaataatggaggaaaagtagcaattttagctttaggcggttttcttgaattaggaaaagaaacagtaaaagcttttagaaaaaaaggaatcgaagcaacgttgatcaatccaggaacgatcacagaaaatgacgtagaaacattagataaattaaaagaaacacacgaattagtcatcacattagaagatggtagtttgtcaggaggatttggcgaaaatatcagtcgttattatggtgattcttcaatgaacgtattaaattttggtgcagagaaagaattcacggatagcgttcctgtagggcagctttatgaacgttatcatttaacaccaaaacaaatcgttgaagatagtctgcgtgtcttgaatattcaataa

SEQ ID NO: 3400 - DNA (genomic), 261 bp, Enterococcus faecium; double-stranded, circular
  misc_feature (B) LOCATION 1...261
  hypothetical: NO
  anti-sense: NO
ctgtctgtagtaattctttgtttgccagactattatatgtctcatttgtcagtaaatgatttttcgtcacacgctccatcgtcaatgtcagcatcaaaaccaaatgttcaagctttctatcacttagattggtctttttttggatcaattcttccccgattactttgcgtgcaagagatagatgttgcggatcaacgaatcgaaaaaaataattcagtgatgcatcgaaagaaatactatgaaaaagttcatattcattga

SEQ ID NO: 3401 - DNA (genomic), 1353 bp, Enterococcus faecium; double-stranded, circular
  misc_feature (B) LOCATION 1...1353
  hypothetical: NO
  anti-sense: NO
atgaaagtagtagtaattggctgtactcatgcaggtactgcagctgtaaaaagtattttaaaaaatcatccagaagcagaagtgacagtatatgaaagaaatgacaatatttctttcttatcttgcggtatcgcactttatgtcggcggagtagtaaaggacccagcaggcttgttctactcaaatcctgaagaattatcttcattaggagcaacagttaaaatggaacacgatgtaacagacgtcgatacagaaaataaaacagtaacggcaaaagatctgaaaacaggagaaacagaaacggtttcttatgataaattagtgatgacaactggttcatggcctattatcccaccgattagtggaatcgatgcgaaaaatgtactcctatgcaaaaactacaatcaagcaaatgaaattattgcacaagcgaaagaagcaaaacgtgtagtaattgttggtggtggatatatcggtattgaattagtagaagcttttgtcgaatctggaaaacaagtgacattgattgatggattagatcgcatcttgaataaatatctagataaaccattcacagatatcttagaaaaagaattgacagaccgcggtgttactcttgcgctaggcgaaaatgttactgaatttatcacagatgaagaaggaaaagtgaaacaagtagctacaccaacagatacatttgatacagatatggtcattttatgtgtgggcttccgtccaaatacaaaactgatcgaaggaaaagtagatacactgccaaacggggcaatcaaagtgaatgaatacatgcagacaagtaatccagacatttttgcagctggagactctgcagtagtcaactacaatccaagtggcacgcaaaactatattcctttggcaacaaatgccgttcgtcaaggtttgcttgtgggaaataacttgacagatcataaaatggcgtatcgtggtactcaaggaacttcaggactttacctatttggctggacgatcggttcgacaggtgtgaccaaagaaagcgcaactttgaacgatctagaagtccaagcgactgtatttgaagataattatcgtccagagttcatgccaactactgaaaaagtaatgatggagctagtctatgaaaaaggaacgaatcgtatcgtaggtgctcagttcatgtccaaatacgacattacacaatcagcaaataccatgtctttagctgttcaaaataaaatgactgtagaagatctcgcactttcagatttcttcttccaaccacattttgaccgcccatggaattacttgaacctacttgcacaagcagcgctaggcgaaatcgaaactgcacaataa

SEQ ID NO: 3402 - DNA (genomic), 1296 bp, Enterococcus faecium; double-stranded, circular
  misc_feature (B) LOCATION 1...1296
  hypothetical: NO
  anti-sense: NO
agaggagtagttaggaaagtgataaaaaatgctatagcatatattacaagaaagaaaaatagaactttaataatttttatcatattaactatagttctttcttgcttgtattcttgtttaacaataatgaaatcaagcaatgaaatagaaaaggctttatatgaaagttctaattcttcaatatcaataacaaaaaaagatggtaaatattttaatgttaatcaatttaaagatattgaaaaattaaaagaaattgaagaaaaaataattcaatatgatggattagcaaaattaaaagatgctaaagtagttagcggagaacaaagaataaatagagaagatttatctgacgaatttaagaatgttgtttcactcgaagctacaaataatactaaaagaaatattttatttagtagtggagtatttacaattaaagaaggtaaaaatatagaagaaaatgataagaattcaattattgttcatgaagaatttgctaaacaaaacaatctaaaattaggtgatgaagttgatcttgaattactagatattgaaaaaagtggaaaaataaaaagtcataaatttaaaattatagggatcttttctggtaaaaaacaggaaacatatacaggattatcttctgattttagtgaaaatatggtgtttgtagattattcaacaagccaagagatattaaataattcagaaaataatgaaattgcaaataaaattttaatgtattctggtagtgcagaatctacagacttagccttaaacaaattgaaagagcttaaaattgatgagtcaaagtattttgttgaaaaagattctaatgcgtttgaagagtctttagagtcagtgagtggaataaaatatataataaaagtaatgacttattctattatgttaggtgggatggttgttctttcattaatcttgattctatggttaagggaaagaatttatgaaataggtatattcttatctattggaacatctaagatacaaattataatgcaatttatattcgagttaatattcatatcgataccaagtataatatcttccttatttttaggaaatgtattactaaaagtaattgtagatggattcattaactcagaggattcaatgatttccggtggaagtttaataaataatagtagttttatgtcaaatataacaacacttggacaaagttatttaatattaataagtattattgttttatcagttgtatttgcttcttcattaatgttaatcaagaagcctaaagaaatcttatcaaaaataagttag

SEQ ID NO: 3403 - DNA (genomic), 1245 bp, Enterococcus faecium; double-stranded, circular
  misc_feature (B) LOCATION 1...1245
  hypothetical: NO
  anti-sense: NO
gatatttcagtatttggaggaataaaaacaatgattaacgttatagggttaggttacattggtttgccaacagcattgatgttggcagcaaatggaaatgaggttgtaggaactgactacaatcaaaaattattacacaagttacaagaaggacagctaacgtttgaagaaaaagggctagaagaattatttgacaaagctcttacaagaggaattaagtttgaaaatgagtattcttctacagatttttatattattactgtaccgactccttatgataaagtagataaaaaaatcgacccgtcttatgttattgctgcaactaaaagggtattggaagtatgtaagaaagggacaatcttagttatcgaatcaacgatttctcctggaacgattgatcgttttatacgaccgcttgttaaagaagcaggattatctttaggcgaggatgttcatttagtccacgcgcccgaaagaattttaccagggcagatgattaaagagttacaatttaattcacgcacaattggagcagatgaaccagaaattgctgaaaaagtaaaagaaatttattctactttctgtgaaggggaaatagtttgtacggatattcgtacagctgaaatgacaaaagtggtagaaaataccttccgtgcaatcaacattgcttatgcaaatgaattaacgaaaattgctcggcacgacggtttagatgttcatgaaatcatacgtattgctaacatgcatcctcgagtaaatattttatcccctggaccaggagttggtggacactgcattccagttgatccatggttcctcgttggagattacccacggttaacgcaattaatttcaactgccttagaaataaatgaatcaatgccagaactagttttagaaaggctagtggctatcatgaaggaaaataatattacagacagaaataaaattggaatctatggaatgacgtataagcaagacgtagatgacattagagagagtcccactgtacaactttttgaaaaaatgaaatctagttttgcagaaccatttagagtttttgatcctatgattaaggaaaaaataatggacaatcaagtaatggattttgataaatttttaaatgattctgaaattattgtattaatggttgagcatactcatctaaaagaaaatttatctatgctacaaaataaactaatcttggatacgcataatcttgttgcaaatgcttataaattatag

SEQ ID NO: 3404 - DNA (genomic), 192 bp, Enterococcus faecium; double-stranded, circular
  misc_feature (B) LOCATION 1...192
  hypothetical: NO
  anti-sense: NO
aatgttggcttatttttcgtttggttgaacttattaccgcagatgcaagcttttgaccaccgtttattcggaatatgggactgtgacaaggcttttgtcacagcccttttttacataaagattattattgttttaactgttttggcagaaagaaggaggaaaaaatggaaattttatcagcaatggatttag

SEQ ID NO: 3405 - DNA (genomic), 1083 bp, Enterococcus faecium; double-stranded, circular
  misc_feature (B) LOCATION 1...1083
  hypothetical: NO
  anti-sense: NO
cggtgctcagttggtgtatattacntgaattttgacgtaaaagaaggagaaatcgtcgtcctcgtggggctttccgggagtgggaaatccacattgatccgtctattgaatcgtctgattgagccaacttcgggcagtatctatattgatggagaagatgtatcgaagttaagcaaagaagaattgcgagaagtccgtcgtcataaaatcaatatggttttccaaaacttcggtctgtttccacatcgaacgatcttggaaaatacagaatacgggttagaagtccgtggtgtacctaaagaagaacgacaagaaaaagcagaaaaagcattagaaaattctagtttgctttcatttaaagaccaatatcctagtcagttatctggtgggatgcaacaacgggttggcctagccagagctttagcaaatgatcctgagatcttgctgatggacgaagcgttctcggctcttgatccgctgatccggcgagaaatgcaagacgaattactggacctgcaagccaatgttcaaaaaacgattattttcattacccatgatttgaatgaagctttacggattggggacagaatcgccttgatgaaagacggcgaaatcatgcagatcggaacaggtgaagaaatattgaccaatccagcaaatgattatgtacgtgaatttgtggaagaagtcgatcgttccaaagtgcttacggctcaaaacatcatggtacctgcattgacgacgaatatcgaatctgatggaccaaacgttgcattgacaaggatgcgtaatgaagaagtcagcatgctgatggctgttgacagaaagagacacctgaaagggatcatcactgcagatcaagcgttagaagctaggaagcaaaaacgtccattgatcgacttcctagatgaaaatgtgacggtgattgggaaagacatggtggtaagtgatattttcaatattatttatgactcaccgactccacttgcagttgtagaggatggaaaattaaaaggtgtcgtcatccgaggtagtgtgattgaagcattagcagaaacaagcgaggtgagtgaacatgaataa

SEQ ID NO: 3406 - DNA (genomic), 999 bp, Enterococcus faecium; double-stranded, circular
  misc_feature (B) LOCATION 1...999
  hypothetical: NO
  anti-sense: NO
gttttatcagtaacgtcattgaacaagacacttttcgttttgaaaggggtaaagataagaatgattgagttcgaaaaaccaagaatcgcaaaaattgatgaagaaaaagattatggcaagttcatcgttgaacctcttgaaagagggtatgggactactttagggaattccctacgtcgtattttattatcttctttgccaggtgctgccatcactaatattcaaatcgatggtgtactgcatgaattctctaccatcaaaggtgttagagaagacgtcactcaaatcatcttgaacattaaaggcttagcgctgaaaatgtatggccaagaagaaaaaacccttgaaatcgatattaccggacctgctacagtaactgctggcgatattatcgttgatagtgatgtagaaattcttaacaaagatatgtacatctgtagtgtctctgaaggagctacgttccatgctcgcttaacagtgaaacctggacgtggttatgttcaagcagatgaaaataaaaaagaagatatgccaattggcgttcttccagtcgattcaatctacacacctgttcgtcgtgtgaactatcaagttgagaacacacgtgttggacaccgtgaagattttgataaattgacgatggagatttggacagatggttcaattgaaccgttggaagcaatgagtttgtctgcgaaaatcatgactgaacatttggatatttttgtgaacttaactgatgaagcaaaaaatgctgaaatcatggtcgaaaaagaagaaacacaaaaagaaaaaatgttggaaatgacgatcgaagagttagacttgtctgttcgctcttacaattgtttgaaacgtgcaggaatcaatactgtacaagaacttacaaataaatctgagcctgaaatgatcaaagtccgtaacttaggacgtaaatcattagaagaagttaaagcaaaattgcacgacttaggtttaggtttacgtaaagaagattaa

SEQ ID NO: 3407 - DNA (genomic), 306 bp, Enterococcus faecium; double-stranded, circular
  misc_feature (B) LOCATION 1...306
  hypothetical: NO
  anti-sense: NO
aaaaaatcagtagaacgtacgtctcgatgggcagaacgaggattgaaagctcatgctaatccagaccgtcaaggattatttggaatcatccaaggagcagggtttgaagatcttcgtcgtcaaagcgcgaaagatctagtcgggatggatttccctggttactcaatcggcgggttatctgtcggggaacctaaatcagaaatgaatcgtgtattagaattcactacaccgttgatccccgaaaacaaaccacgttacttgatgggtgtcggtgctgctgattcattgatcgatggtgttatccgt

SEQ ID NO: 3408 - DNA (genomic), 1479 bp, Enterococcus faecium; double-stranded, circular
  misc_feature (B) LOCATION 1...1479
  hypothetical: NO
  anti-sense: NO
gagagatcagttctcggctgtttggctcatttgttgagcatatgggaagtgtcctctatacagggatttatgaaccgggccatgaaacagctgatggtgacgggtttagacaagatgtcccctccttatgtaaaggaattagaattaggtgtcattcgctatcctggaggaaactttacatctggttatgattgggtggatactgtaggtaggaaagaacaacgaccaaaaaaaattgatttagcatggcgaggtatagaaccaaattcttttggactccacgaattttttaaatggatcagtcatgtacaagcgaaaccgatattcacggtgaatttaggaacaaaaggaattgatgaagcaaaaaatttagtagaatattgtaattttccaaaaggaaccttctggagtgatttaagaataaaaaatgggcaaaaaaagccttttggcgttaaattatggtgtttagggaatgagctagacggtccatggcaagtgggggctaagagtgcttatgaatatggtaggttagcaaatgaagcctcaaaagtcatgaagttagtggatgattcaattgaaacaatcttagttggaagctctacgccacgtttaccatcgtaccctgaatgggatcgtatcgcattagaagaagcttatgagaatgtagattatttagctttgcataactatattgataagtatgatgaagaagacttgactaaacctcctaaaaatgagcgtgatgatacagcgacataccttgcaaaagcttatcgattcgatcgtcaaattgaagaaatcgttgctacttgtgattatgtaaaaggatatttgagaagtgagaaaacaatgtatctagcgtttgatgaatggaatgtacatgcccaaccggaaaaaagacatagggattttgaagtcggtagtcccatcgattggtgttactttactatggaagatacattattatttggttcattagggctggctattttacgacacgcagatcgcgtaaagattagttgtcaatcattgttagtaaacacaatacctttaatactgacagatgctaaaggacaagcatggaggaatccaacttattatgtgatgcaacacttatcgaaatatgctaaaggtcaagtattgaaacaacaaatcatttgccctgtttatgattgtgaaaagataaaaaatgttccttatgtggacagtgtgatcgtagataacggcaatcagctgactattttcttgatcaatcgcacaaatgaacaacaaaagataacgattgaacatgatttcaatttggtagatcaaggagagcactacacattaaccagtagcgatctgttggacaaaaatacacgtgaagaaccagaaaaaataaaacctgaaataaactatttttcaatagaaaaacatgacgaattaaatgtagggatagaaaaatactcttggaatgtaattagaataaagaaaatgtga

SEQ ID NO: 3409 - DNA (genomic), 432 bp, Enterococcus faecium; double-stranded, circular
  misc_feature (B) LOCATION 1...432
  hypothetical: NO
  anti-sense: NO
tctgctggctttgcagcaattttaaatccgatcaaagtcaatatggatgaagcagtatctgatagagtgttcacagcatcagccataatggagacagttcctgaaaaaagcccgatcattagattagagacaaacaagatcagattcgtaaccaatcataagatacccgttagtactccttttattgtccgctgttgcggtatttgtatctttttttcttcttgtttcttagccaagttttttaccccttctagtttgcttgttgctcaggtaaatagatggagaggacgattgttttcctctcctctcttccttagtctatctatcgtgcgtcctattagtattaaaagatggtcattattggtgcggtcccacggtgttgttgcaatanagagccgggcccgttattacattagtatgtcccgnnnaaga

SEQ ID NO: 3410 - DNA (genomic), 1530 bp, Enterococcus faecium; double-stranded, circular
  misc_feature (B) LOCATION 1...1530
  hypothetical: NO
  anti-sense: NO
aggaggtcagttatggaagccacaatgttgattagtagtgtcaagcgtgtaggcaaagttgatccgcggttgtacagttcatttattgaacatatgggacgagcagtatatgaagggatttatcagccagatcatccatcagctaataaaagtggatttcgccaagacgtcattcacttggtaaaagaattgaacattcccatgattagatatcctggtggaaattttgtgtcaggatttcgttgggaagacagtattgggcccatagcaaatagacctagaaggttggatttagcttggcggacaattgaaacgaatgaagttgggattcatgaattttataactggtgtcagcatgtgggggccgaaatcaatatggctgtcaatctgggtactcgtggagtagatgcagctcgtaatttagtcgaatattgtaattttcctaaaggaacttattggagtgatttaaggcgttcgaatggtcaagagagcccttttggaattaagacatggtgtttagggaatgaaatggacggtccttggcagattggacataaaacagcggaagaatatggacggttagcagaggaaacggctaaggcgatgaaactcgtagatgattcaattgaggtggttttatgcggaagttcgaatcggcaaatgcctacatttggtgattgggagttaacagttcttgatcaagcgtacgatcaaatagattatttgtctctgcatcaatattatggcaaccaaaaaaatgatctttctcattatcttgcacgttccttagacatggatcggttcatttctgaagtgacagcgatgtgcgatacagtcaaggcgaagaaacatagtaagaagcagatcaacctgtcctttgatgaatggaatatttggtatcattcagcggaacaagatgagcaagcagcgccttggcagattcctcctcctttactagaagataactataattttgaagatgcattactattaggctgtctattaatcactttattgaaacatgcagatagagtaaagattgcttgtcttgctcaattggtaaatgttattgcaccaatcaggacagaaacaaacggagaagcttggagacagacgatctattatccatttatgcaagctgctgtgtatggacaaggagaggtgttaagcccacaaattcgttcagcaaactatgcgacggaagattttgaagaagtgccgtatttagaaagtatagccgtaataaatgacaaagaacttgtcatatttgcagttaaccgtggagaagaagaaatgaatctaactgttcacttgtctgaattatcattagagggagtgattgatttttctgaaatgagtggatttgatacaaaagcaactaatcttcctaaaagtgaacaagtaaaaccaagtcattcaacaaatgtaaaagctgaagatgggaaaatcaattgtttattgaaaccgctatcttggaatgtggtcagatgtcgtttatcagatgaaggaggaacaaaaaatgaaaggtaa

SEQ ID NO: 3411 - DNA (genomic), 2391 bp, Enterococcus faecium; double-stranded, circular
  misc_feature (B) LOCATION 1...2391
  hypothetical: NO
  anti-sense: NO
aattatggcttcttgcgtggttgttgttatggagaagaaaggaaaaggaggatgaacatgttgctacaaaataaattttcattttttcgctccttcttttttacttcgctttttgttttaagtatatttatcttttcaccttcggcagaagctgttggagcaacgcctcctgccatttcttatgatccatacacgtatgaaaatatcgtacctccaaatggtggacgtagtgcagtcaatggcgggaagcttgtccaactaactggggctaaccaattgcctaaattgactgctacttatttgaacgatggttcaaatgatccttggaaaggtggcacggtccgttttcattgggaaagccatgtgaaactaacaaatgtacttgatttggtgaatatcactgcacaaggatttgcatttgtggcgatcatcaatttgccggaacatgtatcaagcagtgatgtattaaaagcaattgactggaacaacgcctacttgtatattgccggtgcccccatcaaggttactagcggtagtttattatcagcaggaagccataccttgcgttttgggatggggtcgtgggatacaaatactctattggcagatattattgctattattacgcgaggcgaattcaacgtggacgatatcccgcttcaatttgatgttacagctaatgtcgcgaagatgacagaaaacggagataaatatgatacgagtccaaacaaaattttgaccaagggtaaattacaaccttctatgtctaaaaaggccgttttttctgttgatttttatgattcgaataatattatccaagatcgtatgttcaattcgattttagctccagctgcaggtagattttatcctaaattaactggcggaaacttgaatccaggagcatatgcattttctgcaagtgcagagataaatacgtggaatagttacatctcaacaagtgattcaacaggaaaatataatacatttgctgataccacagaatacgtggatggaaataaccagaaccttccaggctctaccaatagtcggacattgacgatggggctgactgaaggacgttttgatcagttgccatttagtcgctttgatcgcgtagtcaactattttacaggaaaaaacgttacacaaggagcaatactgactcatactccagcaagcacaagtggattgaatcagacagccaatatcgtgtacagtgggaaagatgcgcaaggcggattgctttctcctgttgctttaaaggtattggagcagtacaagctagacggaacggttttaccaacaaacttaacagccgatagtcagtggggaaagctcctttcttctgcatcgtaccaagtcacggccaattggtcagcaactgaactaaaaaagggttcgatccattacaggctttattcgaaaggaacccaaaaattagcgacaggatggacagatcaacttttccaaacgatccaatcaaataacgggggtgtaaatacagctacttctacactacctgcattggcttcagggcaatattattttgattatcgcttggtggacgatgtacttactaacatgtatccgtcttttgcgtacaaatggcagtctgaacaagctggaatcaccactcttcctcaaataacagtggctaattttccatctgtgagtgcagatagtcagctaaaaaaccttagcagacaacctgagacaggagatcccctgtctgctctatcaggagatacgattcaagaaaatgtgacattcacgttaacaaaatctggggatgcgataaccgacaaaaaaatcacgatctcacttcctgaaaatactacttatatcaatggttccttaaaattaaatggtacaactatcgcagataccggcattcaacaaggagtttctgtcccagcagatctattgagcaaaataggagataccattcatcttacttacaactatcaattaaatactgtagatacttctgtacaatccgtcagcatactgacaaaggcagctgtactttccagcaatattacattagcagatggtgctaagcttcctaacccagttgtccaaacatctgctaaaacaattcttgtccccaaacaagaattaacattagttaatgtaccagatgattttacatttggtaacgatctccccaaaccgttgaagacaagttattatgaagcaaaaggcgatttttcttttgatgtgcgggatactcggcttccaagcacgtctcccttggcaactgacagggacattgacttctttattttagcattgaatcagggtcaagaattaaggcggaacaaaattatacttcaatcattctggatcaaaacaattgattcagcgaggtcaaaacacgttgatttatga

SEQ ID NO: 3412 - DNA (genomic), 351 bp, Enterococcus faecium; double-stranded, circular
  misc_feature (B) LOCATION 1...351
  hypothetical: NO
  anti-sense: NO
ccttcaccagttgaaccagatacgattgctactcctgcgcttgttccgattcttgtagcaccagcttcgatcattgccattgcttcttcttcgttatggataccgccggaagctttgacacccatttctggtcctacagtttcacgcatcaaacggacatcctctacctttgctccgcctgttgagaaaccagttgatgttttgacaaaatcagcgcctgcagcttttgctatttcgcaagctcggatgatttcttctctatctaataacgatgtttcaataataactttgacaagcgcacgatcttttgctgcttcaacaactgcttcgatatctttttggacttgttga

SEQ ID NO: 3413 - DNA (genomic), 198 bp, Enterococcus faecium; double-stranded, circular
  misc_feature (B) LOCATION 1...198
  hypothetical: NO
  anti-sense: NO
agcaggccagtcaatacagttaccccaatggagttcgtgaacaggataccaaggaaaatcaatcctaagacagctaatgcaaaaaagctgattcctttatcccataatgttccttttcttagtgccagtacaaaggatgccgcactgataatgatccagatcaataatactgtatacgaaagggaacctgccagatag

SEQ ID NO: 3414 - DNA (genomic), 339 bp, Enterococcus faecium; double-stranded, circular
  misc_feature (B) LOCATION 1...339
  hypothetical: NO
  anti-sense: NO
ctgattgcagtaaaaaaagaactaatagctacgccagctaaaatcagctgtaaaggattcatgcccattttcgaaaactgcaaaaagccaaatacgagcaaagtcacagcaaaagaacctgccaatgacaccagaaacacagaaaacccagaagctttgggccaaaaagcaaaactaagagccattgccaacgaagcaccagcgttgattcctagtaaacctgaatctgctaacggatttcttgtcacaccttgcatcaatgcaccgctcaatgcaaaacaactccctacgagaaatgcccctgcgacccgaggcaagcgaatgtttcttatgatttga

SEQ ID NO: 3415 - DNA (genomic), 483 bp, Enterococcus faecium; double-stranded, circular
  misc_feature (B) LOCATION 1...483
  hypothetical: NO
  anti-sense: NO
tcttctgcagtaggagtttcttccacttccacttgctcttctttggagcgtaaattcttcgcacggtttgccgctttgacaactaagaataagacaaaaccagtgatcagaaatgtaatgatagcactaataacgttaccaaacgcaaatgtgacgccttttgtcggcgaccagtcaagaattgaaagtgctccttctaaatcagaagtacctgtgatcattgcgacaaaccaacctattagtggtgtgatcaagccttgcaccacttggtttacgatgcttgtaaacgcactaccaataacaacgccgacagcaagatccaagacatctccacgcatgatgaactctttgaattctttgatcatgaatgaccctcccttcttttatttgtctttagtatatcgaaaaataaaaaataaaaaaacaatatacgcttttagccgtctgtttcttttgataaaaaacatctatgctatactataa

SEQ ID NO: 3416 - DNA (genomic), 1053 bp, Enterococcus faecium; double-stranded, circular
  misc_feature (B) LOCATION 1...1053
  hypothetical: NO
  anti-sense: NO
atttatgcagttatattctatatcttacaaacacattccatgtattccaattccctatccgttataataaaagaaacaggcaacaggaggaaaatcatgatcaaatattttacattagataatgagaaactgcgtaataccggaaaggaaactgaccaaacgatctggtattgtgtagaacgtcctaatcaagaagagattcatcagctgacacatcaatttgaaattccgtcagattacatcacttccatattggacgatgcagaaaattcccgtacagaagaattcaatcaatcaaagttgacaaagccagcgttattattgttacaatatccttttgctaaaacaagtcctagcggttattttcaagtggatacatacccgctctctattattttgacgcccaaaaagaagcttatcacaattacgaatcatgaaccactgtttttaaagaaagtctttagccagacctttccaaaaagtgatatttcgcctaatctcaatatcttctttcaattcatttggcaggtcacactctcttacaacagttatttagctacgcttcaatctcaatgcgatactttggaagccaaacttcaagtatccactgaaaacaaacaactttatcaaatcatggatatccaaaaaagcctcgtttatttcagagaagcgacttctgctaatttagatgcattgaaagaactagcgcaaaataaacttttccaagaaaatcatgctttgaaaaatcatttacgtgatgtattggtggaaacagagcaggcaatgactacttctcgcattcaattaaaactagtagaacaaatgaatcagactttttcagcaatcgtatcgaataatctgaataatattatgaaaattttaacttctttaacgattattttaactataccgacaatcgtcggcagtatctatggaatgaacattaagttacctattgctgaaagggatgatgcctttatatggctagttctattaacattatttatttgtatcgtaactacctattatttaaaaaaagggaagtttttataa

SEQ ID NO: 3417 - DNA (genomic), 312 bp, Enterococcus faecium; double-stranded, circular
  misc_feature (B) LOCATION 1...312
  hypothetical: NO
  anti-sense: NO
gctaatgcagttggcaagaagaaattgatggttttttgcaaattatccaaaatccgccggccctcttttacggcttttgcaatcgtatggaaattatcatctcctaaaaccatatcagctgcctgtttgcttacttcactacctttgattcccatagcaattcctacatcggatcttttcaaagcaggtgcatcatttacgccgtctccggtcattccgacgatttctccatttttctgcaaagctttaacaattcgcagtttatgttctggtgtcgttcgagcaaagacatcgactattggcacttgctga

SEQ ID NO: 3418 - DNA (genomic), 312 bp, Enterococcus faecium; double-stranded, circular
  misc_feature (B) LOCATION 1...312
  hypothetical: NO
  anti-sense: NO
cgtagcggcttaaaatgcaaagacaatcctaatgctaaaacaatccctaatggtaatgagccaatcaaggtaaataaaaataatttcaatgttgtgagtgctcctactaataattgcggcataacttcaatcaaatactccatcttcttttcctcctttaaaataaaaaaatcctcttggcaaatgccaagaggacgtattatacgtggttccacctctgtttattttttccttgcagaaaaaacctcacacagtcgttgccgttcagatgaaaacaaaaagtcctttgatccgaagatcaaaggacgttaa

SEQ ID NO: 3419 - DNA (genomic), 240 bp, Enterococcus faecium; double-stranded, circular
  misc_feature (B) LOCATION 1...240
  hypothetical: NO
  anti-sense: NO
aaccaagcagttggacagttgttggaccgccaagcagtacggatagcacaagtagtgaaagcagtacagaaaacacgagcggtgaaagcagtacagagagtacgagcagtgaaagtagcacagaaaacacgagcagcgaaagcagtacggagagtacgagtagtgaaagtagcacaggaagcacgagcagcgaaagcagtacggagagtacgagtagtgaaagtagcacaggaagcatga

SEQ ID NO: 3420 - DNA (genomic), 384 bp, Enterococcus faecium; double-stranded, circular
  misc_feature (B) LOCATION 1...384
  hypothetical: NO
  anti-sense: NO
tctatggcagttaaaaaacaatgtaatcatgctggatgtaaaacattgattgattataggcagaagtattgtgggaagcataaagcaaagcaaacggcaattaagcgtgaagaaagaaagcaaagcgaaggtaaatattttcaattctatcaaagtagaacatggcgaaaggcttcatacttgtatcggttaaatcatccagtatgtgaggattgcctagaagaaggcttgataaggaaagctgatgttgtagatcacaaaattgaactaaaagatgattggaatagacggttagatgaaactaattttcgttctttatgccatgcacaccataattccaagacagccaatgaaagacaaagacgagaaaagagtaccctttga

SEQ ID NO: 3421 - DNA (genomic), 264 bp, Enterococcus faecium; double-stranded, circular
  misc_feature (B) LOCATION 1...264
  hypothetical: NO
  anti-sense: NO
aaaataggcttaaaggagcaaaatatgacagaacagcaaatagtaaagaaaaacgaacgatatacagtcgaaatcgtcgacttgagttatgaaggaatgggggtagcaaaaatcgatggttatccattatttatcgaaaatgcactccctggagaagaagtagaaatactagtagtaaaagcaggcaataagtttggatatggaaaagtcgaaacatttattacacaatcacctgatcgtcatcctgtaggaccggacccatat

SEQ ID NO: 3422 - DNA (genomic), 906 bp, Enterococcus faecium; double-stranded, circular
  misc_feature (B) LOCATION 1...906
  hypothetical: NO
  anti-sense: NO
atttttcaagtaaatccttggttttttttcagagtctgctacaataaggtaaaaagtacttttactgtcaatggaggtggtcagatgaaccgttttgcttctaaagaagaagaaaaattatattatgaacataaagcaagtgaagaagaatttcttaactggtatcaaaaacaggaacgtccagaatatgacaagccctctttgactgtcgatatcgtactgatgtgctataacaaagaagaagatcagctgaaagttttgttgatccaaagaaaagggcatccttatcgaaattcatgggcattgcctggtggctttgtccaaaaggatgagtcaactggagaaagcgtcttaagagaaacaaaggaagaaactggtgtggttatttcaaaagaaaatattgagcaactgcatacattcagtacgcctaatcgagatccgcgaggctgggtcgtcacagtcagctacttagcctttattggagaagaaccgctaatcgccggagatgatgccaaggaagtacgctggttcacactagaacgtcatagtaacaagatccatttatctagcggagaagtggctatctcgcttgatttagtcactggagagtcttctggcaaagatactttggcttttgaccatagtcaaatcatcttgaaagcattcaaccgtgtagtcaataaaatggaacacgagccgcaagttctacaagttttaggtaaagatttcacgattacggaagctcgaaaagtatttgctaaattcttagggatcgattataaaacgatcgatcattccaattttaagaaagctatgctccaatatttcgatgagatcggtgaacgtcctgtaggaatcggccgtccttcaaaaatctatcagctcaagccggggcaccatgaataa

SEQ ID NO: 3423 - DNA (genomic), 1497 bp, Enterococcus faecium; double-stranded, circular
  misc_feature (B) LOCATION 1...1497
  hypothetical: NO
  anti-sense: NO
ttgcttcaagtcgatatcgataaagaaaacatcgtgattatcaatagtgcccaactggatcaactgattgatttgagagatagaagtgagctgcacgatattctcgatatgatgattgaccaattctctgatgatccattcgctgtgaaactggttatcttctatgataaaatactttttcatatgcaggctcctattaaaaaaatatgtgtacattttgaaacaaaacaatggaggaataagatggtcgcaacagtgacactttatttgacctttactttgattttagatttaggtatctatttattcttttcgaaacaactgctagtaaaaaacagctttggttgtatagctttgatggtggtgacacttttacttcctatccctaaagtgagctttccttacctagttggcttattattgatgtttcttttttattttactacgaaaaacctgtttatcagctgtttgatcagtaatcttttttttgctatcactggactcagcttttttctggtttttgatctgatggattatttaggaaagagacatcttggaacagcaagtttttttgcactacttatcgcatttattttctatctattagtaaaaagtatagacaaacagacgagatttctcaacttgctttttacttatccaactgaacactattttggaggtatttgtattttattaagctggggcgtgatttacttggtattgggaagtgttcacttccgctcatctaattatctgcttctatctcttttgtcgatagtcatcagttttttttctttgtttttttccattatgttgatcagtttccaagtaaaagaaagacaacatcaggaatcgcttcaactgtatcaaataaatgaagaatattaccatcatctagaggaattcaaacatgattataaaagtctactgttttcattaaaaattactcttcaggaaaataaaaaagaaacgttggaatttttagaaatattagaagatcattctgcagctatttttgaaaaaccgcaaatacaacagctaacaaatattgtatccccagctgtcaggggtgtctttttaaaatttctagaaaaagcagaatcggagaaaatcccgatccaagtagttattcctgtcgaagtgaaaacaatcccgattgatctggttgtttttattcgctgtttatctatttttatttctaacgcattcgatcatcgtgtagccgatcagagtccgattacgatcaatctgctggaagaaaaagagggatcacgttttagtatagcgaacaaggcaaatccaacgaatttgacgctatcggagatggtcaaaagaggaaaaacctctaaaaaaaatggcgggttaggtctatacagtgcgaaaaaaatgttggatgtttacgaaaatgcagaactaaaaatcgaattttcaaaacagaatcactatttttttgtagaaatgtatctggcatctagaaagagcaaatcagcctactga

SEQ ID NO: 3424 - DNA (genomic), 921 bp, Enterococcus faecium; double-stranded, circular
  misc_feature (B) LOCATION 1...921
  hypothetical: NO
  anti-sense: NO
cggaaccaagtgtttatcagtaagatagaatttggaggtcagatcatgcttattgaagaaaaactaacaaaacaagagttgtttaccacgacagagaaacggattgtcgattacatccgtaggaatatcgaagctgcagtctacatgacgattgaagaattagcaaaagctacgtatacttcccattcagctatcattcgtttatgcaaaaaaatgggattcagcggatttaaagaattccgtttcgagctggggcgggaagttcatcaattgattgctcagttcaatcaaacgattgatcctaattttcctttttcaagtgaagatagcactcagcaaattgcaaagaaaatggcggatttatcgatccagtcaataaaaaaagcacaattgcagattgaacatgaagatttagatcaaatcggtaaagtattgaacaaggcacagcgaatctttctttttgcaaaaggtgattctcaaatcacggcaaggaaattccagaataaaatggtcaagttgaataagtttttgatcatggctgaagaatacagtgattcttcttggaatgcagccaatttgactagcgaggattgcgccatttttattagctacagcggtcgcatccatcattatgaacgaataatgacctatttgaagcatgtagaggcccctaccttgctgattaccggaaatcagcattcagaaatggccaaacaggctgatatgtgtcttgttatatcgcaggaggaatatgattttgctaaagtagcgactttctcctctcaaattgccttcgattacgtattaaatacgttattctcagtgatatattctcaaaattttgaagagaatatccgcaacttgaaaaacaaacaagaattgatgcaaaaaggccttcttaaagaatatcggaaaacttaa

SEQ ID NO: 3425 - DNA (genomic), 1296 bp, Enterococcus faecium; double-stranded, circular
  misc_feature (B) LOCATION 1...1296
  hypothetical: NO
  anti-sense: NO
attatacaagttattttttataggaggttgctgaagatgaaagaagtaccagtagtagatatcaaaatcacagatttaaaaaaattgtatcaaaaaggatacaacatgttggaggagttacgccatgaagcggacgctcccgtcgtcaaagcaaagattttcaataaagaagctatcacgatctacggatcatcagcagcaaaagtattttatgatccaaggaatttcaaacgaaaaggtgctatgccaaaattagtattgaagacactttttggtcaaggtggagtacagactttggatggagctgctcatcaccatcggaaaaatatttttatggatctaatgacaccggaaagaatggaagattatcatcgtatcttagataagaatctgacacaagcacttgaagcacagcatggtcaatttgaactatttgatttaagtaagatggttttctttacatctatttgcgagtgggcaggtatcaatttatcagcgatttctaaagatgaggtcgaaaaattagcagaatatcaaatctctatgatcagcggaacgtttacttctccgattgatcacataaaaggtgtcgaaaatcgcaaaaaatcagaaaaatgggcgcaaggcttgattgaagaagctcgacaaaatcctgtggctggaaaagaaaatgtggcattatatgcttttgccaatgccacagatttagatggtcagcttttacctctggaagtggcagctgttgaattattgaacatcatccgtccaacggttgctctaactgtgtgggcggcattgatgggacatgcacttttcagtagaccagatttgtatcagcaattaaaaaatgacttttcgacgttacaagatccgtttattcaagaaatgagacgctattatcctttcttcccaatgctacctgcgatttcgctgaaagaagtagaagtagatggttatcgtataccagaaggcagttgggttattttagatttatatggaacagaccatgatgaacgaacagttgaagcgccagattcctttatgatcaaacggtatgtagggaaagcaaaagatatttcctataaagaagaatatgagatgattgcacaaggcgggggaaattttcgacaaatgcatcgctgtgcaggagaatggatcactcttcatagtctacgtgtgttttccgatcagctagtaaataagtttgagttctctgtacctgaacaagattggacgattccattcaatcagtttccgacttatccgaatagccgagcgctactttacaagaattag

SEQ ID NO: 3426 - DNA (genomic), 273 bp, Enterococcus faecium; double-stranded, circular
  misc_feature (B) LOCATION 1...273
  hypothetical: NO
  anti-sense: NO
cacaacaaagtaagcccaacaaactctagtatgtactttatcgtacatttgaggataatttttaataatccatttttcattctcattccatacatcaattatatcaaaatctttttttgtaaattttttactagtaatactatctccacgatgataataataatatttttgagaagtatcaacatggattttattacactgattgataattttcagtattactgctgcgtcttcagcaatttttccttttggatatctcacattctcaaataa

SEQ ID NO: 3427 - DNA (genomic), 444 bp, Enterococcus faecium; double-stranded, circular
  misc_feature (B) LOCATION 1...444
  hypothetical: NO
  anti-sense: NO
aacctaaaagtgatatcacttttagacaatggaaaaggtggaaataagatgaagaaaaaacaaactaaactatcgttagcagatattttaacacagttaaccgcaactgaagatggtgttgtagaatttgaacgatctgaaatttcggtagtagatgatcgttactttaaaatgccttacttttttgaccaagcaaaggtcatttgcctttgtggctacgatggggtacgtgattactttggaattagaattactgaagaaaaagtcgtttgggtaaacaatcatacagaattaggtgcgctagcctttgaaggaactgtattggacaatatctctattgtattcgaggaagaaagctttacgcttgaatgcgataagttaacccgatatatcgatccaaaattctatgaggataaaaacctggcatgggaactggctttatag

SEQ ID NO: 3428 - DNA (genomic), 1308 bp, Enterococcus faecium; double-stranded, circular
  misc_feature (B) LOCATION 1...1308
  hypothetical: NO
  anti-sense: NO
agcaaaaaagttagtaaaccagcaagagcaagacggattattgtcttgtccttgtctttttttgtatatttgaaaattgaaacaagtgaaaatttcacctgctcttggaaagcaccttggacaaccgttataatagaaaagaatttcaaaaaagaggggtttcttatgatatattttgataacagtgcaacaaccccaatctttccgcaaagcttagatgcatatgtaaaaaccagtcagcggattattgggaatccatcaagcttgcatgatttaggcaatcaagctaaccggttgttgcagcaagcaagaaagcagatcgctgatttgatccatgtagaaccagaagaaatctattttacttcaggcggaacagaaggagataactgggtattaaaaggaacgatgatcgaaaaaagagaatatgggaatcatatgatcatttcaggagtcgaacatccggccgtcagcgagacagcagaacaattaaaagaattaggaatcgaagtaagtatcgccccagtggataaacgcggatttgtacgtgtcgacgaattgaaagaattaataagaaaagagacagtattagtctctgttatggctgtgaataatgaagtaggatcgattcagcccatccaggaaatcagtgatcttttggatgattttcctaaaattcatttccatgtagatgctgttcaggcgattggaaaagtaccattctcgcaatggttgacagaaagagttgattttgcaacattttcagctcataaattccatggcccacggggaactggtttcatttattggaaaaagggtcgtcgtttagcaccattactgacaggtggagggcaagaaagaaatcagcgaagtgggacagaaaatgttccaggtattgtggctatggttaaagctttacgtttatcattagagataaaggaacaaaaacctgagcagacacaacgcttaaaagtagctctaatcaatgcgttgaagacgtatgagaaagtgacgattttttcagaaggaactgactatgcaccgcatattttatgttttgctctaaaaggaattcgcggcgaagttctcgtccatgccttagaagaaaaacaaatatttgtttctactactagtgcctgctcctcacgtaaacatatggcaagcagtacattgcacgcaatgcatgtaccaaatgatctggctacatctgctgttcgaatcagcttagatgaaaacaattcgcttgcagaagtcgagcaatttatgattattttcaagcagctttataagaaattttctgcaatcaattaa

SEQ ID NO: 3429 - DNA (genomic), 363 bp, Enterococcus faecium; double-stranded, circular
  misc_feature (B) LOCATION 1...363
  hypothetical: NO
  anti-sense: NO
atggaaaaagtttgccaagtgactatcgtacataaagaaaaagtaaatgtaataaaaaataaattggatcaaaaagatttttcaaacttacttgtgttaggaaaatgtttcagcgattcttctagaattaaaattttctatgctttagaaacctataaggaaatgtgtgtatgtgatttagcagaaatacttactgctagtgtcgctacaacgtcacaccatttacgttttttaaaaaaacatggaatggcaaaatcacgtcaagatggaaaagtagtttattactctttagcgaatgaagacatcctttccgctattcgtgttttttttaagttatcagaaaatctatctatgaaatcttag

SEQ ID NO: 3430 - DNA (genomic), 468 bp, Enterococcus faecium; double-stranded, circular
  misc_feature (B) LOCATION 1...468
  hypothetical: NO
  anti-sense: NO
tttttgaaagtggtgagtaatttgagtatacaagcagagttacaaaaaatacgtaaagaaaaacttgcatcttgttacttgattttaggaacagaaaagtttctccaagatcaagttcggacagaaattgtcaaaaaaatccaattagagggcgaagatgacttaaattttttaagttttgacatggaaaatgcaagtttagatgaggtagtagctgaagcagagacgttgccgtttttcggagatcaacggttagtattcgtagagaatccttattttttaacaggtgaaaaagtaaacaatggaatcgaacaaaatactgatttattgacggcttatttgaaagaaccattagaatcgactgtattagtattctttgcgccatatgaaaagttggatgaacggaaaaaagtaacgaaacaattgaaaaaacacagcaattatcatcaatgtccaacagttgaatga

SEQ ID NO: 3431 - DNA (genomic), 438 bp, Enterococcus faecium; double-stranded, circular
  misc_feature (B) LOCATION 1...438
  hypothetical: NO
  anti-sense: NO
accatgaaagttgtacaaacaaaagatacaatgagcaatatttacttagatgctgtacggatcaggcatcaagtttttgtagtcgaacagggtgtgcctttgtctcgagaaatagacaaagatgaagcccattgtatccacttcgtcctgtactcagataaaaaagaaccgcaaggaactgtacgtcttttgcctttagaaaacggaaaaatgaaattacagcggatggcgattctttctgaatacagacaccaagggttaggaaaaatattgattgaagaagcagaaaactttgctaagaatcaaggctataatacgattttattaggggcacagtccacagctgaaactttttacgaaaaactaggatatacagcttacggcgatccttttgaagatgctggcatgcctcatatttatatgaaaaagactttataa

SEQ ID NO: 3432 - DNA (genomic), 801 bp, Enterococcus faecium; double-stranded, circular
  misc_feature (B) LOCATION 1...801
  hypothetical: NO
  anti-sense: NO
ttaatgaaagttaaggctttaaaaaagaaaagaaaatcaagtattagccccttgaaaattacgaaaacagaacataaaagcttttggattaaattactaggtgatgtttattatcaaaaattacgtgaaatgaacaattccaatattgcgattattaagtggcaaaaacaacggttaaaaaagtcattgatttttatcctagtcggattcttaatgtatctatttttagggaaagaatggtattacttagccggtggaattgctacttcagtaggtttttatgtttggcaagcaaaatcaatcaatggtatctataatcaatttcggtttgaacgacacttgcaatttagtaaatttacacggctattgatcccctatctgaaacaaaaaaaagatggcggaaatttatatggtgtttttgcaaaaatcgtaaaaagactagattatgataccgataaaaagctattaatgaagcttatgcaagaaatgacagatcagcctaacgatattagaccttttacggaatatgcagaacagacttctggaacagacatgtccgtattatttatgtctacagtttatgatattcgacaaggttcggcagatttggatgttattgaagagttggatcgtttagcttctgaagagttaatggccggaatcgattcaatcattgactataagtcgaggcgttttgtcttctttcctacaaaaattgcaatgacttcatttattttagttgtcggttttgcagtaggcgttcttttcatgaacctaaaagatattaactttgggcaataa

SEQ ID NO: 3433 - DNA (genomic), 1026 bp, Enterococcus faecium; double-stranded, circular
  misc_feature (B) LOCATION 1...1026
  hypothetical: NO
  anti-sense: NO
atgaagaaagtagcaatcataggcgctggacaagtagcagaaaaagtacatgctgcttattatcaaaaaagatcagatgtcttagaattggccgctgtggttgatccagtcagccagcgagcagaagacttttgccgacgtacaggattttctcatgcgtatacatcagttacacaaatgctgaatgagatttctcccgatatcgtgagtgtctgtacacccaatcgctttcacttcgaacatgtattggctgccctcgaagctaatgcttcagtgatgtgcgagaaaccaccagctatgacagctgatcaagcaagaaagatggcagagacagccgataaaaacgggcagattttggcttatggattccagcatcgtttttctgacgaagcaacaatgatcaagaatcatcttgatgttctcggggatatttattacgtagaagcgaatgcgcttcgtcggtctggtgttccaggctggggaacgtttatcgacaaagaacttcaaggaggcgggcctttgatcgattatggcattcacatgcttgatacagcgatgtatattactggatttcctaaagtaaaaagcgttcgggcgtacagcttccaaaaaattggtacgaaaaaaaattcagggaaattcgggaaatgggatccaagcaaattcacagtagaagatgcaatttttggcacactggaattagaaaacggcaagatcatccaactgaatacttcgtttgctttgaatatcagagaagacaaactgaatgtggctttttgtggcgatcaggcaggtgctaatctgtatccaggcgaactattcgaagatgtagatggaaagctggtttccttacaaaagaccacgccagttaatgacccacatgaactaagtatggctcattttgtgaatcgggcgctcggtgaccagactcagatgattgcagatggctggcaaggatatgtcatccagaatctggtggaaaatttatatcgttcggcagaaacaggagaagttattaccttatga

SEQ ID NO: 3434 - DNA (genomic), 441 bp, Enterococcus faecium; double-stranded, circular
  misc_feature (B) LOCATION 1...441
  hypothetical: NO
  anti-sense: NO
gtggagaaagtcaaaacgccggtaaaaatcagcgattcagaatgggagatcatgcgggttatttggacacttgggcagacgactgcccaagaaatcacgcagatcttagctgattcgatggattggaaaccagcaacgatcaaaactttgctgggacgtttggtaaaaaaagaagtgatctggacagaacaagaaggaaaaaaattcatttatcatccaactgtctcagagatggaaacagttcgtagtgcgacggagaatcttttttcccatatctgtgcaaaaaggattggagagacgattgcggatctagtagaagaagctactttgactcaagaagatatcaatgaaatcttgaaacaattagaacaaaagcaaccagtcgaaacaatcgaatgcaactgtatcccaggtcaatgtgaatgtaaacaacatcaatag

SEQ ID NO: 3435 - DNA (genomic), 561 bp, Enterococcus faecium; double-stranded, circular
  misc_feature (B) LOCATION 1...561
  hypothetical: NO
  anti-sense: NO
aaactagaagtacttcaaagaaaggaaggctcgcctatgctgaatcaattggcaattgcagaagttggcaatgcgatgttaggaaatgtcatcgttgtcagcggctcatttttgatactactggctctcttgaagcattttgcttggggaccaatcagcgatattttgaaaaaacgtgaagacaagatcgccaatgatttggattctgcagaacaatctcgcatcaactcagcgaaaatggaacaagaacgcgaacaacaattgttagcctctcgttctgatgcagctgatatcatcaaaaatgcgaaagaaagtggagaattaagccgccaaaatattttgaaggatgctcaagaagaagcagctcgtctaaaaagtaaagcccaagctgatatcactgtagaacgtgattcagcgctgaactctgtaaaagacgatgttgcagaactatctcttcaaatcgcggaaaaaatcttgaacaaagaattatctccagaaatgcacgaatcattaatcaatcaatatatcgaaggtctaggttcttcaaatgaaactagataa

SEQ ID NO: 3436 - DNA (genomic), 747 bp, Enterococcus faecium; double-stranded, circular
  misc_feature (B) LOCATION 1...747
  hypothetical: NO
  anti-sense: NO
atgtcagaagttgtaaaagttagccaattagtgaaaaaattatctttggaaatcgtgacaggcgacgagaaaagcttagaccgtgtcatcgtaactggggacatctcacgcccaggactagagttgactggttattttaattattattcccataatcgtttacagctatttggcagtaaagaaatcagttttgcggaacggatgatcccagaagagcgtttgatcatcatgagaagattatgtagtgaagatatgcccgcatttattatttcaagaggattaccagctccagaagaaatgatccaggcagcaaatgaaaatgggatagctgtactgcgttctcccatctcaacttctcgtttattaggagaattatccagttatttagatggtcgccttgcccctcgaacaagtgtccacggtgttttagtggatgtttacggattaggtgtactgattcaaggtgacagtgggataggaaaaagtgaaacagcgttggagttgatcaaacgcggccatcgattgatcgcagacgatcgagtagatgtttatcagcaagatgaattaacggtgatcggagaaccgcctaaaatcctggaacatctgattgaaatccgaggaatccggatcattgatgtaatgaatctttttggtgcgagtgcggtacgtggctctatgcaagtccagttgccggtttatctggaagcatgggccaaagataagaaatacgcccgtctgggctcctga

SEQ ID NO: 3437 - DNA (genomic), 435 bp, Enterococcus faecium; double-stranded, circular
  misc_feature (B) LOCATION 1...435
  hypothetical: NO
  anti-sense: NO
gaagaagaagtagagcatgcggcttctttagcatttatcaacaatgaaatcaaggaattaccaaaaggttatgataccttagttggagaacgtggagtctctttatctggcggacagaaacaaaggatttcgattgctcgagcattgatcaaaaatcctgaattattaatattagatgatgcactctctgcagtagatgccaaaacagaagaagctatcttgcataatttaaaagaaataagaaaagagaaaacaactatcattgcagctcaccgtttaagtagcgtgatgcatgcaaaagaaatcattgttgtcgatcaagggaaaatcattgaacgaggaacccatcatgagctgcttgcactaggcggctggtatgaacaaatgtgggagaaacagcaattagaagcgaagatagaaggaggcgaggcctga

SEQ ID NO: 3438 - DNA (genomic), 306 bp, Enterococcus faecium; double-stranded, circular
  misc_feature (B) LOCATION 1...306
  hypothetical: NO
  anti-sense: NO
catggggaagtattctcatggagttgtagactgttaaattataaaaataaaaagcaaacaatatcggaggaatatattattatggtattcgaaaaaattcaagaaatcatcgcagaagaattaggaaaagaaactgaagaaatcaaattgactactgacatccaagaagacttagaagctgacagcttggatttattccaaatcatcaatgaaattgaagatgaatttgacgtgaaaatcgaaacagaagacggaatcaaaacggttcaagatttagtgacttacgtagaaaaacaaactgcataa

SEQ ID NO: 3439 - DNA (genomic), 1089 bp, Enterococcus faecium; double-stranded, circular
  misc_feature (B) LOCATION 1...1089
  hypothetical: NO
  anti-sense: NO
aatgaaagagtgaagacgatgacgaaaattttagaagtgaaagacttagaaatctcttttgatacgtatgctggaaaggtacgagcgattcgcggtgtcaattttcatttgaataaaggagaaacattggcgatcgttggggaatctggaagtggaaaatcagtgacgaccagaagcatcatgcgcttgctgtcaagcaacgccaatatagatgctggtcaaatcctctttaaaggtaacgatatcgttggaaaatcagaaagagagatgcaaaaaatccgtggtaaagaaatagcgatgattttccaagatccaatgacctctttagatccgacgatgcccattgggaagcaagtcgctgagtcccttagaaagcataataaagtttcaaaaaaagagggacaaaaagctgcattagaattgcttaaattagttggaatacccgaagctgagaaacgtatcaacagttatccgcatcagttctcaggaggtcagcgtcaacggatcgtgatcgcgattgcactggtatgttatccggaaatcctgattgctgatgaacctacaacagcgcttgatgtgactattcaagcacagattttggagctgctgaaagaaattcagacaaaaatcgatacatcaattatctttatcactcatgaccttggtgtagtagcgaatgtcgctgatcgtgtcgctgtcatgtatggaggaagaatcgttgaagttggaacatcggaagaaattttctacaacccgcaacatccctatacttggggactgcttggttcaatgccgacattagatagtgcgaacgatcgattgtatgctattcctggttctccaccggatttattgaacccgccaaaaggagacgcattctatccaagaaatgaattcgcgatgaaaatcgatgcagaacaagaaccaccattttttgaactatcaaaaacacacaaggcagcaacttggctacttgctccgcaggcacccaaagtgacaccgccagaagaaatccaacgtcgctgggctatctttaaagagaaacaaaaacatacttacggtcaaggaggaattgctgatgccaaataa

SEQ ID NO: 3440 - DNA (genomic), 186 bp, Enterococcus faecium; double-stranded, circular
  misc_feature (B) LOCATION 1...186
  hypothetical: NO
  anti-sense: NO
aaggagagagtaccaatgccaattgcaataggaaataaacggttacccgtgacattagatgaaaagagacaaaaagaattgcagcaactaaagcagaagtacggcaaaagtgaatccaggattatgtgtattgcgttagatttattgattgccaagaaaaagcaggatttgaggtaccagcactaa

SEQ ID NO: 3441 - DNA (genomic), 195 bp, Enterococcus faecium; double-stranded, circular
  misc_feature (B) LOCATION 1...195
  hypothetical: NO
  anti-sense: NO
aaggagagagtactaatgccaattgcaataggaaataaacggttacccgttacgttggatgaaaagagacaaaaagaattgcagcaactaaagcagaagtacggcaaaagtgaatccaggattatgtgtattgcgttagatttattgattgcccaagaaaaagcaggatttgaggtaccagcactcaaaaagtga

SEQ ID NO: 3442 - DNA (genomic), 444 bp, Enterococcus faecium; double-stranded, circular
  misc_feature (B) LOCATION 1...444
  hypothetical: NO
  anti-sense: NO
atagttggagtgatggtttgtatgtatttaaagttgaaagaaatgctgagtgagtataatttaaaattgatctatatggaaatggaagaaccaggtttttattatccaaaaccaagaatagtatttttgaatgaaaaactacacgaagacagttctgaagcttttcatttagcccacgagctcggtcatttcattgcttcacattttgaatattcagtactgtacgataactctacaacttttcattcaaaattcgaaactgaagctgataaaattgcaattatgattttactaaatatctttattgagaacgaactgactgatgaaactcagttcaaattagaaaatttcatgaagttctactctatcaataataagttaagaacagaatgttttaatgtttgccagtcatatttcaagaaaaaatactcttatgcacagtaa

SEQ ID NO: 3443 - DNA (genomic), 453 bp, Enterococcus faecium; double-stranded, circular
  misc_feature (B) LOCATION 1...453
  hypothetical: NO
  anti-sense: NO
atagttggagtgatggtttgtatgtatttgaaattgaaagaaatgttgagcgaatacaatttgaaagtagtttatatggagatgaaagagcctggtttctactatccaaaacccagaatcatttttttgaatgaaaatctatacggtgaaactgcagaagcctttcatttatctcatgaacttgcacatttcagcgcctctcattttgaattttcagttttgtacgatacttctacaacttttcactcaaaatttgaaacagaagcagataaaatagctattctaattttattaaatatctatattgagaacgaactgactgatgaatctcagtttaatctcgaaaaatttatggagtattattctattcagaataagctcagatacacttgttatgctgtctgccaatgctattttaagaaaaaatattcttacgcaaggcaatatgtatga

SEQ ID NO: 3444 - DNA (genomic), 1344 bp, Enterococcus faecium; double-stranded, circular
  misc_feature (B) LOCATION 1...1344
  hypothetical: NO
  anti-sense: NO
aagaatggagtgttatttatgatggattattcaaaagagccagtaaatgattactttttaatcgatatgaaaagcttttacgcaagtgtcgaatgtatagaaagaaatttagatccattaacaacagaacttgttgttatgagtcgagctgataatactggttcaggattgatattagcttcttctcctgaagcaaaaaagcggtatggtattacaaatgtgagtagaccacgtgacttaccacaaccatttcctaaaacactacacgttgttccaccacgtatgaacctatatatcaagcgaaatatgcaggtaaataatattttcagaagatatgtggctgatgaagatctactgatttactcgatcgatgaatcaatcttaaaagtgacccgatcactgaatctttttacgactgaaggaacacgaagtcaacggagaaagaagctggctcaaatgatccaggagaatattaaagaagagctaggattgattgctacagtaggtgtcggagataatccccttttggctaaactagccttagacaacgaagcaaagcataatgaaggatttgttgcggaatggacgtacgaaaacgttcctgaaaaagtatggaatattcctgaaatgacggacttttggggaattggctctcgaatgaaaaaaagactcaatcagatggggattatgagcattagagatcttgctaactggaatccttatacgattaagaatagactaggtgtgattggcttacagctgtacttccatgctaatgggatcgatcgaacagatatagcaatcccaccagaaccgacaaaggaaaaatcatatggaaattcacaagtgttaccacgagattatactagaagaaatgaaatcgagctggtggtaaaagaaatggcggaacaagtagcgatacgcattaggcagcataactgtaaaacaggttgtgtccatttacacattggcacgtcgatcttagaaacgagaccagggttttcacaccagatgaagatccctatcacagataatacaaaggaattgcagaattattgtcttttcttgtttgataagtattatgaaggacaagaagtaaggcatgttggaataacctatagcaagcttgtgtacaccgattcgcttcagctggatttatttagtgatccacaaaagcaaattgacgaagaaaatttagataaaattattgacaagattcggcaaaaatatggttttacgtcgattgtacatgcttcttcaatgttagaaggcgctagaagcattactagaagcacacttgttggtggtcatgcgggcggaaatgggggaattaaaaatgattga

SEQ ID NO: 3445 - DNA (genomic), 648 bp, Enterococcus faecium; double-stranded, circular
  misc_feature (B) LOCATION 1...648
  hypothetical: NO
  anti-sense: NO
aaaaaaggagtacttatgaaaaatacaaaaaactttacattaactgcgatgtttttagctattttgattttattagctgttacgcctttaggttttatccctatcggtccaatcaatgcaacaaccatgcatattcctgtaatcattgcttcgatcgttttaggaccaagactaggtgcttttcttggcggtacatttggactgatcagcatgatccgtagcacagttatccaaacacctttgtcttttgtcttttctccgtttatcccagtcatcggaacagaacatggaagctggaaagccttgctgatcgcgtttattcctcgcatcttgattggggtggttccttatttcgtttataaaggtctgcgcaaactaatgaaacaaaaagcagattccgtttctttattcttagctggactttccggttcattgaccaatacgattttagtgatgaatatgatctactttttattccagcaagattatgccaaagtcatcggaacaaatttaaatgctgtttattcagctattctagcggttatttttacaagtggtatacctgaaggaatcgtcgcaggtcttgcgactgcagcagtatgcaatgtcttgttaagatatttcaagcacccttctcttactaactga

SEQ ID NO: 3446 - DNA (genomic), 456 bp, Enterococcus faecium; double-stranded, circular
  misc_feature (B) LOCATION 1...456
  hypothetical: NO
  anti-sense: NO
gaaaaaggagttgaatttatgaatctaaccagagatctgatttttttggttctctatcttattggggtattctccatcgtttattggcgaaaacagaaaaaggatccttccttgttcttttacagcagtacatggacgtttgcggtaatcttgacttattttgtcgtgttggaaattttttattcgaccttttatttttttattcccttagtgtttttcagtatctttgccttttcctatttttcagaaaagcgaaggctgttgaatggtcttttattcaatgttttcctcattagttttggtatctacttgtttgtctcgctatacgaaacacaaaatatttttactgggcggactgattgcttgaatcacgatcccgttactgcttgtctttctattcggcatttatggattgatcgtttttcttttttggaacggtgtcacagttttacgtag

SEQ ID NO: 3447 - DNA (genomic), 561 bp, Enterococcus faecium; double-stranded, circular
  misc_feature (B) LOCATION 1...561
  hypothetical: NO
  anti-sense: NO
atgaaaggagttttacaaatgattgatccaaaaatgttggggatgatcttcctcattaattttgcttatatcactctgaacacgttacgtttcatgttgacaatgaaaggctatcgactgattgctccacttgtcagtatggtcgagatcacgatttatatcgtcggcttatcccttgttttagatcgtttagataatccactgaatttatttgtctatgcgttaggttacgcagtaggtatcagtgtcggaattttgattgaagacaaattggcattaggatacatcatggtcacaacgattttgccagcaaatagcgcagaagataaaagtttgccgggtatactgagagaacacggttatggtgtgacacagacttctgcaatggggctggaaggtgagcggctagttctcgaaatactttctcctagaaaaagcgaacgtgaactgtatcgcctgatcaaagaaatcgaagagcgtgcttttatcatttcttatgagccaaaatatatttcaggtggtttctggactaaaaaagtgagaaaacgacaaggaaaataa

SEQ ID NO: 3448 - DNA (genomic), 357 bp, Enterococcus faecium; double-stranded, circular
  misc_feature (B) LOCATION 1...357
  hypothetical: NO
  anti-sense: NO
atgaaaggagtaatgaatgatttttactggtcattctttgaaaaaagaacaatgatagaaaaaatcagcaagaaaatactagcttcacccaaattgatcatttggatgtctatgatagttcttatcttttgtatcgcaagtggttttttattatcaaatttgctattttatagagaaacagaagagactgctgcaaaagaaatactttcttcgtttagttccagtggagaagatccatcagctgaaggaaacgatgtagaagtggatgctcgtccaaaggtcatgtacaccgatatcaaaggaagtgtgaaaggagcctggtatctattccttttcttcagaaaaacgggtctatga

SEQ ID NO: 3449 - DNA (genomic), 615 bp, Enterococcus faecium; double-stranded, circular
  misc_feature (B) LOCATION 1...615
  hypothetical: NO
  anti-sense: NO
actgaaggagtaatgaatatgcaatatccagaaccaattgcgaaactgatcgacagctacatgaaacttccaggaatcggtcagaaaacagcgacaagactcgccttttatacgatcgatatgaaagatgaagtagtaaatgaatttgctaaatctttgttaagtgtaaaacgcgatttgcatttttgtagtatctgcggaaacatcacagaagaagatccctgcgaaatatgtagaaatccttcacgtgatcgaagcgttatcctagtggtcgaagagccgaaagatgtaatggcaatggaaaaaatgcgagaatatcacggactttatcatgttctccatggtgtgttatcaccgatggaagggacaggtccagaagacatcaatatttcttctctgttgcagcggctgcatgatgcagatgtaaaagaagtgattatcgcaacaaatgcaacaacagagggagaagcaacagctatgtatctctcacgtctgatcaaacccgcaggtatcaaagtgactcgtctagcacatggtctgtctgtaggctctgatatcgagtatgcagatgaagttactttattgaaagctgtcgaaggaagacgtgagttataa

SEQ ID NO: 3450 - DNA (genomic), 999 bp, Enterococcus faecium; double-stranded, circular
  misc_feature (B) LOCATION 1...999
  hypothetical: NO
  anti-sense: NO
agcgaaggagtcgaaataatcatggcacaaaaaacaatgatccaagcaatcacagatgccttagcacttgaactagaaaatgacgagaatgtcgttgtttttggtgaagatgttgggaaaaacggaggagttttccgggcaactgaaggattgcaggaaaagttcggagaagaccgagtattcgatactcctttagctgaatctggaatcgcaggattgagtttcggtcttgcgttagaaggatttcgtccagttcctgaaatccaattctttggttttattttcgaagcaatggacgaagtagtagctcaaatggctcgtacaagatatcgaatgagcggcactagaaatctacccatcacaattcgttcgccatttggtggcggtgttcatacaccagaattgcattcggataatttagaaggtttgatcgctcagtctcctggtattcgagtagtgattccttccaacccttatgatgcaaaaggactattgatttcttctattagaagtaacgatccggttgttttcctagaacacatgaaactatatcgctcattccgagaagaagtgccggatgaagcttacgaagttcctttggataaagcagcagttactcgtgagggaacagatgtatctattatcacatacggagcaatggtgcgtgaagcaatcaaagcagcagacaatcttgcaaaagaaaatatatctgttgaaatcattgatcttcgtacagttgcgccattagatgtagaaacgatcattcaatccgtggaaaaaactggtcgcgtagttgttgtccaagaagcacaacgacaagcgggcgttgccgcgcaagtagtttctgagatctcagaacgcgctatcctttcattagaagccccaatcggacgagtttctgcacctgatacagtcttcccatttggacaagcagaaaatgtctggttgccaaatgcaaaagatatcgaagacaaagtaaaagaaatcgcggaattttaa

SEQ ID NO: 3451 - DNA (genomic), 576 bp, Enterococcus faecium; double-stranded, circular
  misc_feature (B) LOCATION 1...576
  hypothetical: NO
  anti-sense: NO
gaagaaggagtgagtgtcatgataaatgacgaacgaaaaaaagcagtgactcagcaactcgctgcgttggtagaggaagcattgatcgcagaagtaacattaagtccaaaacctggattagtggatgcactggatgcgggtgcacattccgatatggactatgctttatttcttaagtctgctaagacgctaactcctttttttgaagaaatggctcaaatagcatggcatcatgctattgatcaggagttaagagaaagaattgctgagattgggcgaaaagcggaaaaggcaatgctgattgctacaaatggcatcaatacccataaaggagcgatttgggcaatggggctattgatcagtgtcattgcacaaaaaatcagtatggaacagcctttttatttatcgaaaatacttgatgatgtcagcaagcttgttgcttttcctgatacaaaatatcgtcataaaaaaaccactcatggtcatagggtgaagcaaaaatatggcgtacatggtgcatatgaagaagcgatattagggtatccgcatatcagggttgcaattcaagcagcttag

SEQ ID NO: 3452 - DNA (genomic), 282 bp, Enterococcus faecium; double-stranded, circular
  misc_feature (B) LOCATION 1...282
  hypothetical: NO
  anti-sense: NO
cttttgggagtcgatacattgtcacagtccttttttcgaataaacggtgttctcctgccaactcctcggtcacaagtcacaatattcaacaaacatgagaagctattttttgaaattgctccttgtgactcagagttaaacggcaggctcacgacctcttggtataaacggtgttcaaaagcttgcatctacgctaatgagtccaaccaagtcaaaaatgaggagcttttttggctgtccttattacttgatgcagggcagttttttcataatctcttttag

SEQ ID NO: 3453 - DNA (genomic), 366 bp, Enterococcus faecium; double-stranded, circular
  misc_feature (B) LOCATION 1...366
  hypothetical: NO
  anti-sense: NO
agagggggagtaggaatggaaattacaatgtctaaaaatgcagtagagacgttaattgaaaaggttggggaaaatacaaaaatcgcactcgcgcttatcaatgattccgatccatttctaagggacaaaggtgcttttgcaaaaggcagcttttttcaaatcattccttttgtttcggaatttggagaatatgcgactaaaatcgagcatccattattggacatctatacatctaaattagagcaaaattatttcggtaaacgattgaacatggacttcaacaaacagcttgacagcttttcattagaaaatgaaatcgcagtactcgattataatatcaaattaaagaactgcttcttcagctaa

SEQ ID NO: 3454 - DNA (genomic), 348 bp, Enterococcus faecium; double-stranded, circular
  misc_feature (B) LOCATION 1...348
  hypothetical: NO
  anti-sense: NO
aattttttggtaacgcaggcccaaacgattcattgggtgcaagcattccgacaaatgaaacatccaaanataggtgtaatgttaggntatatgataccgtttatccattcttttaggttcaattttgctgcagatgcgatgaaatngcctctacagcaaatcatatngtcgatcgtgatnggagtcatcctttcgtctgtgtngtatgcgtgtggtggagaagctctgtttcacggatataacaaaactgcagtcacgttggttgcaagtgttactgtgctagtagggttagttgtcttcatttataaagatcgcaagaaaaaacaaggaaaacaaaagcacaaataa

SEQ ID NO: 3455 - DNA (genomic), 279 bp, Enterococcus faecium; double-stranded, circular
  misc_feature (B) LOCATION 1...279
  hypothetical: NO
  anti-sense: NO
tctctcttggtaaaaaatatgggagttgatcatttgattgtcttaagtaaacttttgttttggataccatttatcataatgaccagtgctttcttttacttattcaaaaggcctaacaaatacttactcttatctgcttgtccgatgatctattttatccataagattagaggattttattattacgactctggtatctcattgttttgctacgaaatcggcttattagcttcggccatctttttcatatttgtgttagaatatttcagaaaaaaataa

SEQ ID NO: 3456 - DNA (genomic), 513 bp, Enterococcus faecium; double-stranded, circular
  misc_feature (B) LOCATION 1...513
  hypothetical: NO
  anti-sense: NO
gcaaacttggtcgtttatttatcgttgattgctgctagtcctggtaattctttaccttcaagcaattccaagcttgcgccgccacctgttgagatgtgtgtgaatttgtcagcaaatcctaattgttctgctgctgcggctgagtctccgccaccgatgattgttgttgcgccttctaagttagcgattgcttcacaaacaccgattgtacctttagcaaagttactcatttcaaatacacccataggtccgttccaaacaactgtttttgcaccttgtaatgtatcagcaaataattttactgatgctgggccgatgtctaaagccatcaaaccatcaggaatgtctccttcgattacttgtgtttcaacatcatttgaaaattctggtgcacagacattgtcgattggcaagacaagtttgtcgcctgctttttcgattaattcttttgctagttccactttatcagcttctactagagagttaccgatcttgattccttttgcttcgtag

SEQ ID NO: 3457 - DNA (genomic), 321 bp, Enterococcus faecium; double-stranded, circular
  misc_feature (B) LOCATION 1...321
  hypothetical: NO
  anti-sense: NO
atgagattggtatgcgagaatattcatcgttatgagcaagaactggttgcctacgttttacctaaattacaagcgatcggcggtatcaccatttacggaccgcaagatcctgaacatcatactggcgtggttgcttttaatttggatggcatccatccccgtgatgtggcgactgctctggatatggaaggtgtcgctgtacgttcacgacaccattgtgcacaacggttcatcgacgatttctgtttgactaattggtcgtttaaacagtcgatgataatgccgtttgagcggctccaatgtcgtggaatctttgagtaa

SEQ ID NO: 3458 - DNA (genomic), 345 bp, Enterococcus faecium; double-stranded, circular
  misc_feature (B) LOCATION 1...345
  hypothetical: NO
  anti-sense: NO
aagaagttggtgattttgatggcagaagataatcgcagtcaagctgcagtaagtagattactaggaaataaaaataaaaagaattttaaatcaaaagaagtagaagaaatcgaattaaccaagaaaaatataagtaaagtcataaaagatcaaggaagtagtgtaagaacagcagatagcattcgtataaatccaattctaatgtcagcactcaaatattggacgactattgctgaatcagacaaaagtaaaccagacgttatagaagatgcgctattaaagtccatacctgaagaatacttgattgaaggatataaactagcaaagaaacaaaataaaatttaa

SEQ ID NO: 3459 - DNA (genomic), 1011 bp, Enterococcus faecium; double-stranded, circular
  misc_feature (B) LOCATION 1...1011
  hypothetical: NO
  anti-sense: NO
gatatactggttctatcagccgatgttacaattgcttatatgctactgaaacatcgatttgattattcagtcaaaaataactgggtagattctgatgataatatatttttcatattcacagttgaagaattaatgaaattgttacaatgccgcgaaggtaaagtatctaaaatcaaaaaggaattagaaaaagcaggtcttctgaaacagaagagaggaagagtaaataaacgtgacggtaagattgaatccatgcctaatttattgtacttaggcaagccagaagtaacgaatcaagacgtctttaaaatcatggaagaggaagacaatactgataccaccgtaattgcgaaaatcgcaaatacggcaaaaccgcgagaaatcaatgataccaccgtaattgcgaaaatcgcaaatacggcaaaaccgcgagaaatcaatgataccaccgtaattgcgaaaatcgcaaatacggcaaaatccagtcatatcaaggactcaaccgtaattgcgaaaatcgcagacaatctattctattctaattctatagacactaatagacacataatagacactgaaactgatcagttacaaaatcaagttttactagataacttcgtcgacatcatgaaagaggacagtataaatacatttgtaccagaaaatgtattaaacttgataaaaacattttctagtacttacgaagacgctcaaaaaaccgtccaaactattcataatgcaaagaaaaaagctgaagaattagagcaaacagttgttgtttatgaagaactggaatcttatggaattgatgctgacaaaggattatatatgactttgctgaaagcttatcaaaaacaaaaaactgaaaaagtaaacaatttgcagaatctaattttcgtttatgtaaaaaattggtttgtcgaaaaagctattgcggcaaagcttgcaaacgaacaaagagaaacatttaacgaattaccaacagttagtacggaaaattggctagagtag

SEQ ID NO: 3460 - DNA (genomic), 429 bp, Enterococcus faecium; double-stranded, circular
  misc_feature (B) LOCATION 1...429
  hypothetical: NO
  anti-sense: NO
tgttctatggttaaagcgatagaaaagcatattacattttatgaagcgcacgatgaagttttaaaacatattatggaaactcagcctacggtaaaaaactattctgaagccattcgatttttatgtatgaattacgatccagaaattgaaaaaaataataatatgacgaacgcaaagttgaacgcaatgggaaaggaaatttctattttaatagaaatggtttcagagtttgcggatcttcatttgaaagatacaggaatattaattggtacaaattcaactgtctatcaagaagcaaaagagcgtgtggaagggaaaataaaagcgaatcaaacgaagaagtattctcctaaaatcaagaaatcaataaatgaatctgttcatgccagagtagacccgtttgatccaacaaagtttttaaaaagataa

SEQ ID NO: 3461 - DNA (genomic), 198 bp, Enterococcus faecium; double-stranded, circular
  misc_feature (B) LOCATION 1...198
  hypothetical: NO
  anti-sense: NO
atgaatatggtacagcaaggtatgtgcagaaagctgctgatgccaatgggaaagaacgaacggttgaatttaatggtctttgctgtgttaaaagaaaatcattatttgaaaattagcaataaaggagcacacatagaaacgtatgaggaagttcctagagaaaaagttccggagaaagcattagcaattattgggtaa

SEQ ID NO: 3462 - DNA (genomic), 453 bp, Enterococcus faecium; double-stranded, circular
  misc_feature (B) LOCATION 1...453
  hypothetical: NO
  anti-sense: NO
gtagaaatggtaaaaacattgtatagcattttacacaggagtctggacttgactgagtttatggaagaagttttaattgatgataatatggtttttgatattgataatttaaaaggatttcttaatgataccagttcatttgggtttatagctaaagaaaataataaaattataggatttgcatattgctatacacttttaagacctgatggaaaaacaatgttttatttacactcaataggaatgttacctaactatcaagacaaaggttatggttcaaaattattatcttttattaaggaatattctaaagagattggttgttctgaaatgtttttaataactgataaaggtaatcctagagcttgccatgtatatgaaaaattaggtggtaaaaatgattataaagatgaaatagtatatgtatatgattatgaaaaaggtgataaataa

SEQ ID NO: 3463 - DNA (genomic), 324 bp, Enterococcus faecium; double-stranded, circular
  misc_feature (B) LOCATION 1...324
  hypothetical: NO
  anti-sense: NO
gtagaaatggtaaaaacattgtatagcattttacacaggagtctggacttgactccttttatgaatttagccaatttatcttcaattttacttactataggttcattgtttcaacctgtactattaaagtttacaaagctatattggcaaaatgttattcaaattctctacgccgtattgtttattatgttaagtttatttttaattaataagtaccaattgattggatttgtttatgcaagtctttttgccaatctttttcgtctgttattatttatattagtaggatatttcagtatttggaggaataaaaacaatgattaa

SEQ ID NO: 3464 - DNA (genomic), 381 bp, Enterococcus faecium; double-stranded, circular
  misc_feature (B) LOCATION 1...381
  hypothetical: NO
  anti-sense: NO
gtagaaatggtaaaaacattgtatagcattttacacaggagtctggacttgactattcctaatattgaatattcgtatattagtgatgaattatctatactaggtgataaagaaattaaaggaacttttttaacaccagaaatttattctactatgtcagaagaagaacaaaatttgttaaaacgagatattgccagttttttaagacaaatgcacggtttaaattatacagatattagtgaatgtactattgataataaacaaaatgtattagaagagtatatattgttgcgtgaaactatttataatgatttacctgatattgaanaagattattttgacagtgttatggaaagaactaatgccacaacagttttttga

SEQ ID NO: 3465 - DNA (genomic), 1332 bp, Enterococcus faecium; double-stranded, circular
  misc_feature (B) LOCATION 1...1332
  hypothetical: NO
  anti-sense: NO
ggaggaatggtgggaatgagaatctctgaaaaagtcgttcgtataggactcattttgatggttgcgttaagcatatacttctcttatgcaatctggctgagcccagcaggaaaaagttcaatcaacgtagatgagacaaacactcaaatgatcgagtctcaaagcaatcgaaaaacttccgaagtctttcttccgcttcatgttacatggcaccattcgggaatgatccaagaaaccaacagtgaaaatctcgtgtaccgattgcaattgatcatcgataaagcaagatttggaaagctttctgaagtagtttcaggagacaaatcacagtttgaacaggtgaaaaatctgaactctggttttgagttggcctataatgcgccttttttgctaagagaatacaaggaagcatttgatttagatttagatgtgtcgaacttggcaaaagaaagcgaaaatatgtattttactagaatacaattcgatcaaggaaataaaaaaatccgatttttgaattattcgaaccatctcgtatatgaagcaaatatttcgttgaattggacagatatcaataaagaattaacagcaaaagacacaaaatggacagaaatgacaacagaaccatcgacgatcgacacgcaatatgctacgaaacattcgatcaaactgaaaaagtatagttatatcctgtcacagcaaccctatacactttttagaaatgcttttttccagaaaccagatagcgtgaaaaataatgatgaaagcaatgaattgattttttacggtgggaatgaaacaatgtctatccattcggaaacgcaagtagttgattttcgtggagagctgccagagaaaaaagaaaatgctagtgtattttctgaaagtttcccctatattagcaaattaggcagttctttagggaacctcagatattttgaccgcagtgacaatacgatcgattatcggatattcgtggaaggcttcccggtttttgggacagacagcagaggacagattggtgtggaagttggcggtgaaacgaatggttctgtgcaagtgaatatccaaaccagtttgaatacgattcaagtgccgataccttcagacgaagaagtagaacttgcaagtacgaatgaaatcatccagcagttaaaagctaagggagcagatagcaacaagattggttcagtgatcgttggctatacatggcaaaatgtcaaagaaacgaatcgtgtcgttgatctcttacctgaatggtatgtgaaatataaagataactggtattcagctaacgaccttctggaaaaattacctggattggaggcgaattaa

SEQ ID NO: 3466 - DNA (genomic), 867 bp, Enterococcus faecium; double-stranded, circular
  misc_feature (B) LOCATION 1...867
  hypothetical: NO
  anti-sense: NO
tacgctgtggtgaagacatcgctctttggaggaagcggtcggtcagtcgatccaaatgcgcctcgtcaaggtgctgatttgcaatatacggtcgacttgtcttttgaagaagcgatttgtggtgtagaaaaagaaatcaagtataatcgggaagaaatctgtcatacttgtggtgggaacggtgcaaaaccaggcacacaaccaactacttgtcataaatgtcatggtgcaggtacgattaatgtagaacgccaaacaccacttggacgagtgatgagccgtcaaacttgtgatgtttgtcatgggacagggaaagaaatcaaagaaccttgtccaacctgtcatggctcaggacatgagaagaaagcacattcagttaaagtgaatgtaccagctggtgtagaagaaggacaacaaatgcgtttagctggtcaaggagaagctggagaaaacggcggaccatttggtgatttgtatgtggtcttccgtgtagaagaaagtgatatctttgatcgtgaaggttctgaaatttactatgaattgcctttaagttttgtacaagcagctttgggggatgaagtccaagtaccaactgtccatggagatgtgaaattgaagatccctgctggaacacagacaggtacgaacttccgtttacgtggaaaaggcgctccgaagttacgtggtggtgcaacaggcgaccaacatgtcaaagtaaaactgatcacaccgaaaaatctaaatgaacaacaaagagaagcattacgtgcattcgctgaagctggcggcatcaaagttgaagaacagcaagaagacggtttcttcgataagtttaaagatgcttttggcgggaaaaagcggaagtag

SEQ ID NO: 3467 - DNA (genomic), 279 bp, Enterococcus faecium; double-stranded, circular
  misc_feature (B) LOCATION 1...279
  hypothetical: NO
  anti-sense: NO
caacgtgtggtgaacactacacaaaaacacagatacttgctttcgatgatcaatatcaatgcagctttcgtcattacaaagcggacagacggcttgattgggatcagtgccagaagtaccggcacgatcaacgtccaaatcatcatggaatccttaggtggcggaggacacttcacaaacgcagctactcaactggaaaatacgacagttgaggaaacaaaacagaagctatttgctgcaatcaaagaaaatatgaatcaaatatatgataaggagtaa

SEQ ID NO: 3468 - DNA (genomic), 582 bp, Enterococcus faecium; double-stranded, circular
  misc_feature (B) LOCATION 1...582
  hypothetical: NO
  anti-sense: NO
catttcgtggtgaagatgactgtttttgtgtggctgcttatgtcagtccctatcatcggtgcttacttgattggtaaaaaactgcaattcagcgatacttcttctttgatgatggctggaggaaacgctgtttgtggttcttctgctattgcttcaatcgccccttccatccatgcgaaagaggaagaaaaaggacagatcatcacactagtcaatctactgggtactgtgatgatgttgactctcccttttcttggattacagttgtttggtggaaatctcattgaaaaaagtgcacttttgggtggtacactccaatctgttggtcaagtantcgctggggcaagcttacttgacaattctgttgtcgaattcgccatgctatttaagattctacgtattatgatgctcgttgttgttgtctatctgtttgaaaaattcatgcacaagaaacaaccagctctgtttgaaacgccaactgatacgcagaaaaaacgaaaattaccgcttcccttggtatgtattagggtttgtgatcttttgtntggtcaacagcttgttttctttacctgtagttattga

SEQ ID NO: 3469 - DNA (genomic), 1887 bp, Enterococcus faecium; double-stranded, circular
  misc_feature (B) LOCATION 1...1887
  hypothetical: NO
  anti-sense: NO
cacgtcgtggtgtcggttactatttgcgtaacccagaacaggagtaattggatgaaaagaaaagtccgcttttttcgatcagtcaattttaagatcgctattacctttattctgattttattgatctcgatcgaaattattggtgcctactttatacgtggtttagaacgttccacgatcaatacatttattaaagatatgaatcaaacggtggaatcattagcaacaacaatcagcccggaattgaatcgaaaagataatgcagatgatgaagaggtaaatgcgaatatcaaaagatttattgaaaacagtgcgactagcgatatcatcgaaatacgggtcgttgacgaaaaagggatcatccgaggaacaaccgatgtcaatgaacaaagcgctgtgggaaagaaaaatgattatgttgatatcaatgatttcacgactaaacgttatgttgctttagataacgacgataaacgggtgaatatcaatgttcaaccgatcctgtccccgaccggcgatgccgttatcggggctctttacgtcaaaagtaatatcgaacaaaaatattcggaaatcaataacacagcagtcattttctttactgcctcactaattgcggcatttatttcaatgatcgtatctgttttagttgctcgttcgattacacagccgatcggtgaaatgagagaacaagccattcgaatcgctagaggagactacagtcggaaagtcaaagtgcatggacaagatgaacttggacagctggctgataccttcaatcagttagctgaacgtattgaagaagctcaagatacaatggaagctgaacgcaatcgtttggatagcgtgctatcccatatgacagacggcgtcattgcgacagatcgcaggggtaaagtcattacgatcaatgatatggctgtttccttgctagatatcaaaaacgaggaagcaatcggacaatcgattttgacacttttagatatcgaagaagaatatacgttgcggaaattattagaagatccaaacgaaatggtacttgaccgttcaaccagtacattggaaagtgatcagatgatcttgcgagtagacttttctatgatccgtcgcgaatcaggttttatcagcggattagtagctgtcttgcatgatgtgacagaacaagaaaaaacagaacgggaacgtcgtgaattcgtctctaatgtttcccatgaacttcgtacaccgttgacaagtatgcgtagttatatcgaagcattgagcgaaggtgcgtggaaagacgaggaagtagcaccaaattttttgaaggtaacgctagatgaaacagaccgaatgattcgaatgatcaatgacctcttaaatctatctcgcatggatacaggtaatacccagcttcaattagaatatgtcaatttcaacgagttagtgaattttgttcttgaccggtttgatatgatggtgggaaatcaggaaaaaaattataagatccgtcgtgaatttacgcaaagagatctttgggtcgaagtagatacagataaaatcatccaagtagtcgataatatcatgaataacgcgatcaagtattcaccagatgggggaacgattacttgtcgcttattagaaacgcataataacgtggttttaagtatcaccgatcaaggattggggattcctaaaaaagatctgaaccgagtgttcgagcggttctatcgagtagataaagcacgtgcaagagcacaaggtgggacaggacttggattagctatttctagagaagtgattaaggcgcatcgaggcgctatttgggcagagagcaaggaaggaaaagggtcgactttttatatctcgctgccatatgaaccttatgaggaggaatggtgggaatga

SEQ ID NO: 3470 - DNA (genomic), 861 bp, Enterococcus faecium; double-stranded, circular
  misc_feature (B) LOCATION 1...861
  hypothetical: NO
  anti-sense: NO
caatccgtggtgaagtgtcttctggcaagtcgaataataagtgactgcaaaacaaagaataagaggacgggagaatgcatgatggagtgtcagttagaccaagagtggcggttacgtcccatcaaaggcgacacaggaaaaacatacataggcatgcgtgatgaggacaaagtctttattaaacgaaacacgactccgatgttggctgctctttcaagggaaggaattacaccaaaacttgtttggacaaaacgaacggggaatggcgatactttgacagcacaagagtggctggaaggtcgcttgctgactcctaatgagattggtcaaagaaacgacgtgattgatgttttgtaccatttacatcattcaaattctcttaaaaccatgctgacccgtatcggtggtcgtgtcatgacgccggagaagatgctgcaaaaatatgaaaaagaattaccggaagaactccagaaaaatcaatttctgcaaattgtccatcgttttcttcgtgagcagatcccgtcaatagataaggaaaacttatcagtagtacacggagatgtaaaccatcgtaattggttagtatgtaaaaattatttatatctagtcgattgggattcaatcatgtttgcagaccctgcggtggatattgcaacgattttaggaaattatgtgccactgtctagctggaatcagtggctgatcagttatggcatacgcccgactgacgaaatgcttgaaaaatttcattggtatgcggccatgaatttgctccaagaaatcaccagatattgcaaacgtgaagatcatcgacggatgaacgaagaaattttacaattaaaacgaattttcagtggctga

SEQ ID NO: 3471 - DNA (genomic), 681 bp, Enterococcus faecium; double-stranded, circular
  misc_feature (B) LOCATION 1...681
  hypothetical: NO
  anti-sense: NO
aacaaagtggtaccaaaaaaacaagtaaaggaaggaactaagatgagcaggccgaatttgcaaattgcgttagatcacaatgacttagaacatgcattaggagatgttatgaaagttggtgatgtagtagatattattgaagtgggcacaattctttgcttacaggaaggacaaaaagcgattcgctgtattcgcagtatgttcccagataaaaaactagtcgctgatacgaaatgtgcagacgctggaggaacagtggcgagtaatgttgcaaaagcaggagcagactggatgacagtcatttgttgtgcaacgattccaactatggaggcagcacaaaaagaaataggtgaattgcaagtagaactctacggcaattggacttttgaacaagccatggattggcataacatcggtatccggcaggtaatctaccatcaaagccgtgatgcgctgttatctggtgaaacttggggtgaaaaagatttatcgaagatcaaaaaactgattgaactaggctttaatgtttctgtaactggtggattaaatccacacacattacacttatttgaagggatcgatgtgtatacctttatcactggtcgtggtattacagcagcaaatgatccgatgaaggccgcacaaaacttcaaagatgagatcattcgtatctgggggtaa

SEQ ID NO: 3472 - DNA (genomic), 402 bp, Enterococcus faecium; double-stranded, circular
  misc_feature (B) LOCATION 1...402
  hypothetical: NO
  anti-sense: NO
aagaaagtggtgaaaaaaatgagcaacctgtgggactacaatcaagaggcacccatccattatttaattgcgcgacattgggatgcgttgaaaattgaggcggtttgccgatccttgttagcagccgttccaaaacaacaactggaaaattttttggtggctgacagcttgcagcgggaaaaagttcaggcttattttgcagcctttaaagatcagcctttggaatatttgcatgcgcagtttcatcttttttatcaagtagccgccccagatgactacaacgatttacgaggacagctgcaattgacctttcaagcggatgaaaccgcctataccgttttattgggaatggctcgccttggtgatcaggcgaaggtcgagtggcggattttcgatatttga

SEQ ID NO: 3473 - DNA (genomic), 1581 bp, Enterococcus faecium; double-stranded, circular
  misc_feature (B) LOCATION 1...1581
  hypothetical: NO
  anti-sense: NO
gggagagtggtgataatcaaaaaaaagttcacagttttactcacaatcatagtgaccggtatcatgagtggttttgccttggttagtataaataaacaggtactctatcggacaaatgaatttttccatcaaacagatacttatactccgattcgattgccacaacattttattgggcaagaagaatatgagcagctaatcatggtatttgaaaatgtctcatcagaaactgagctttcttatatgaaaaaaacagtaaatgaatccaatgaagtagatacatcttggaacttcaagatacagccaaagcttgaaatgacattgtattatcaaggggatgtcaaatcttctcacgagaaggtaccctattctaatacctcctttcgcgtaacgtccattgaagaatcgatcaaaataaaagattttgaaggtgaatttttcttgatgacgagagaaaaagaagcctatgaacggttcatttcactattcactgatcgattcaatcaagcatttcacactgattatgccactaatatttttgaagactttgaaaatagctattcgtattcggttatttcaaatacagacgtatataattatcgagtgtatttaactattggattgattcttttattccttttgttatcatcctttttcttattgatgaataaagaaatcagtttattgttgaataatgacttttcattacatcaagtattgtggtgtttattggggaaaaagaaaatcattattacattcataattgcaggaatcattggtggttttatttttatgtattataaggagcaatttctttatttgttccagatgtacgttttcttgttcagcggaatatatggtatctctttgatttctcttttattagttgaaaaaatcgcttcgttaagagaagcgttcaactatatccaatacattctttttacatttggattgttgttttctcttcttttgaccgttgccaatgtcgaattagcaactatcgttttttcttcttcacagttagctgtttcccatgaaccaccaaaagaaatcgctggtgaggactatcatgtattttatccagtaaccatcgggaaaaaccacgtggattttatttattccaatcgttttgcatcagcagcagatcaggaattatatgaaactttgaataaaaacggaagtatattagtcaatgtatcagattacttgaatgaagaaaatgaacagtttggcagagggataaaaataaatctgaattatcttaagaaatttcctttgattgatgtctctggaaggttgatccaaataaccgaaaaagaaacgcaccctgttatattgatccctgaacgatatagacatacagatttaaaaaatgacctggcgcaaataacagaatattatcaagaaatcagtgaaaaagaaccgaaatttctatttataaaaaacaatcaacccatttatacatttattccttctatcccctggatcgaaccttatccgggtgttggaaataccgacattgaaaaacagtatgtatttggaaagacatattctcagcggagaaatctatcccccggttaa

SEQ ID NO: 3474 - DNA (genomic), 915 bp, Enterococcus faecium; double-stranded, circular
  misc_feature (B) LOCATION 1...915
  hypothetical: NO
  anti-sense: NO
aaattggtggtgaaaaaaatgtatgatgaaaatgagtggggagaaaatgttcggatgacccgaagaagacagcaaaaacaggcagctcgtaagcggatgatcatgattggggcagcagttgccgtgtttttgatcatagcaggaggagttgcgggtctatattttcatggaaaaaattcgtcagaagcgaaaagtacgaccataacggaaacaacgacaaagaaaacagagacgaaacaaacaagtgagtcatcaactaaaacaaaagagacacaaacttctgaagaaaaaacagcaaatggtttgccagagcaacttcaagcaatcgtaaatgattattcgaaaaagatcgaagaaaagacgcctgcattgattgaagaataccagacagaaattcagggaaatcaagagggaatagctggtttatcagcagttgctaaccaaaaagcacgtgagcttcaagcaatctccgacgaagggatcagaaaattacgtgcagcgtatcaggcagcagaaaataaagacggtgtagacttagatactttgatcaatcaattatcggctaattatacgaatcatgtcgctaagatttccgatatttatttgcagactagcgcctctcttcaagcagagtcaacaagcacacaagacacaacatcttctgattctgagacagcagagtcggtagaagcttctgaaatgcaagctcgaacaacacaagacacaacagattcctctgaaactaataccaacagcgcgacttcacaggctgcgacaaccgtagttttggaaggagaaggtccaaatcaaatagccgaacgaactggcgtaccagtagaaacgatcttgtcgctgaatgggatgagcatggagaattatttcctgactcccggtgagacgctaaaattgaattga

SEQ ID NO: 3475 - DNA (genomic), 522 bp, Enterococcus faecium; double-stranded, circular
  misc_feature (B) LOCATION 1...522
  hypothetical: NO
  anti-sense: NO
aaactggtggtgtttattttgaatttttttcacttaacaatttttcaatggatgtcaataataagttttatattgagtacgtttttaacagggataaaaataaaaggaatgcgccctcaactagaagttgaacttaatgcttcttacttcgctgcagatatgatttatacaaaagtaatcatttctaactattcaacagaaccagctatgttagttaatttagaactttcatccgctaacttaaaccgcagatggtcagctactccatttaagaaattaattgctaaaggaggatcagtcgatgataatagaatatactctgaagctgtaccgctaaatattcctcctaaaagtgctatatcttgttaccttgcatttgaagtagggaaaattaattttaataaactccttaatcaccaaacaaaaatgatatttactctaaatagaacccaaatccacaaaattgttgatatcaaaaatacaaacttcccaatagagaaattagtgaaagaattaaactga

SEQ ID NO: 3476 - DNA (genomic), 225 bp, Enterococcus faecium; double-stranded, circular
  misc_feature (B) LOCATION 1...225
  hypothetical: NO
  anti-sense: NO
gaagactcggttacgcttaagatcccgggaagaccaagttcttctgccttcttgccagcgtgcataacgccgccaaataataaagattcatcttctgtatgggctactagggctttattgttttttgcagcttctttcatagccagatacatcgtcccagctgtttggacacctacaccgtcatttgtgaaagcaaaagcaccttcttcaatcagtgcttcttga

SEQ ID NO: 3477 - DNA (genomic), 321 bp, Enterococcus faecium; double-stranded, circular
  misc_feature (B) LOCATION 1...321
  hypothetical: NO
  anti-sense: NO
gtggagtcggtggaagataaaaaagaaaaactttttgacttaattgcgaatgcatataattcaaagtcatataataatgtagaagtaaaagaaggatttcttcaagatgctaagaaaatacgagaggataaaccatatcctgaaattattatatcagtgtacaaacatttatctaaattaaaagctgaggaacgcataaatatcaatgaaattaagtgcttaatggaatttatcaaagaagattacacaaaattgagtgctaaagagttgagaaaatatgatattggttatggtgccatgtctatgccttatattttttaa

SEQ ID NO: 3478 - DNA (genomic), 183 bp, Enterococcus faecium; double-stranded, circular
  misc_feature (B) LOCATION 1...183
  hypothetical: NO
  anti-sense: NO
agatggtcggtggaacagcacttgaatactttgaacaatacaaagaaaaataagcgacgttgtgggagaaccgaaatcatttttcctgctgaggaaaaagatacattgaaaaaagatcaactgaaggttggaccccagacgtcattattggccgtgcagagcgaaccttctcttgttcagtaa

SEQ ID NO: 3479 - DNA (genomic), 381 bp, Enterococcus faecium; double-stranded, circular
  misc_feature (B) LOCATION 1...381
  hypothetical: NO
  anti-sense: NO
gagaccgcggtaaagatgtcaatgagccgctcttcaacttcccggaacaggaggccaatcaccatgactaaactatatttgctacttttagttgcttgtctgttcatcgtggcatatatcccgcgcttgttcccgatgctttattttactcatcgaaaagtgccatcctggttcagtgactggatgaaatatgtaccggtggcattatttgcggcgttagcttttaaagatgttttcattactcatgaacatctggatattgcttggaatatcaaaatagctgcaatgattctagtagcaggcgtggcttacaaaacacgttcgatggcgttgtcagttttgacaggacttgcgtctgtctttttgctgtctatgctttaa

SEQ ID NO: 3480 - DNA (genomic), 192 bp, Enterococcus faecium; double-stranded, circular
  misc_feature (B) LOCATION 1...192
  hypothetical: NO
  anti-sense: NO
aaaacattttttcagaatcgattggctctccatttattcaataatggtttgtctaacgatattgttgggataattcttaaagaagtattagaaatagttggtacttcattactttacatgaagatttattctatggtaggagcaattatattgagaattaatccttttttatataagttgtttgcttattga

SEQ ID NO: 3481 - DNA (genomic), 1908 bp, Enterococcus faecium; double-stranded, circular
  misc_feature (B) LOCATION 1...1908
  hypothetical: NO
  anti-sense: NO
caccaaaaggttgatttcaacacatccatgataaggtctcagttaacctctgataccttattaagttatcaacgaaagaaaacgttcttatgttataatatatctgacaactttgaaaggggagttacgctgatgataagaaatgatatccaacccgacttacaaacgattgagcaatattttaatcgtaaagaattttatattccaagttaccagcgtccatatgcttggcaagttgcccaatgtgagcagctcatagaagatatcgagacccatcaagaaaatttcgaccaagagagccaagataattatttttttggtgctatcttgattgctcaagaatctggagaggatcacgaagtaacccttattgatggtcaacaacgcacatccaccttcatgcttttacttaaagctctcttactcaagataaataaggagtcagctaaactatcggatgaaacgttggaaaacgctaaattgatcgaaaagctgaacagactcaagagtagcattatttcgatgctgtataacttaaatgaggacaactctttttattatcgaaaaggcgattataaattgcagcctactgatattaagtacctgaatgaatctatttctgagttgtatgcagccgatatggagaagattctaattggtgagagctttgaagatatcgctggttcagttacgcaaatatacagacgtcaaaaagacaatcgttttactaacttctataagaattttcgatacttctggaaatattgtgatgagctaacgaattttcaagttgctgagtttgcagagcattttatcaaatattgtcaggttatcaccatcacgagcttcaataccgatcaagcaataaacatctttaactcattgaatggcactggtgttccactaacaccaattgaggtaatcgtttccaaagcaactgccaacgcagctgagagaaaaacttttgaatccaattggcaagcgatagtaaataaaacggatcactcctcactgaatttgaatttattgatgacgcattatattttcgtccaattatcgcaacaacatggggctatcacaaggaatcctgggattcgtgcattctttgctaagaataaagaattattgaagcatgatgtggaatttacaaattcgttgaatacaattttggataacttaggtgattttgaaagaactgagttaggaaagattctgaatcagtttaacagtaacctcaaaccatttgtttcaagctatttatattttagaccgatgaatcaagagtacctgacttacttattacgacttggagcaattcttgagttaaccgattttgcctacgcaaaccgtaatttcaaaggatttttggaacgcatcaacttgaagtacagtcaggttgatatagttagtgatgaagaactaattgaagaaataaagaaacacatttctacggcctttaataaggaagacatccttcagactcttatggaaagtggcgtaccaaattctattattttcttgaatgaatatgtatattgtaagcaacatgatcaagagtttaatatttacggtaacgttgatattgaacacgtgatgccacaaagtggtctgaatagagaaaatatcatggcagatgcaggtttcactgaaccagaagaattccatgaatatgctgagaaacttggaaataagatactacttgaatcagaaatcaatcgtggtattggtgatgcttggtttagaactaaaaaggaaaatactatcacaagccaccacggtttcattggtagccaatacaaaatagcgcaagctttagttggttaccataaagatacgtgggtgaaagacgatatcaagattgccactgagaaagctgcacatagaatttctgacttcttgttcgagtga

SEQ ID NO: 3482 - DNA (genomic), 294 bp, Enterococcus faecium; double-stranded, circular
  misc_feature (B) LOCATION 1...294
  hypothetical: NO
  anti-sense: NO
gaaagaaaggtgacgaacatgcgcaaagttaaaatgaactaccaaggacgcgtccaaggcgtaggatttcgctacatgaccaagatggtcgctgatcaactaggcgtgactggaacggtaaaaaacgaagatgacggctcagtcacgatcgaagcaatcggcaatgacggcatcatccagaaatttattgaagaagtcaagaaatcaccgagcccaagtggacgagtgcagtatgtggatgtccaagaagacccgatgattgaggaacgaaagaaatttgatgtggtgggataa

SEQ ID NO: 3483 - DNA (genomic), 1308 bp, Enterococcus faecium; double-stranded, circular
  misc_feature (B) LOCATION 1...1308
  hypothetical: NO
  anti-sense: NO
gggacgaaggttttattagtggcttataaagatataccaaaatcggtgcataaatttatggaagatatcacacaaaaatgtggggatatccatgcggactgggcaaagaattttacagcagcatttgccaatactctgttgacaacagtcaaaaagcaaaatgacggaaccacctttttattgacgggagacattccagcgatgtggttaagagactctactgcacaagttcgtccttatttagtgattgcaaaagaagatgaggaattagctgacatgatcagcgggttagtcaaaaagcaatttttttatatcaatatcgatccatatgcgaatgccttcaacgaagaagctaacggtgctggccaccaaacagatcatacaaaaatgaacgattggatctgggaaagaaaatatgaaattgattctttatgctacccaatacagttggcctatcttctttacaaaaatacaggaaaaactgatcaattcaatcaatcttttattgaaggtatcaaaaaaatcttggacgtgttcaaaacagagcaagatcatgaacactctccttatacatttgtacgagacacgacaagaaaagaagatacgctgatcaatgacgggcgaggtgcaaaaacagcttttacaggaatgacatggtctggtttccgtcctaccgatgatacttgccgttatggatatctggtaccatccaatatgtttgcggtggtcgtgttaggttatgtggaagaaatttttcaaacgatactcgatgataaagaaattgtacagcaaacacagaaattgaagaaagagatccaagaggggattcagaatcacggacgaacggttaatcaaaaagggcaaacgatttatgcatatgaagtagatggaatgggaaacgccacagtcatggatgacagtaatgtgcccaatctgatcgccgcaccttacttgggatattgttctgaacaagaggaagattatctgcaaacaagaagaacattgttgagtaaagaaaatccatatttctatgaaggaaagtacgcaaaaggaattggatcctcccatacgccagaaaaatacgtttggccgattgcattagctatggaaggaatgacaacgtcagacaaatctgaaaaagagcggatattgaatttacttgtagcaactgacgcaggaacacaccttatgcacgaaggattcgatgtgaacaatcctgaaaattatacgagagaatggttttcttgggcaaatatgatgttttgcgaattagtcatggattactttgatattagagtagaaaagtag

SEQ ID NO: 3484 - DNA (genomic), 915 bp, Enterococcus faecium; double-stranded, circular
  misc_feature (B) LOCATION 1...915
  hypothetical: NO
  anti-sense: NO
aatagtgaggtgaagtatatgaataagaaatattccattcataataagaaggaaccaaataaaaaaaataaggcacaaattgacaaagtatataaaaaaacgaaaggagtaaaattatatttaggtgctatacttggatttttagcaataggaatgataatcgttttttctccttatgtgatggggaaaagttatgattttgaaactgtaaaaatgagttcagcccaaaatgtaacgtcttctttgaatatgtatgttgatgatatggaaataaatagggaagccggactgtttaaattagtattgcggtatcaagatgatacaggtactaaatcactaagtaatattaaaagtgactataaattaaattttataacgaacaaaaataatgaagatgttaagacaaaagttgtaaaattgtcagatgaatacacggtaatttattatcaaaatctgcctaaagattttggtgtaatttctgtgacagttaaccctagatatatttatcctgaattagaaccttcaaatgacttaaaagaaaaggaaataaaattctatgcagtagacaaagatattaaatcaaatgctaaattggaagttgaaagtacttctgatttgcaaaaagataattttaaatatcagattaaagctatagaaaattctataaaagatgagaaaaaatcaattgaaaaaatgaatttagcaaataaagtagtgcaaaaagatattgataaagctaatcaaaacttagaatttcaaaccctagacgaacaaacagatacaaaaaatgaaatcagttctatgcagacgactattgaaaataataaatcttcaatagaggaaagtgaaaataaaatcaaacaatttgaggaaaaaataaagcaactagaaaagtctgcaagccgatttgagtga

SEQ ID NO: 3485 - DNA (genomic), 357 bp, Enterococcus faecium; double-stranded, circular
  misc_feature (B) LOCATION 1...357
  hypothetical: NO
  anti-sense: NO
aaactagaggtgagcagaatggaaatcgaaaagaccaatcgaatgaacgcgctctttgaattttattcgaccttattgacagaaaaacaaatgaactacatggagttatattatgcagatgatttttcattaggcgagatcgcggaagaatacgaagtaagtcgtcaagcagtatatgataatatcaagcggacaagcaagatcttggaggattatgaaaaaaaactccatctcttctctgattatattgtccgagaacagatattggaaaagatgaccgcatatattacagataagtatccggaagataaaaaactgcttgaatatgtacagcaaattcaagcaatcgaagaataa

SEQ ID NO: 3486 - DNA (genomic), 876 bp, Enterococcus faecium; double-stranded, circular
  misc_feature (B) LOCATION 1...876
  hypothetical: NO
  anti-sense: NO
atacaagaggtgaacaagatgaaaatggataaattacttgctctttacccacaagcacagaaaaaaaactctccagcatcagaagcggatatcctttcttttgcaattgatgatgcttttatctggatcaaacaagattcattatctcaacaagaaaccagccttttgaaagcgttattccctgtaatcaacgatcaaaaaaaacacccatggtatcactatctttttaaagatgcttcttgtgttcaagaaaaaagctttcgtttgatccagcttcacgtcgaatcaaaaggagaattcttaaaaaaagaatggcaagatactattttggaattatttcgctattctgctgatttctttttttatacagacacagatgcgctcttagtcgaacaaataaaccgtgattatcttgatgctactgaaatcaacggtatttttctatctttagatgctgattttgatacgacaacgtctgtattcgttggttctttccattcacctggcaccgacctcgtccctttgtttgctgaagaaagaaaaatttttttaacagagcaaaacaatctttatactcacagccgtactttttctatgcaagatgtggctttacattactatacaaaagatactgtaaaagatagtaagttgatcaaaagttacatagaactgatcaaacaaaatgaaatggaagtgatcattcaagaattatggaatgaattaggcaatgtcagctctgctgcaaaaacactgtttcttcatcgtaatactctaaaatatcgaatcgaaaaatttcaagaacagtctggtttcaatctaaaaaaagccaacgatttactgttttgctatcttttattgcttcatgaacataattaa

SEQ ID NO: 3487 - DNA (genomic), 288 bp, Enterococcus faecium; double-stranded, circular
  misc_feature (B) LOCATION 1...288
  hypothetical: NO
  anti-sense: NO
tcgaaagaggtgaaagaaatggcaatttcaaaagaacgcaagaatgaaatcatcaacgaatacgctcgccatgaaggggatactggttctccagaagtacaaatcgctgtattaactgaagaaatcaaccacttgaatgaacatgcacgcgtgcacaaaaaagaccatcattcataccgcggcctaatgaaaaaagttggtcaccgccgtaacttgttagcttacttacgtaaaactgacgttcaacgttaccgcgaattgatcaaacgtttaggcttgcgtcgttaa

SEQ ID NO: 3488 - DNA (genomic), 750 bp, Enterococcus faecium; double-stranded, circular
  misc_feature (B) LOCATION 1...750
  hypothetical: NO
  anti-sense: NO
cttttggaggtatttatggattactcactaatgacccgtcttgcggcggaaatgattggtacagcattactaatcgttctaggtaacggtgctgtagcaaacgtagatttaaaaggtacaaaaggatatggcagtgactggatgctgattgctgtcgggtatggattcggggttatgatgccagcaatgatttttggtggaatcagcggtaaccacatcaacccagcatttacaattgctttagcatctaatggtctattcccttgggctgaagttgttccttatatcattgcacaattgattggtgcagcgattggacaattgatcgtagtagcttgttacaaaccttactacgaccaaacagaagacgtaaaccatgtgttaggtacattctcaacaatcaacagcgttggttctaaattcaatggtttcgtcaatgaattctttggttcattcgttttattctttggtgccctaggtattacaaaagcaccattcttccaagataatcttggtacagctcacttagcacttggtttccttgtatggacattagttgcttcacttggtggtcctacaggtcctggactaaacccagcccgcgactttgctccacgtcttgtacacgcacttcttccattgaaacataaaggttcttctcaatggggatatgcatgggtaccagttgtagcacctatctgtgctggtgtcgtagcagtattcttatataaattattatttatggcttaa

SEQ ID NO: 3489 - DNA (genomic), 261 bp, Enterococcus faecium; double-stranded, circular
  misc_feature (B) LOCATION 1...261
  hypothetical: NO
  anti-sense: NO
ttcttggaggtgaaaaagttgactcgcgaagaagtatttaacaaagtagcgaaaattatttcaaatcattttgagatagataccgataaagtgacggatgaattgaacatcaaagatgatttaaaagctgattcaattagtattatggaattcgttttagagcttgaagatgaattcggtacggaaatttcagatgaagacgctgaacaaattgaaacagtcggtggcgcagtagattatatcagcagccatcttaaataa

SEQ ID NO: 3490 - DNA (genomic), 1155 bp, Enterococcus faecium; double-stranded, circular
  misc_feature (B) LOCATION 1...1155
  hypothetical: NO
  anti-sense: NO
aaatcggaggtgaatttaatggagcagaacaaaaataataatgttgcttcaacactcgctcgtcaagggatgaagcaagtatcaaagaaaataggtcttgctttaaaaataaaaataggggtagttataggactgataacattggttggccttttagttataggttctttagctacattacaaggaacacaaactgcaactaatacaggaggtgcagaagtcattggtggcaacaaaccgttgtcacctgaagttcaaaaatggcaaaaaacggtagaaaaatatgctgaaaaatacggaattaaagaattagtaccttatgctttagcaattatgcaatgtgaatccggaggtaaattgccggatttaatgcaaagtagcgaatcagccggattgcctgtaaacacacttcaatatgaagaaagtatcgatcaagggctaaaacatttgagtaatgtgtataacattgctaaaagttatggcatggaaagtaactatgatggaatagttcaagcttacaattacggaatagcttacatgcactacttaggaaaaaacaaaaaaacacatactatcgaaacggctgaagcctactctaaaaatgttgttgctccaagtttaggaaatactacaggacagacttattcatatgtaaatgaagtatcaattaaatatggaaaaacatatttgtatttaaatggtggtaatttttactatgcagagttagttaaacagtatatcggtgggggtagtggtaatccggctaatccttcagaattttggggaaaaatgaaaacagaaatggaaaaatatcaaggttggccttatgtttggggcggtaaaaatccaacgacaggttttgattgtagcggattaacagcttatctttatcaatttagcgccggaattacaatagatagttatacagtaacgcagtatgaagcaactgaagcagtatcaattaaagaagcaaaagctggtgatctgattttctttagaggaacatatggagcgcctgatttcatttctcacgtaggtatttatgtcaatgaaacaactatgtatgacagtaattcaagcggaattggttatcacaattggcaagattcatattggcaatcacatagtccagagattcgtagagtcaaaaaatag

SEQ ID NO: 3491 - DNA (genomic), 354 bp, Enterococcus faecium; double-stranded, circular
  misc_feature (B) LOCATION 1...354
  hypothetical: NO
  anti-sense: NO
agaaattgggtggtttattttatgtcatatacaggaattttgagtctcaaagatatttgtcactacggtaaacggtgtaccgctacagagaaaatcacgaagaaactatcaactggccaaagtaaaaccgttgtgcagtgtaagaaatatataatccagaaagacaaagtctcagaggaaatgatttattacattgggaaacaaaagcaaataattttaaaagatcctatccccttaaaagagctatatccaacaatcaaacatgtttatgaccaaaacggtgtactgattggtcgaagaaaaaatggagtcttgcgttgtaccgcaaaagggatggggcgtttaatcagctga

SEQ ID NO: 3492 - DNA (genomic), 3573 bp, Enterococcus faecium; double-stranded, circular
  misc_feature (B) LOCATION 1...3573
  hypothetical: NO
  anti-sense: NO
tttaaacgggttcgttatttgaaccgcggggaaaaggcatatctgccggaatttgaaaaaatgcagcttgctcggagtttatatacgttccaatattacgaccccaacgatgccagcaagacaatcccccacgactgggatgttgacgcggcaaaaaaggtattccgcccgctgttagatgacccggaacaatgcgcggggcactatgaaaaaatggtgaaagccctggcaatggtatccccggatgagcgcgcctattctctgatggagccgacgcttcaaaaaatgggcgcatacctgcggggcgaatactccttattcacccctctgcctgatgccgtcttgcaggaggaacggcagaaaaagcagaaacagaaacagaaggaaaggcaggattccgccagacaaacggctgaacctgcaaccggccttgctgctgcggcaaaagccctttcccgcaagaaacagcctgccccacgggaggatgcagacgggcagcttactttagatatgttcgggctttcgtccgaaccagaacagccagccgcaactcctgaaccggagccggaactttcgcaggcagaaaccggcgcatctgaaacggccgtccctatcgcatcaaagccggaaccaccgcaggaaacgccgaacataccagaaggggctgcgcccataatggccgaaagccccgctgaccgctatgatttaggctatggccatatggggaacggcctgaccgtctggaaccgtctggaggaagaacacggcgactacaaaacagttgcccatatcgcccctgaccgtaccgtgactttttacgacgcggatatgccggaggaaatcagggaaaaaattcaaaaggttgccgctgccactgaaatgtccatttctgccacccaggacacgccagtattttccaccccgccccaggagccggaacgggtgcagcctgggaactcggagccagagccggaaaaggtgcaggacgcgcccgctgcggtcaatccagagccggaaaccggggacagcaatattgtaccatcccccgcgcaaaaggcgggcgcagaacccaccggcacaggttcgccgcagacccaggaagccccaaaaacagccgccgcagacggtctgaaccttacgcccaacgtggaggaatacctgaacctgaaagcccaataccctgacaaactggtaggcgtccgggtagggaaaaccatgctgttttacggcacagacgcagaggaagccgcccctgcgctgggaacgaaaaccatcacccgcgatattcccgacctggggatggtgtccatcaccggagccaatggctggcagtccgtcttaaaaaagctgctggaacatggaaaaagcgtggtgctggcgcggcctgacacggaacgcggcggcgatgccccctatgaaatcatcaaggaacgcagcgcggcggattatatccctgtcggcatggaactgaccattgacgggcggctgatgaagattgacagcgtggactataacgccggaaccgtcagcctgcaagatatggaactgcggggctggtatcccattttccgcagtgaaagcatcccctttgtgcggcagtttgtagaggaagtccagcaggagcattttacagcggaacccatgcaggagccggaacgccccgaaacctccgatttagatacggcaaaacagctaattgaacagtttgcctacgccgaatatggcagcgatgatgtggatttttccgatttggagcatatcgggattgcctatggcacgaccgaggacggcggtttagaagtccaggtggacgtaaacctgctggatttctccatcagccagtccgtagacgggaaatgcgtggaaacacggcagtatggcagcctgcgggaactgattgatatggaacttgctttccttgactatgatatgctggtttccgtggaaccggatattgaagaacggttaaaagccgaactgaaccagcggatcaggtggtcagaaatggcaggtgccagagagggcgtggagccaacagagccggaaatttttccagagaaggacgtttctccagaacaggaagcaccgccggaactggtggagattgacggcgggcagattacggaaaccccggcgcaaagacagacccgccgccgcgcccaggaggaagtggacagccgggtattccccagcgagattattttacagccgctccgtctggagccggaacgccacaacttccgcatcaccgatgaaaatttaggcgcaggcggcgaaaagaccaagtaccagtacaacgtggaagccatccgcaccctgaaacagattgaagccgaaaaccgccttgccacaccagaagaacaggccattttatcccgttatgtgggctggggcggcatttcccacgcctttgagccaaacgacccaaaatgggcaaaggaatacgccgaactgaaagaactgctcacccctggggagtaccagtctgcacaaagcacggttctcaacgcccactacaccagccccaccgttatccaggcaatctacaatgcggtggaacagatggactttacgccggggacggttttggagccgtctatgggcatcgggaactttttcgggatgctgcccgaaaaactggcggcagcaaagttatatggtgtggaactggacgacctgaccgggcgcatcgccagacagctataccaaaaggcggatataacggtagacggatttgagcgcaccgaccacccggacgatttctttgaccttgcggtgggcaacgtcccctttggcagctatcaggtgcatgacaagcggtacgaccgtcaaaacctgatgattcacgactatttcatcaccaaaacgctggacaaggtgcgtcccggcggcattgtggcctttatcaccaccaaaggcacaatggacaagaaaaacagcaaggcgcgggaggcgctggcacaaaaagccgatttattgggtgcagtccgcctgcccagcaatgcgttcaaggccaacgccggaaccgaagtcacaacggacatcctctttttccagaagcgcgaccgcatcccggaaaaactcccggaatgggtggaggtcgggcagacagaggacggcatccccctgaaccgctactttttagaccacccggaaatggtgctggggacaatgacaatgggacgcagtatgtacggcaatgaaactgaaaccgcctgccagcccatccccggcgcagacctttccgggcagcttgcagaagctatccggcatatcgcaccgcctgaccgggaactgttagaagtggattccgggcaagacggcgaagaactggaaagcatccccgccgaccccactgtacgcaatttcagttacaccctatccaatgataagctgtacttccgggaaaactcccgcatgacccaggccgtccttggcaaaacccccaccgagcgcgtcaggggcatgatcggcatccgggacagcgcccgcggcctgatcgacttacagcttggccggcgcagacgacccagaaatccagtccgagcaagcaaaattaaaccggctctatga

SEQ ID NO: 3493 - DNA (genomic), 903 bp, Enterococcus faecium; double-stranded, circular
  misc_feature (B) LOCATION 1...903
  hypothetical: NO
  anti-sense: NO
acgataagggtaaaatgtaacgagaaggggttgaaaaatgtgtatcaaattgtaacagattcttgttgtgatctgccataccatgtattagcaaaagaaaaagttgattttttatcaatgaatctccaattgaatgatcaagagttagtagatgacctcggaaagacattcaattatgaccgctacatgaatcagctgaaaaatggtgcgatgcctacgacatcacaaatcaatgttggccgatatttagaatttttccgttcttatgcggaaaaacagattcctgttttatatgtggctttttccagtggattaagcggctcttacagtagtgcgcttcaagcggttgaattgctgaaggaagaatatgaagaccctgagatctatgtttttgatacaaaagctgcaagtattggggaagggcttttagtattggaagctgtaagattgaaaaaagaaggtaaaagcatcgaagaaaccctagagtggctggaaagtaattatttgaaagtccattcatgggtaacagtagacgatctgaaatatctagaacgaggcggtaggatttccaaagcaagtgctactcttggcagtctattgagtgtaaagcctattattacggtggataaagaaggaaggctgacgaatgttgacaaagttcgaggaagaaacaagtcgatccagacaatcgtcaatgagacggtaaaaacaatcgttgcaccacttgatcaaatcgtttatgtggcttacgctggggatctagagagcgcggagaaggcaaaacggcttttggaagagcagataaagatgaaagatgtgaagctttatcccttaggaccaacgatcgccagtcacacaggctatggctgtatcgcgattttttcgatgggaatcagtcgataa

SEQ ID NO: 3494 - DNA (genomic), 1020 bp, Enterococcus faecium; double-stranded, circular
  misc_feature (B) LOCATION 1...1020
  hypothetical: NO
  anti-sense: NO
ttgaaaagggtgagtaaaatgccagattatcatatagcaatcgttaattccagcagtttcggaagagtctttccacaccacttggaaagattaaagtcagttggagacgttcatttctttactgttgatcaagagattccaggaaaagaactagcggagttacttaaaggattcaatatcattattgcaagtgttacgccattttttcgacgagatttttttgaaaacaaagatgaactgctattgatttcccgacatggtattggttacaacaatattgatttaaaagcagcaaaagaacaccagacaatcgtatctatcatacctgctttagttgaacgaaatgctgtagcagaaaataatataactaatttgttgtccatgcttcgacgcacgacacaagcacaagcaagagtcaaggacgatcgatgggaagatcgggcggagttcgtcggtaggacgctgtttaacaaaacagttggtgtgattggtgcaggaaataccggaagcggagtaatcgaaattttgcgtaacggttttcgctgtgatgttctagcttatgatccttacaaatcagatttatacatcgaaagctttggtgcaaaaaaagtagaacttcaagaattactggaacaatcagatatcatttgtttatgtgcgaatttgacagaagagaactatcacatgatttctgataaagaagtcgatcagatgaaagaaaatgtttatctatctaatagtgcaagaggcgctctagttgatgaagaagcgatgattaatggtctgaaaagcggaaagatcgcaggatatgccacagatgttttagaagaagaaccgggacgtcaagatcatccgtatttagcgtttgaacaagtagtgattacgccacatatatcggcctacacaagggaatgtttagaagcaatgggtgaaaaatgtgtcagagatgtcgaacagatcagtcagcaccttcttcctgaacgttctgtccagacaaagagcaactatataaaaggatga

SEQ ID NO: 3495 - DNA (genomic), 1287 bp, Enterococcus faecium; double-stranded, circular
  misc_feature (B) LOCATION 1...1287
  hypothetical: NO
  anti-sense: NO
aagaaaagggttgagggagaaaaacatatgatcaggttgttggaaagaaactatagaaagatggaaaaaatcattcgaattctgtccatttctgacaagtggatgactaaaaaagaacttgccaaacgaattggtagttcagaatctacatttgtaaggtatatcgaagagatcaaaatccgctggggaacggatgtaacgattcaatcttcacaaaaattggggtatcgtcttgaacgcaatcaaattttagaaagctatttattaaaagtgatcgttgaccaaggttttcagttaactagccttaaaagtgagctccagttgcgtatctttgttacctttttctttttaagttactacggaagacgcacgttgccatttccaatcgaaaaaaagaagatcaaagaaattatggtcaagaataattgtcagatgaatttgtttcaggaagaaagcccatatgagcaatctttctttattatgtattttgttgtgcatctcatgagagaatcccaaggaactccatttgaatggaaagctggagactcttatgtacagttgataaatatcgataaaaaagacttcttaatcttgaaaaatctcttaggaaaattgaagtacagcagctatataaaagtagtgaactattttgtcaatacgattttttcagaattttcggagaaagaaaaaaatgaaatcagtgagcagatacgaaaaaatatgtcctactgttcgttttcatccgctgattgcaaagaaaaaaacgaagaatatgttgttcaattattaacgcaaatttattttttctcccgtattttcccatacgatacgactcatttgacgatccgtgcaacttactttgcacagcagatgcaacaccgccagatacgtctatatgctggatttcgtgcagaacttcaattttattccactctactgaatcagaatctgatttattatttatctagctatatcttttggatgcttatcggtaatcctgaaattcaccattatacttctgataaaaaaatactgattatcagcgacttaagtcttcgacatagtcaatatattgaagaatatatcagtgatattcttgctgtgcataaaattcactctgagacaactgctattactgaagatcagctgtcgaaatacaatcttctcgagtatgatctgatcgttacgaatcaacccattttgaatgcccatgttcctcatatattgattgatgatagtgtgtcattcgcaaatgaagaagaactcatccgcttattcgagttatga

SEQ ID NO: 3496 - DNA (genomic), 513 bp, Enterococcus faecium; double-stranded, circular
  misc_feature (B) LOCATION 1...513
  hypothetical: NO
  anti-sense: NO
ttaaaaggggtgctttttttgcggaaatatacatttgtttttaagaaaaaagtagtttcagactatttaaataacgaaggcggctacaaatatcttgcacataaatatcaaataaatcgtacactggttagacattgggtaaggatttataactatcatggttgggaaggcttggttggaggtggcaaaagctacactacaaaatttaaacttgatgttatagaatatatggaaacaaatggtctttctatccaagaaactgctaaaaaatttaatatcggttcaaatagaactctaagtaaatggatagagcaatatgaagaaggcggtgcttcttcacttgagagccaaaaaaggggcagaaaaattagtatgaattccaagctaaacattcctaaaaaacttaaagatgagtctcttgaagaagaagttattcgtttaagagcagagaacgcatatttaaaaaagtggaatggcaacactttttttgacaaaaattataaggtgttgtga

SEQ ID NO: 3497 - DNA (genomic), 306 bp, Enterococcus faecium; double-stranded, circular
  misc_feature (B) LOCATION 1...306
  hypothetical: NO
  anti-sense: NO
ttaaaaggggtgctttttttgcggaaatatacatttgtttttaagaaaaaagtagtttcagactatttaaataacgaaggcggctacaaatatcttgcacataaatatcaaataaatcgtacactggttagacattgggtaaggatttataactatcatggttgggaaggcttggttggaggtggcaaaagctacactacaaaatttaaacttgatgttatagaatatatggaaacaaatggtctttctatccaagaaactgctaaaaaatttaatatcggttcaaatagaactctaagtaaatag

SEQ ID NO: 3498 - DNA (genomic), 555 bp, Enterococcus faecium; double-stranded, circular
  misc_feature (B) LOCATION 1...555
  hypothetical: NO
  anti-sense: NO
ttaaaaggggtgctttttttgcggaaatatacatttgtttttaagaaaaaagtagtttcagactatttaaataacgaaggcggctacaaatatcttgcacataaatatcaaataaatcgtacactggttagacattgggtaaggatttataactatcatggttgggaaggcttggttggaggtggcaaaagctacactacaaaatttaaacttgatgttatagaatatatggaaacaaatggtctttctatccaagaaactgctaaaaaatttaatatcggttcaaatagaactctaagtaaatggatagagcaatatgaagaaggcggtgcttcttcacttgagagccaaaaaaggggcagaaaaattagtatgaattccaagctaaacattcctaaaaaacttaaagatgagtctcttgaagaagaagttattcgtttaagagcagagaacgcatatttaaaaaagttagaaaccttgattcaagaacaagatttgagcaagaagaaatcaaggttaaaacaatccttcagctcaaaaaagaatttaaattga

SEQ ID NO: 3499 - DNA (genomic), 861 bp, Enterococcus faecium; double-stranded, circular
  misc_feature (B) LOCATION 1...861
  hypothetical: NO
  anti-sense: NO
gtttttttatttttcttgagagggcgaagcaaaatgaaaattgataaaattttgaataacaatgtcgtcatttcgaaaaatggattcggggaagaagtcgtttgtatgggaaaaggactagcttttcaaaaaaagattggggacgagatttcgccagaagcggtccaaaaagaatttgttttaagagattcttttgctaaaaaccaattccagcagctgatggctgatattccggcagaggagatcgaatgggtcaaacaagtagtcgaactggctgaagataaactaaaagttgaattttcgcctaatatttatctgacattgaccgatcatcttcattatgcgatcacacgagcaaaagaaaatatccaactgcctaatccattattatttgaaacaaaaaaattttatccgaaagaatatcaagcagcgaaagaggctcttttgttcgtgaaacaaaagacgggtgtggaactttctgaggatgaagccggttttattgcctttcattttgtgaatagccaacaaggaaacgaagacatgcaagtgacgatgaccgctaccacaatggtaagagatatactgagtatcatcagtaaattcttcggcatcgtgttcgatgaagaatctttgaattatcagcgtatcattactcatctgcagttttttgcccagcgttatctcaaaggggaaggatctgacgagcaacatgaatttctctacgcattagttccaggaaagtatccaaaagcgtttcattgtgtcgaacggatcaatgagtatcttcgacaaacgcaaaaaacgggaaattggggatcgcagagcagatttatttttaacgattcaatattccaagagtag

SEQ ID NO: 3500 - DNA (genomic), 942 bp, Enterococcus faecium; double-stranded, circular
  misc_feature (B) LOCATION 1...942
  hypothetical: NO
  anti-sense: NO
tttttttctttatgctatcgttatattaaagaaatcaatcagaagggaaagaaagtgatgaaaaaagttttattagtggtaaaccccagttcaggcggtgaacaagcaaaggaatttgagcaattagcgatagcaaaattggaatcggtgtttgatgaagtggtcgtcttgcatacaaaaaaagcaggggatgcaaaaaactttactcgcgaagcggctacggaagggtatcatagtgtgtttgtcatgggcggagatggaacagtcaacgaaggaatcagtggaatcgctgaacaagaacatcggccaaatttcggatttttcccattgggtacggtgaatgacttggctcgagcattagggataccgctagaacctgaggaagcgatcaatcatttttcgattgaatcagtcaagccattggatattggaaaaataaatgacgactattttatgaatgtcgtcgcaattggctctatccctgaatcaatcaatgatgtagatgcggagaagaagacgaaatttggaaaactagcttatttcatgtcaggaatcaaacagttagcttccacacaatcctactcgtttcacgtagaagttgatggaaagaaggaagaaattgagagcagtaccttgctgataggactaactaactcagtcggcggttttgaaacattacttccaaatgcaaaagtggatgatggtaagctccatttggtttatttaaaagattcttctttgatcgatacgcttaaaacattgccagacctattaaaaggagtagatgaatctacgaaaaatctagcctaccttacttgtgagcaattagttgtgtcattagctgatgaggaagaattgacgacgaatgttgatggagatgaaggggataaattacctgtgacaatcaaagtattgccctcacatttacaggtttattgttaa

SEQ ID NO: 3501 - DNA (genomic), 207 bp, Enterococcus faecium; double-stranded, circular
  misc_feature (B) LOCATION 1...207
  hypothetical: NO
  anti-sense: NO
tcctttttatttattttttctatatttttcttcttaaattttaaacacggatcattttaccgatattgtgattcgatggtacgacttgggatgatccaagcagctagaatcacgatgtttgcgatcagcacggctactggcgntagtaaataccctaagacaattcctaacacattcaaaccaatcgatagatacgatttgttgtaa

SEQ ID NO: 3502 - DNA (genomic), 1551 bp, Enterococcus faecium; double-stranded, circular
  misc_feature (B) LOCATION 1...1551
  hypothetical: NO
  anti-sense: NO
aaaaaatttttgaaaatggtgggtgatgatatgactgaacatatctttaacagaaaaagtgcgagcattattcttaaagcaaaatttgaaactggaaaaagcaaaaagaataatcacatggtagaacttcaaaaatttgtagattatatttccagacaagaggctattaggcaagataaactagatcatgattattcagaagatgaactaaatgaattagctagaatagaaaaagctttggaaaaaatagaacaggaaacagatcaaccagtgattaaagatttacgtgaaatggataaatatattgattatatgacacgtaaaaaagctatcttagaaaatgtagataatgaaatagtaaacggagcatttagcaatacaaaaagatatatcactaaaaaagacatttcaaaaataaaagaatcggtcatagaagcaaaaaataatggatcggtgatgttccaagatgtaatttcattcgataatgattttttagtaagggaaggatattataatccagaaacaaatgaattaaatgaaaatgttctatatgaagcaacaaagtctatgatgggaaaaatgcaagaaaaggaagaactagttgatcctttttggtttgcaacgattcacagaaatactgaacatatccatattcatgtaacagctatggagcgtaaaaatactcgtgaaataatggaatatgatggtgttttacaagctaggggtaagagaaaacagtctacgttagacgatatgatttttaaattcggtagcaaaatattagatagaacgaacgagtttgaaaaaatttctaagttgagaaaagaagttcctttagaacttaaacagtctgtaaaagattctttgattcaattatatgtagaaaataattcaagatatgacaaagaattagtaaagtacctaaaggaattaaaaaaagaaatacctagtacaacacgtggctacaatgagcttcctgaagaaacaaaagaaaagattgatgaagtcacaaattatatgacaaaggataatccaaaaagaaaagaatatgatcgtatgactaaagaaattgatgagctatatcaaacaacctacggtaaacgctacaatccacaagaatattatttaaatagaaaaaaagattttaatgctcgaatgggtaatgctgtagtaggacaaatcaaacttttaaagcaatctgaagaaaaaaatttgaaaagtaatgaacttaaaaatctattagacggaaaaaaattaaacgttaagtttgatagagaaaaaccagaatttaaaacgaaatatgctaaacaaagttatgatgatttccaaaaaagattagaagaacgacaattagcacgtgaaaaaaatgaagtccacttcaagaagatttctgaaaaatttaaagataaaaagcttattagaaaaattgatagagtaatcaatgatgatttaaatatgtatcgtgcgaaaaatgattatgaagtagcgcaacgaatgatagagcaagagaaaatgagacaagcacgtgaatttgaaataggaatgaattag

SEQ ID NO: 3503 - DNA (genomic), 186 bp, Enterococcus faecium; double-stranded, circular
  misc_feature (B) LOCATION 1...186
  hypothetical: NO
  anti-sense: NO
tatttttcttttctattttataaaacaaaaacagccaatccctatgaagggacggctgtttttgctttattgttatttccagaaatcatccaaaacggaaattggcaaatgtcgtttatgttgtgtcttgttccaccatgcttcgattttttcttgtgcttgagcgggaacttcttttccttctag

SEQ ID NO: 3504 - DNA (genomic), 186 bp, Enterococcus faecium; double-stranded, circular
  misc_feature (B) LOCATION 1...186
  hypothetical: NO
  anti-sense: NO
gagaaatttttgaagtatctgaataataaagaaaccgttttcaaattttggtatgatgaatgtagcaaacgtaaacaactaatggatggaaaaggagcggataaaaatgaacatcagaaagttaattgctggagtcgtttgtttagcggcagcatcaggtttcttaacaggatgcggaagtgctag

SEQ ID NO: 3505 - DNA (genomic), 243 bp, Enterococcus faecium; double-stranded, circular
  misc_feature (B) LOCATION 1...243
  hypothetical: NO
  anti-sense: NO
ctttcttctttgatcttcttgatcgtagagatcacttcttcacgaccttctggatctagcatactggttgcttcatctaaaataatgatatcaggtcgtaaggcaaccacgccggcaatggcaacacgttgtttttgccctcctgataaacgagcaggctcgcgtgaagcaaactcagccattctaactttctcaagtgcatctttcacacgcactagcatttcttctctgggaatcccttga

SEQ ID NO: 3506 - DNA (genomic), 195 bp, Enterococcus faecium; double-stranded, circular
  misc_feature (B) LOCATION 1...195
  hypothetical: NO
  anti-sense: NO
aggatattattcaagattaaaaattgcaaagattatgctcagttattattacaagattctatttatttattaaattttttcggagaattaaaaaatacaataaataactttagttactttaatgcgttcttactttatttttatattatcatttttcttattcacttctttggtttatactattcttataaataa

SEQ ID NO: 3507 - DNA (genomic), 1560 bp, Enterococcus faecium; double-stranded, circular
  misc_feature (B) LOCATION 1...1560
  hypothetical: NO
  anti-sense: NO
acatcattattcagaataagggactgtgataagatttttgtcacagtcccttatgttttgcaaaaaaagtttttcttttttctcgtaaattcggtaaaatcaaaagaaaaaatagaccatagaaaagagaagcttatgtgggaaaaagtagagaaaaaacaaggaccgatttatcgtcaaattatggaacagattatgagagaaatcgaaaacggaaggatcaatcctggaagtcaacttgaatcagaacgaaaactagggcaactttttggtgtgaatcgttccaccgttgtccatgcattggaagagcttagggagcttggggtactaacgagcaaacgtggcagcggatggtttgttaatcagactgaatgggggaaattcgctgttccaagaatcgattggcggcaaatgatctctcctcgttatgagcagacggactggtatgagcaaaaaataagagaagcaaagcagatccaaaaaacatcgtttcttgatttatacgctagcgagatgccagatgagcttttgccgaattttgagtttccttcttattctcttgaagaaatcttagcggaagaaaaagaaatggatcttttaggctatactccgttacgtaacaaaatcaaacggtatttggaaagtaaatttgaattggcattttcccccaaccagcttcttgtgactggtggcggtcagcaagcaatctttttgattttacaaacgattctttcagctggagaggggatagctgtagagtcaccttcttttttttaccgattacctcttttcaaagcttcaggaacgcgtttatttgggataccgatggatgaagaagggatcgacttagaaaaactgaaagaatcgatccataaaaataaattgaaagcagtgcttatcaacccgaattttcaaaaccctacaggaaaagtgatgagtcaaaaacgacgagaaaagctagtagaattgtgtcgacagtatcggcttccaattattgaagacgatgtatttacggatctttcatttctaaaccaagaagaagtccttcctatacgaacgattgatccggataatgtgttatacgtcggttcgttatctagggttttaggaaaaacaacgaaaatcggttgggtgataggacctgagacttttatctcgcaactagctcaagcgcaagaaatgatggagttttcgatgaatatccttacacaaatcacagtggctaatgtatttaatgaagcaattgatttgaaaatgcaagatgtaagaaaaaagttgaaagaaaaaagccgactgataagcgcttggggagattcacaatcgtttttcaagcttcattcaattttaggtggttactatgcctggattacttgggatgggaaaaaactagaccccgaactagcagaaaaagtagtagatatgggtcttggaattgcaccaagtctactttttgggcaagatataaatggaatcagaatcaattacagtaggctggatgaaaaccaaataccgttgttttattcaaagatgaaaattctagaaaagtggttaacagaataa

SEQ ID NO: 3508 - DNA (genomic), 915 bp, Enterococcus faecium; double-stranded, circular
  misc_feature (B) LOCATION 1...915
  hypothetical: NO
  anti-sense: NO
nnnntnnttntnnnnntnnccnnnnnnnnnnnnnnnnnnnnnnnnnnnnnnnnnnnnnnnnnactgacgaaagtcgttgcaaccacttcattagttttacgtctattagaagatggaaagatagaactcgatcaaccgcttcataaatatcttcctgaatttgaaaatcagacaatcactttgcgtcatttactgacacatacttctgatatcaaaacatggataccaaacagagataagctatctcaggaagaattgatcgccgcttatttgaagctagaaccaggtgagcaactaggaaaagaagtaaaatatacagatgccggtacgattcttcttgggttgatgctagaggaaatttaccaagaaactgcagtggaaatctttcaagaacaagtattggaaccattaggaatgatgaacagcttatttcttccttttccttccaaaaaaatcgttcccacagaacaactgccttcgggtgaggttttgcgtggacaaactcatgatccgaaagcaagagttttggctgaacatgcaggtaacgcgggtctctttattgatttgaaagacagcattacttttgtccaaatgtatttgaacaagggaaaaatccgtaatggtcgttttttagaagaagagacgattgattctttactgcaagatcaaacaccgaaaaaaaatggctatcgttctttaggatgggacttaaaaaaggatgtagaagacggtcatgcgattctttttcatactggttatacaggtacgtttttcttgattgatataaaaacacaagaagcgttgatatttttgtcaaatcgcgtacatcctgtcgatcatcgtgcggagtatctcatatgtcgagatgaaattgttgaaaactttttgaaagagaaagcggtattaccgaaataa

SEQ ID NO: 3509 - DNA (genomic), 1296 bp, Enterococcus faecium; double-stranded, circular
  misc_feature (B) LOCATION 1...1296
  hypothetical: NO
  anti-sense: NO
atgcaattattacaacaaatacatggattaagagggactgttaggataccagcagataaatcaatttcccatcgcagcatcatgtttggagcaattgctgaaggaacgacgactatacaaaattttttgcgcgcagaagattgtctgagtactttacatgccttccaacaattaggtgtcgagatcgaagaagaggaagaggtgatcaagattcatggtcgcggtagccactcatttgtccaaccaaccgaatcaattgacatgggaaactccggtacgaccatacgtttattgatgggtattttggctggacagccttttacgactactctgttcggggatgcttcgttgtctaaacgtccaatggggcgagtgatggaacctttacgcgagatgggcgctgacttgcaaggagaagaaaatgaccagtatctaccaatcactgtgacaggaacccgctctttatcacctatccgatacaatatgcctgtagccagtgcgcaagtcaaatctgctttgctgtttgcggcattacaagcagaaggcacatccgtaatcgttgaaaaagaacgttcccgtaaccatacggaagaaatgattcgtcaatttggcggaaggatcacagtggaagataaaacgatcatagtgaccggaccgcaaaaattaactggtcaacagataactgttccaggtgatatttcatcagctgctttctttctagcagcaggacttcttgttccggaaagccaactgttgttaaaaaatgtcggggtcaatccaacaagaactggtatcttagatgtgttggaggagatgggcgcagcgattacccagacgaatcacaatgaacagaaccaatcggctgatttaagtgtcaagacgagtcatttgaagaaagcaacgattggtggagaaatcattccgcgtctgattgatgaattgcccattctagctttagtggctactcaagcagaaggaatcacgatcatcaaagacgcagaagaattaaaagtaaaagaaaccaacagaattgatgcggtggcagaagaattacagaaaatgggagcaaagataaaagcgacagcagacggtctgatcatccatgggccgacacctctgcatggcgcaaaagtgtccagcagaggcgatcatcgaatcggtatgatgctgcaagtagctgctttgatagctgatggaccttgcgaactagaaggagctgaagctgtttcaatctcttatccggcattttttgacgatttagcagaacttgtgtcaggaggagaagctcatggctag

SEQ ID NO: 3510 - DNA (genomic), 204 bp, Enterococcus faecium; double-stranded, circular
  misc_feature (B) LOCATION 1...204
  hypothetical: NO
  anti-sense: NO
ttttattctttcagttgtttttattttgtctacagaaaagaaaagtcagttattgctgatgaatggaggttaacaattggagccgttgatagtgataaaaggtgcgaaaaaaatcattcgaaacaaaacgattcttcatttggatcgtttcactgcggatgctggggatcttgtgactgttgttggagaaagtggagcaggtaa

SEQ ID NO: 3511 - DNA (genomic), 1236 bp, Enterococcus faecium; double-stranded, circular
  misc_feature (B) LOCATION 1...1236
  hypothetical: NO
  anti-sense: NO
gaggaattttttatgacaacaactatctctacagaccaattgaaggatctaatccaatatcgtttaccagtatatcaagcacttgctctagatatccacgaacatcctgaagtaagttactatgagttttattcctcagcagcgttgattaaacaattagaaaaagaatggttttgggtagaaaaagaagtagctggacaccgaacagcctttgatgcacgttatatttccaataaacccggtcccacaattgcctttttggcagaattcgatgctttaccaggtattggtcatgcatgcgggcataatttgtttggtacttattccgtattatccgccagcatagtgaagcaattcattgatgaaactggtggagatatccgtgtatatggcaccccaggtgaagaagggggcgagaacggatcagctaaaggcagctttgttcgagaaggtttttttgaggatgtcgatgtagcgttatgcgtccatccagcttttcgttatgggaaaacgacagaatctttagcgaatgatccagtcgacatcaaattttacggtgtcgcttcccatgcagcagcagcacctgaaaaaggagtaaatgctttggaagcattgatccaagtgtttaatggaatcaacgctctacgcttgcaattgccaaaagatgtcaatatccatgggatcattacagacggaggagtagctgccaacgtcattccagattacgctgctggacgtttctatttacgtgcaggaaatcggcaaacattagataaagtatatgaaaaagtggaaaatatcgtacgaggtgctgcgataagtacgggcacgacttttgagtttggattgttccaaaatgcagttgatgatgtcatcgttactccttcttttgatgacttattcttccagcatgcaaaagaagcaggtgttccagatgaagaaatagaaacggaacaaagaacaagtctcggttcttctgatgtaggaaatgtcagccaagtcataccaacaatccagcctacggtagcaatctctgagacatatattgccggacacacagaagaattcaaagctgctgctaaaagtgacaaaggccttgcttctattgcgattgcagcagaactactcgccaatacagctcttgatctgttgaaagagccaaagctattagaaagaatcaagcaagaacatcaagaaatagtagcaagaaaaaaacaagagggcgctactttctag

SEQ ID NO: 3512 - DNA (genomic), 330 bp, Enterococcus faecium; double-stranded, circular
  misc_feature (B) LOCATION 1...330
  hypothetical: NO
  anti-sense: NO
tccaattctttctctaaatacattgttagttctttggaagacattgtctccacctccatattcatctgtcttgcagaacataccaaacatatatcgtgtcattcatctacaaagcaagtatgctatatttttgataacgcttacactgattatgagaattatttaaccacattttttatttacagtatctttttactttcaaatgacttatatagtatgaacaattaccttttagataatgatctattttactctacctgggcagataaatacaacacaaccattgatagaagccctttcgttaaaatcaattgtattctgaatatttaa

SEQ ID NO: 3513 - DNA (genomic), 297 bp, Enterococcus faecium; double-stranded, circular
  misc_feature (B) LOCATION 1...297
  hypothetical: NO
  anti-sense: NO
accaattctttggtgaagagcggcgccaaattagcaaaacttgcgttcgcagatgaagaacttgcaagttttaccgaccaattaggtaaaatcatcgatatggttgaaatgctggaagaagtagatacggaaggtgttccatttacgtcgaatgtggttgaaacagtaaacgtgatgcgacaagatcgggcgcaagctggatggaaccgcgatgaattattgaaaaatgtgccggaaacagaagacggctttatcaaagtacccgcaatcatcgataatggggaggctggcgcataa

SEQ ID NO: 3514 - DNA (genomic), 654 bp, Enterococcus faecium; double-stranded, circular
  misc_feature (B) LOCATION 1...654
  hypothetical: NO
  anti-sense: NO
aaatgtctattgccggagcttttctatcagcaatttttattctttactgatacaattactctaaacaaagaggtggcacaaatgagatgtccgtggagtgaacagacagaaaatatgcagcaatatcatgatactgtctggggtgttcctgaatatgatgaccaaaagctgttccgaaaattgatgctcgacatcaatcaggcaggattgagttggcagacgattttaaataaaagtgaagcattcgataaagcatatgatcaattcgatatccaaaaagtcgcaaattatggagaagcaaaaatgagcgaactaatggaaaacaaaggaattattcggaatcgcagaaaaatcgaagctgctgtccaaaacgctaaagcagtcttgaagattcaagaagaattcggcagtttttctgagtatctttggtcgttttctaatggaaaaatcgttgattcttcttatcattcacaagaagaagtcccgacaacaagttctctttcagatgaattagcaaaggatctaaagaaaagaggatttaagtttatcggaagtacaacaatctatgcttttttagaagcagtcgggatcatcaatgatcaccttgacagttgtttccgcaaagaagaggtcgtacgtatcggcaaaaaataa

SEQ ID NO: 3515 - DNA (genomic), 870 bp, Enterococcus faecium; double-stranded, circular
  misc_feature (B) LOCATION 1...870
  hypothetical: NO
  anti-sense: NO
acctgttctttgcttgcgatgatagaaaaagaaagatatcctaatgctaaaggagaggataacatgaaagtaggatttatcggcacagggaatatggcacaagctattattgatggtttattaaaaaaaggaacagtctcgaaagaagaggtgttcgtttccagtggacattttgaaaatgcacaaaaatttgctgctgaaactggcgtccatgcatgcaaaagtaatcaggaagttgcatcacaatcagatatcgttcttttagccgtgaaaccaaaaatcattgaaaaagtattggaagaactaagagaatatagccagaaagtcttattcatttctattgcttcaggaaaatcattaacagatttagaaacagcgcttgaagatcctcaggcctccatcgtacgtgtgatgccgaatgtcaatgtcagcgtaggagcaggcgtttctgcgatttgcaaaaatgaagctgccacggaggaacagcttcagcaagctacgatgatttttgaagcaatcggcagcgtctatcctttagcagaatcagatttcagtacattcattggccttgctggcagctcacccgcattcgtttacatgctgatcgatgcgatgggacggactggtgtactgaatggtttgtccaaacagacagccactgagattgctgcaaaagcaattatgggttcttgtcaaaaattcctttcaagtgataaaaatccatgggaacttgtagaccaagtttcttctcctggcggtacaactgttgcaggtgtagttgccttagaagaagcaggattcatcccagcaatcatcaaaggaatcaatacgacgatcgagaaagatcttgagatgttgaataaaaaataa

SEQ ID NO: 3516 - DNA (genomic), 360 bp, Enterococcus faecium; double-stranded, circular
  misc_feature (B) LOCATION 1...360
  hypothetical: NO
  anti-sense: NO
tttttactatttaaaagcactgagatcctatgttggatttcggtgcttttttgtttttatgttaaactattatttaatgaatatagatttttttcaggaggaaatatgaaaaagaaaataatccgattgatgttgatctcgttgggaatcattctgatactggtagtgggctatcggttgtatttagaatatcagacagacatccaattatttttaaatccgagagcgagtaaggcagagctactcgcacatattcgttcgcatgggacttttgcatcgatactcttgatcgtattgacagcggtgatgtgtgctgttccaggtattcctacttcagtagttggagtcattgcggtttga

SEQ ID NO: 3517 - DNA (genomic), 348 bp, Enterococcus faecium; double-stranded, circular
  misc_feature (B) LOCATION 1...348
  hypothetical: NO
  anti-sense: NO
ggtatactattctttgccgaaaggctaggacaatggtgggcttgtgaagcgtgtcaggtctggaaggaagcagcactaagcaggttccgccatgtgtctgattataatgaaacgacaacagactttcgggtctgttttttttatttttatagtactgtaaaaatgaatgttcctgattttttagccagactgatttatcgaatattgtacttatacaatttgcttcaaggcaggaaaaactctgaaatagagcttgtttcaatggaagaaaaagctgcctatggtatgataaagataaagagaggcgagagggtacatggaaaaaatagtgattttacatacgaatga

SEQ ID NO: 3518 - DNA (genomic), 1281 bp, Enterococcus faecium; double-stranded, circular
  misc_feature (B) LOCATION 1...1281
  hypothetical: NO
  anti-sense: NO
ttttcactattcacgtcaaaacagaaaaaaagaaaaaggaggggaaaaatgacgaccacagggaagaaactgaaagttattttcatgctgataatattgagtttatcaaactttgtgccattatctgcaatagcagacactacagatgatccaacagttttagaaacaatttcagctgaagtcatttcggatcagtctggaaaaaaagcactgaacatcaagctaaatgcgaataacaccagtgctgaaaagatagaaaaagaaattggtctagtcgaaaattacttaagtgatgtggaaagaaaagaaggagatggctatgcttatcaggtaaatagcgggaaaattacgttggaaatctcatcaaacactaaacaaactatcgatctgagttttccaatcgatccagcactttaccacagccaggcaaacaagctgatcgtcgataataaagaatatgacattattgatgagacagaaaataagaaagatacagatgtgtcagtaccaaagccagacgaaatagaagaagaatcatcaaaagaaaacgaaaattctgtcagcccatttacattgcctacattatccttgccagctgtgagtgtgccatctaatcaaacgattcctacagaatatacaacagatgatcagggcacttatcctaaagccagttggcaacctacaggaaatacaaatgttcttgatcatcaaggcaataaaaacggaacaaatcaatgggatggtataaattcttggaatggagatcctaatgatcggacccattcgtatatcgaatatggaggaaccggtaatcaagcagactatgcgatacgaaagtatgcaaaggaaacaagtacacccggattgtttgatgtttatttgaatgctcgtggaaatgtacaaaaagatatcacgcctcttgatctcgtattggtcgtagactggtcaggaagtatgaacgacaataatcggatcggtgaagtaaagattggtgtcgatcgttttgtcgatactttagcagatagcggtatcacagacaaaatcaatatgggatatgtcggctactcaagcgaaggatatagctacagtaacggtgcagtacagatgggttcatttgattcagtgaaaaatcaagtaaaatccattacaccttcacggacaaatggtggtacttttacacaaaaagcactaagagatgcaggaagcatgctatccgttccaaatggacataaaaaagtgatcgttttgctgacggatggtgtacccaacattttcctataa

SEQ ID NO: 3519 - DNA (genomic), 213 bp, Enterococcus faecium; double-stranded, circular
  misc_feature (B) LOCATION 1...213
  hypothetical: NO
  anti-sense: NO
actgcactatttgctgaggacaaagaagcaaccaaaatcattagattgacaattgctgctccgccttggcaatggatcacttgcagcatagtcactaaaggactttcttttaaatctaaacaatgccatggaacaacaaataaaagagagtataaaatattttgtgtaaatgaaaaaatccatacaaaaaaggaagtcccttctgtagaataa

SEQ ID NO: 3520 - DNA (genomic), 213 bp, Enterococcus faecium; double-stranded, circular; identical to SEQ ID NO: 3519
  misc_feature (B) LOCATION 1...213
  hypothetical: NO
  anti-sense: NO

SEQ ID NO: 3521 - DNA (genomic), 186 bp, Enterococcus faecium; double-stranded, circular
  misc_feature (B) LOCATION 1...186
  hypothetical: NO
  anti-sense: NO
aaaatgctattgtttcccacaaaacctcacatgcctacttgtttacaggacccagaggaaccggaaagacgagtgcagcaaagattttcgcaaaagcaatcaactgtccgaacagtaaagacggcgagccatgcaacgaatgcgaaatgtgtcgatcaattactgctggtacgcaagaagatgtga

SEQ ID NO: 3522 - DNA (genomic), 183 bp, Enterococcus faecium; double-stranded, circular
  misc_feature (B) LOCATION 1...183
  hypothetical: NO
  anti-sense: NO
aaaaagctatttccacttgctgatacttcaaattatgtcacctttcttcctactatgtatcctatcataatttgtagaaaaacagtaaaaaaaccagtcgaaagtcttagagaaattttagcttttattcggtacaatgaaataaagaagaaagaatatgtctatgcgattattttctcataa

SEQ ID NO: 3523 - DNA (genomic), 252 bp, Enterococcus faecium; double-stranded, circular
  misc_feature (B) LOCATION 1...252
  hypothetical: NO
  anti-sense: NO
gatttctctttaccaacatcatttgacaaagagccccttttttgccgagtaaacggtgttcaaaagccagtttctcggtatgaagtcaaatttaagcaaaaatgtgagaagctattttcacaaaatttttcttcatactcgaaactaagcggctttttcacgacctcttttttattttgccatgaacatatcataatacgcgtccattatttctttagcaatcgtcaagttcatgtggtcttgttcgtctaa

SEQ ID NO: 3524 - DNA (genomic), 1488 bp, Enterococcus faecium; double-stranded, circular
  misc_feature (B) LOCATION 1...1488
  hypothetical: NO
  anti-sense: NO
tattatatattgaacaggagaggaatacagattatgaaaagcaaaatgatccaacgtgtgtcctacgctttaggcgcttttggacacgacacattctatgttacattaagcacttattttatggtattcgtgacaagccagatgttcgcaggaacagataaggcaacgaatgcaaaaatgattgctacagttacaagcttagttgtaggtatccgcttagttgaaattatttttgatcctttgattggtggcatcatcgataatactcgtacaaaatacggtaaattcaaaccatggttagttatcggcggcgttgttagttccgtactcttggtagcaatctttaccaatttctttggcttagctactcataatacgactttatttatcatattatttgcaatcgttttcatcttattggatagtttttattcatttaaggatatcgctttttggtcaatgattccagctttgagtacggaaacaaaggaacgtgaaaaatttgctacgtttgctcgtttcggctcttctctaggtgcaaatggtactactctagtcgttgtccctatcgttactttctttacctatcttgttactcataaacatattgaaggcgcttcaggctggttctggttcggtgtgattgctgctgttatttcaggcggtactgcgattatcactgccttgggcacaaaagaagtcgatactgcgatccgtcagcaaaatgaaaaagctgggatcaaagatgtgttcaaagcagttgctcaaaatgatcagttgatgtggcttgcccttgcttatatcgcttatgcgattgccaatgtagcaacaactgccgtattattctacttcttcaaatatgtacttggccaaccaactgaattttggatcgttggtctagttgctgccttacttggtttagtagctgttccactattcccaatgcttacacgcgtcatctctcgtcgctacgtttaccttggagggatcgcaatgatgatttcttcttactttttctttacgatcgcaggttcaagtttgccaatcgttatcatcgggctagtattgttctacttccctcaacaattgattttcttatccgctttgatgacgatcacagactctgttgaatatggtcaatggaaaaatggtatccgtaacgaagctgttactctatcaattcgccctttactagataaaatcgctggtgctttgtctaacgggatcgtagggtttgtcgctatcgcttctgggatgactggtaatgctactgctgctgatatcactgctcatggcgtaacgactttcaaagcttatgcattctatgctcctgctgctttgatgattttctccgctattatttttgcttggaagattacattgacagagaaaaaacatgcacaaatcgttgagaaattggaaaacaaattggctccagctgatacaatggaagatgaacttcacgatgcagtagttccttcccattaa

SEQ ID NO: 3525 - DNA (genomic), 297 bp, Enterococcus faecium; double-stranded, circular
  misc_feature (B) LOCATION 1...297
  hypothetical: NO
  anti-sense: NO
acagatatattttttagttgtagatctctttgggctataacaattgcaataatcgttccaactgcggcaattgcaatcaatggtaactcgagatacgccataacaacggccccaaagaaaaaccacacagcaatatttttactccaaagcatccgtaacagcatcgccatcccaactgccggcagcagatttccagcgactgttaatccgttcatgatgacctctggaatattatccaagacgcttttgacaacatctgctccaaataaaacggcaaagaatggaataagagcataa

SEQ ID NO: 3526 - DNA (genomic), 204 bp, Enterococcus faecium; double-stranded, circular
  misc_feature (B) LOCATION 1...204
  hypothetical: NO
  anti-sense: NO
ttatgtatatttttgaaacaaaaatttttcattgcaataattgcaacaaagaaatttcatcgggggaagaggtttggacaaaaatggaaatttccgccaaaagtaactgctcctcaactgaaatcaattaaagaactagaatttgagaatgcactggtaatttgtatgacatgtactgatgaagtatttcgaaaacatttttaa

SEQ ID NO: 3527 - DNA (genomic), 231 bp, Enterococcus faecium; double-stranded, circular
  misc_feature (B) LOCATION 1...231
  hypothetical: NO
  anti-sense: NO
ctgatctcttttctttaccgcataaaaaaatgtcttggtataactgatacccttggcgttagttgggaaaagcagctaacagtccattcggcaatctcacttttcaatcaaaataatcttttaaaactgggaccccccaaacccgttcttttcataggtttaacttttggctccttcccttttggtaaggaattttcccaattagccgcctccaatttgttttccccttaa

SEQ ID NO: 3528 - DNA (genomic), 213 bp, Enterococcus faecium; double-stranded, circular
  misc_feature (B) LOCATION 1...213
  hypothetical: NO
  anti-sense: NO
aaaagcatattaaaaaaagcttctcagatctcatcgttgagttttgacactgtacaacgtaaaaagcagatacctgcttttagctaccttatgaaaagccttatctcgacaattcctgttctacccattggcgtctctcgacgtttttgggcagtagcctatgtttgtataggagcctcacctaacaaatcttattcggttttccttcgttaa

SEQ ID NO: 3529 - DNA (genomic), 279 bp, Enterococcus faecium; double-stranded, circular
  misc_feature (B) LOCATION 1...279
  hypothetical: NO
  anti-sense: NO
ttantaatattgggtattttcaatatatatctagctatgcgcaaatatcctcgtactaaatttcaaaattttcaattgatcttagggagcttggtcattttttttagcttagtcaacagtcctgctttatggatgatggttgtattggccgttttatttatcgggctgaaaggtgtagagatttcaggaatagatttgacaaaaaatgctttttggcgaaaaaaacagatcatgatggtccaaacagagcaattaaaaacacataataatgagcgttaa

SEQ ID NO: 3530 - DNA (genomic), 354 bp, Enterococcus faecium; double-stranded, circular
  misc_feature (B) LOCATION 1...354
  hypothetical: NO
  anti-sense: NO
aataaaatattacacttgagaatagaaggtgacgtaatgcacatccagattccaactgttcttcttgatggtactgtgctagcagcattaagcaacgaagatatgtatgggtatgccttaacaaaaatcgtacaagaaagtctctctgtcagtgaatctacactatatccggttttgagaagattgaaaaaagaaggatatcttgagacctatgatgaaccttttgaaggcagaaaccgtcgatattactcgttgacaccaatgggaagtcgtcatttagaagaaattattgatgaatggattgtttttcgagattctttagaccggttattggaggagagcacaaatgaatga

SEQ ID NO: 3531 - DNA (genomic), 195 bp, Enterococcus faecium; double-stranded, circular
  misc_feature (B) LOCATION 1...195
  hypothetical: NO
  anti-sense: NO
caggaaatatttatgaacggagttgtgacaaaagccttgtcgcagctcctttttctgaataaacggtgtgccagagatagcctatcggcaataaggcacgattttgtaaaatatgggaagcgatttttcaaaatcgcttcttatcgctcaaggctgaacatctctgtcacaacctctccactaaatggtgtttaa

SEQ ID NO: 3532 - DNA (genomic), 486 bp, Enterococcus faecium; double-stranded, circular
  misc_feature (B) LOCATION 1...486
  hypothetical: NO
  anti-sense: NO
aaacgaatattggttaaccaaattagagaactaaaaaggagaaaaaatatggctcagaattactatgacgaatttgtcaaattacctttggataaaatggcacaaaaaatggaggatatgacgttcctatacaatgagacacgtgttccaaaaaaacattataaggaaaaattgtcggtagctgtggaagaaatgattgaatcaggtgtcgaaatgaatctcattgcgacgtactatcgaacactggatgaactgaaaaagcaaaatgcaaaatggtttttccaagccttactatgcttggaagtaggcgtcaaaccaagcacaattaaaccttctgaataccaagctttagaactaacgtatgcgaaatttatcgaaacgaaaaaagctaagactgtttcaagtgaatggttagattattttgaaaatatcaataagtatggcgcatattacaccatgaaaaaggaggacaacgaaaatgagtaa

SEQ ID NO: 3533 - DNA (genomic), 399 bp, Enterococcus faecium; double-stranded, circular
  misc_feature (B) LOCATION 1...399
  hypothetical: NO
  anti-sense: NO
ttgatgatattcactacatcgttacttggaatagcaaatcccattccttctacgcttacattagaagtagattcagaagtacttgcgatcttacttgagttgataccgataacttgtccttcgatattaactaaaggaccaccagaatttccagggttgattgctgcatctgtttggatcgcattgatattgactgtttcgttcgattcattcgtacttgtcacttgtcggttcaaggaagaaatgattcctgaagtgacagaatttgcatattcagatcctagtggggaaccaatcgcaatcgcaggctcaccaaccttcagagcacttgagtcaccaaaagaggcaactgtttcgactttgtctgaattgatcttcaacaccgctaaatctgaataa

SEQ ID NO: 3534 - DNA (genomic), 663 bp, Enterococcus faecium; double-stranded, circular
  misc_feature (B) LOCATION 1...663
  hypothetical: NO
  anti-sense: NO
ttttggatattaggaggagataacatgaaaaaatttagaattttcttatccttaaaaaaagaagaagaatggattaattctatacaagaagaaggttataggttagtttctgttagttcagtggtgcctatatatacttttgaaaaattggctagtaaagaaaagtttattccttatgtgcgccttgattttagagaaaaaagtatgggaaaaataaaatatgaagattatgtaacattgttttctgatagtggttggaaactaataaagggaagtcgttctggtggcgctcagtattttcagcaagaatatcctgatgtaacaagggacatattttctgacactgattctcaagaaagtgtaaagaaaagatatgtaaaatatggttatacttatggaactctatttttattgtatttctttattttttttagtagtaattcttggaatttggataagatattgaactttaaatcatggtattttacccaaggtttatgggaaatggagggtatgtggttttggaaagcgttcatttttgaaactccgtttgttttactccgtgtattaccgttatttttctttctgtttttgggtatctattatcttttacgttcacttataaatgatgattcaacagtgataacaaaatattttgtgtaa

SEQ ID NO: 3535 - DNA (genomic), 2274 bp, Enterococcus faecium; double-stranded, circular
  misc_feature (B) LOCATION 1...2274
  hypothetical: NO
  anti-sense: NO
gctaggatattaatagacagagatgatcaaaaggggaagagaagcatggagaatttctcactaacagaaaaccgaaccttttcacggctagaaaagcaaatgatctggaagaaaccgaaaagccatcggacaagtgcagaagaatggcggatcgcctccgaaatcaaagggaattggcaagatcctgaaatgaaaatcagtaacgtacttttggaaggagatgccgggtcggggaagacacaattagccaaagcactatctgctgatctgcaacttccctatacaaaagtgacctgttttgcagatatggacaaatcagatgttttcggagccttattacctgtagtagattctaataaggaacaagaccaagaattactagaagctatttaccaaacagatacacttgaagctgtactgacactgatccagaaccattacggcattgatcctttttctgctaaagaaaaattagcagagctagttcaaaggatcgaagctgattatccagatgcaatccattacagctattacccttctgaaatcgttcgagcgattgaaaaaggctatttattagagattcaagagccgactgtcatccgagatgcctctgttcttgtggcacttaactcagcgctcgaaccaaatgggatgttgaatttaccgacaggaatcattcgtcgccatccagattgcgtcattgtgatcactacaaatcgaaattaccaaggaaatcgcccattaaatgaatctttaagagatcggatgcaacatgcggaaaaaatggatcttcctgccttagaagtcatggcagaacgtgcgatggcgaaaactatgatccaaaaacaagaacttctcttaaagatggcagagattatccgtttgttggatgaaactgcaaaagctaacgccatcaaaggtgtagcaggaatgcgttcttatttttattgggcaaatacctataagcaaggacaagatttactccagtcgatttatccaaaagttttgtataaattatccactgattcagatgaattggcaattcttgaacaagctttgtctgacagtggattgctactggaacttcaggacatattgagaaaagaaaaatggggtcatcctcaatctgagcatacaaaagaaagaaccattagcgccgaagaagcaaatgaacgaaacatcactgaaaatgctgaagaaattctgcgcttagatgaaaagaaatcgttgtctgctgaagaaccaaatgagggagaagagaaacaagaagaaacaatagaaaaaaacgagattcctcctcaaatgcaaaaagaacgcagtagcgatatcgaaggaaaaaatcaaaaagaacaacaaacaggagatgattctcaagaaatgtctgcttctgacatggaagcacatgataaggaaatcaagaagcaactgaataaagaagcgcgacaaatcatgaaggaaacgattcatgaaaaagaaggtctcatcgttcaccgaccagctttccaaggaaaaacgccggaagcacgtgagctacacatgcaagtaatgccaatagtagaatcacttagccggcaaattttagagttactggataatgaacaaacagagacgtaccaaaaaggaaaatacgaaggtcagcggttcaatgcaagcaaagtagcatatggtgatttgagaaattttgacaaaaagaacccgccacatgagcaaccttctttagcggtagctgtacggatcgatgaatctgggtcaatgatacgggatgatcggatcgaagcggcaaaaaaagcagcgattgccattgccgaattttctaagaaagtcgatatcccattgttgatttacggagatacagcagaccgttcgtcaagagaaaagacttctttgttttcttataaagaatttgaagacggatttcaatggttaaatgaaaaattagtcactatgaaaccaaggcaaaacaatcgtgatggtgctgcacttcgtttagcagcagaaaaattaaacagacaatccgcaacaaccaaactgttgcttaatattagtgacggtcagccaaaagcattgccggattatacaggcaaaaaagcaaaagaagatatccagtctgttttgaaagaatatgaacgtcaaggaatcctatttgtctccgcagctattggccaagacaaagaagaaatcaagtcgatctacggtgaaagtcgttttgtagatattactgacttgaatgaatttcccaagcaaatgattcaactgattgcccgctatctatga

SEQ ID NO: 3536 - DNA (genomic), 252 bp, Enterococcus faecium; double-stranded, circular
  misc_feature (B) LOCATION 1...252
  hypothetical: NO
  anti-sense: NO
ttattagtattgagaaaaaagaaagcacagattactacatttactaatctggaaatagatgaggaggtttttaataagaaaaagatattattattaataatagcaggggctttattaagtgtgttaagcgcttgtggacaagaaaaagaagcggtgacaacaggcacaagtatctttaacgggacctgcaatggtttagttaacagtcggttagattacttattttggctcttcgtcaatgagtgttggtga

SEQ ID NO: 3537 - DNA (genomic), 201 bp, Enterococcus faecium; double-stranded, circular
  misc_feature (B) LOCATION 1...201
  hypothetical: NO
  anti-sense: NO
ccctcagtattagctcaaaatgctgattttacaacttcttccttaaacggtgttctcctgccaactcttcggtcacaagtcacaatattcaacaaacatgagaagctgtttgttgaaattgcaccttgtgactcagaattaaacggcaggctcacaacctcgttgattcgttttatttatttccttgtactcgtacaatga

SEQ ID NO: 3538 - DNA (genomic), 192 bp, Enterococcus faecium; double-stranded, circular
  misc_feature (B) LOCATION 1...192
  hypothetical: NO
  anti-sense: NO
ccctcggtattagctcaaaaaacggcaaaatatgaggaactattttccatttgtttctctaatactcaggacaaaacgctgatttcacaacctccgatatacggtgttccagaagtagcttcttcgaaaaataagctgagatttcacaaaaatttgagaagcaattttcgtaaattccttcttatgtcttga

SEQ ID NO: 3539 - DNA (genomic), 1290 bp, Enterococcus faecium; double-stranded, circular
  misc_feature (B) LOCATION 1...1290
  hypothetical: NO
  anti-sense: NO
ggaagatttttaatgaacgaatttgtacaagtatttcccgaaaattggcagaaaaaatatgaggataaagggtttatctcaccttctcttattcaacgagcagtttttcagccactaagtaataaacaaagtatagtagcggtttctcctacaggttcaggtaaaacactggcttatctttggcctctactactaaacgtggaaccaggtgaagcaagtgcgttggtcatttttgcttcttctcaagaactagctattcaagtagcagatgttgcacgtgaatggggaaaagacaaagagttgaaagtccaatctttggtgggcggagccaacgtcaaacgtcagattgagggtttgaaggaaaaaccagaaatcttgattggtacaccaggaagaatattggaattgatgaaagcaaaaaaaataaaagcacatcaagtgaaaacaatggtatttgatgaagcagaccagctatttgacgctgggaacagccaaatcattgatcaaattcttcatcaagctccaacagagtatcagctagcttttttttcagcgacagcagatcgttcccttgaaagcattgaaaaaatcactgggaaaacgtttgagacaattgacgtgacagcagaggacgattctcgaaaaggactgagacattactttttacgtgtaccgatacgaaagaaagatgactacttgagacgtctcacgcatatagaagattttcatggtctgattttctttaatcaactgactgaattaggcgtaatggaagaaaaattgctgtatagaggtgtaccggtaggaagtctggcctctgatcagaacaagctactccgaaaagcagcgctagaacaattcaaaaagaaaatggtcagagcacttttgaccacagatgtggcggctagaggtttagatattacaggtcttccttatgtagtgaatgcagaagttccgttaagtgaagaagcttatttgcatcgttcgggaagaactggtcgaatgggtaatgaaggaatagtaattacactcgtacaagataataatctaagagatttaaaacggcttttacgtccatcaaatataacacttgaagagatttttttatacggaggtaagctgcaaactgagcagccaaccaaagaagatgcagctcctgcagtaaataaaaagtatgcgaaaactttttctggaaaggagcagaacccagaatataacaaagaaaaaataagaaaaaaagttaaaaataaatcaaaaaaagagagaaataaaggagcaaggcgcaaataa

SEQ ID NO: 3540 - DNA (genomic), 204 bp, Enterococcus faecium; double-stranded, circular
  misc_feature (B) LOCATION 1...204
  hypothetical: NO
  anti-sense: NO
aggagatttttcatgacatcacttaaaactttactttttggaacaactttggctgccggcgctgcattcttcatgggaacgactgctcatgcggacgaagcttataccgttcaatcaggtgatactctatcaacgatttctcaaaaatacgttggtgataactccttgatcaaatgccattgcagaatcaaattcaatttctga

SEQ ID NO: 3541 - DNA (genomic), 234 bp, Enterococcus faecium; double-stranded, circular
  misc_feature (B) LOCATION 1...234
  hypothetical: NO
  anti-sense: NO
caatcatctttttataaatcaacaaaaatatgtacatttaaggcattagattcttttaatgttcgtgttttatcagaaacgaaaatcttataccatcaacaagcgtttacatttatacttaatgatggtatattagaattaactaaaaatttggataatgggttcgaggaggcacttgccgatggaagatgcaataaaacaaggtcagctttttttatcagaattaacagctga

SEQ ID NO: 3542 - DNA (genomic), 327 bp, Enterococcus faecium; double-stranded, circular
  misc_feature (B) LOCATION 1...327
  hypothetical: NO
  anti-sense: NO
tctccatcttttcccccgctccacaccgtacgtgagactttcacctcatacggcgttccatctatttattttctattgaatgttttgcagattacacatctttcgataaaggttgatttttgctatttgctctggcaccagtttcagttcatgcacgtagtgatcgattatcattttatttgttgtatggatcagaagatggatatccttatgaataattctcaagttatcgaatttgtcgtctccaccaagactttttggcaaatagtgatgacagtgaacggcttttgctggcaaaaattgttttgtaatctcacacttgcctga

SEQ ID NO: 3543 - DNA (genomic), 552 bp, Enterococcus faecium; double-stranded, circular
  misc_feature (B) LOCATION 1...552
  hypothetical: NO
  anti-sense: NO
atttcttcattaccagatagtattggttgtgattggaaagattctgttgattctatttgctgtggtgtcgaaaaagtttttgtttgtccttccgtttttggcgcttccttttttgaagattctatatggtttggttttgtcactttcgaagaagttatttcacttgtactacttgaagttgttgaagattcggtacttgaaatcgtactactttcacttgacgaagttgttgaagactcggcatttgaagtcgtactactttcacttgatgaagttgttgaagactcggcatttgaagtcgtactactttcacttgatgaagttgttgaagactcggcatttgaagtcgtactactttcacttgatgaagttgtcaaaagttcactactctctgctgttacatcggaattactcatttcagtcgtctcggttctttcttttgcaattttgtatgttgaattttcgcttgccaacacatggaaaggtgttgctataaggagttgggacattaatataactgctgatgcaagttttaaagattttttcatttga

SEQ ID NO: 3544 - DNA (genomic), 435 bp, Enterococcus faecium; double-stranded, circular
  misc_feature (B) LOCATION 1...435
  hypothetical: NO
  anti-sense: NO
ttcacctcattgattatttttgattatttttttatcttccaaatttactcaacaatcgccatgatatcttttcctgcgacgatcagatattcttttccttcgtattttacttctgtaccggcgtatttttcgaacataacttggtcgcctgcttttacagcggcaggaactttttcaccgttttctaacaaacggccttcaccgactgcaacaactgtcccagtttggggtttctctttagcagcagaagctaaaacgattcctccgacagttttttcttcttcttttgcgacttcgataatgacgcgatcacctaatggttttaacacgataaatccctccgataactctttttttaatctgttagcactcttaaccttcgagtgcgcacgtacatttttaatttactcatgccgccaaccacgagatctgngg

SEQ ID NO: 3545 - DNA (genomic), 375 bp, Enterococcus faecium; double-stranded, circular
  misc_feature (B) LOCATION 1...375
  hypothetical: NO
  anti-sense: NO
ggaggctcattcatggctgtaaaaattcaaacgtcagctggaaccattgaaattaccaatgatgtaattgcaacagttgttggtggcgccgcgacagatgtgttcggtgttgtaggaatggccagcaaaaatcaaattaaagataatattactgagattttgcgtaaagaaaattactcaagaggagtagttgtccgccaagaagataatggtattgctgtagatgtttatacgattatcagctatggtacgaaaatctctgaagtttcccgcaacgtccaagaaaaagtgaaatacaatctagaggcattattaggcgtaactgccaattcagttaatgtctttgtacaaggtgttcgtgtactgccagactag

SEQ ID NO: 3546 - DNA (genomic), 288 bp, Enterococcus faecium; double-stranded, circular
  misc_feature (B) LOCATION 1...288
  hypothetical: NO
  anti-sense: NO
atggcatcatttgctataacgatcaaaatagctagtttaatgctagataagttgacagaaaatggctatcatattccagatgacctatcgatcgtaggaacagacgattcttctttaagccatttagggaataaaaaattgacaacattgacgcatccaaaagaaaagttgggacaagatgccgcacggtggatcgtcacaacgattgaaaaaggacaggcacagccaaatattctctatgaacctgtactagttgaacgggaaacagtgaaagaaaacgaaaaataa

SEQ ID NO: 3547 - DNA (genomic), 1653 bp, Enterococcus faecium; double-stranded, circular
  misc_feature (B) LOCATION 1...1653
  hypothetical: NO
  anti-sense: NO
gaggaatcattcatgcttacagggttaaacttattaaataatccttttctaaataaaggaacagcttttacaaaagaagaacgggcaaaatatggaatcactggtatgcttccaagtactgtccaaacactggaacaacaatctgttcaagcttatggtcaatacttaagcaaacaaacagatttggaaaaacgtatcttcttaatgaatctattcaatacgaatcggacattgttttataaattgatgggcgaacatttagttgaattcatgcctgtcgtttatgatcctgtcgttgcggattcaatcgaacaatacaacgaaattttcttgaaaccgcaagatgctgcatttctttcaatcgacgaaccagaaaacatcaaagcaagtttgaagaacgcggcagatggacgagacattcgtttgattgttgtgactgatgcagaaggaatcttaggtatgggcgactggggtgtgaacggtgttgacatcgctatcggcaaattgatggtctatactgctgctgctggtattaatccagcacaagttttgcctgtatcgatcgacgctggtactaataatgaagaattattgaataatcccttatacttaggcaatcgtcatgctcgtgtagaaggcgaaacttactatgaattcatcgatcaattcgttcaatcagctaccgaattattcccagaattgttattgcattgggaagattttggacgaggaaatgctgcagcgatcttagaaaaatacgaagatcaaatcactactttcaacgacgatatccaaggtacaggaattgttgtcctagcaggtgtattaggcggattgaatatatccggtgaacaattgaaagatcaaataattttgacatttggtgctggtactgctggtgtgggtatcgcaaacatccttttagatgagatgatccgtcaaggtgtacctgaagaagaagcacgccaacatttctatcaagtagataaacaaggtttattgtttgaagatacagaaggattgactcctggtcaaatcccattcgctcgcaaacgctcagatttcactaatgctgatgaattgacaaacttagaagcagttgtaaaagcgatccatccgacaatcatgattggtacttctacccaacctggagcattcactgaagaaatcgtgaaagaaatggctgctcatacaccacgtccgatcatcatgcctttgtctaatccaacaaaattggcagaagcaaaagcaaaagatttaatagaatggacggacggaaaagcattagttggaacaggtatccctgctgctgatgttgaatataatggtgtaacttaccaaatcggtcaagcaaataatgctttgatgtacccaggtttaggacttggtttgattgcttcaacagctacacgagtaaatgctgaaatcatttctcaagctagtcgagcattaggcggaatcgttgatgtaacaaaaccaggagcagctatcttgcctccagtagcaaaaatcactgaattttctcaaacgattgctgaaactgtcgcaaaatcagttgtcgcacaaaacttgaatcgtgaagaaatcacggatatcaaagaagcagttgaatctgctaaatgggttcctgaatataaatctttagaagattaa

SEQ ID NO: 3548 - DNA (genomic), 369 bp, Enterococcus faecium; double-stranded, circular
  misc_feature (B) LOCATION 1...369
  hypothetical: NO
  anti-sense: NO
gaaagatcattatggaagctgttcctcaggcaaaacatgattttttgccgcgcaaacaagctaaaccaaagaaaaaagggaagccttggtgtcgagcatgcaagcgatgctgttattttagaagcattgaaaaaggtcgtgacgccagacatttcccaaacggctgtttctgaaatcattagacaagaccttttagattatggtttaatagctggggcacaagcaacagaaaaacgagaaaaactaggtgacgagttgcgcatcggttacacgaacggcaaacaattggaaaaacgtttgaagatgtttcgtattacgccgaaagaactcgcccaagcaatgaaaatagtggaggaacaacatgagtga

SEQ ID NO: 3549 - DNA (genomic), 285 bp, Enterococcus faecium; double-stranded, circular
  misc_feature (B) LOCATION 1...285
  hypothetical: NO
  anti-sense: NO
atttcaccattaaaaatttcctcctttttttcttttatcataccattttcaatgttttttttcatcaataaccgaaaatttgttcgtattatgcaaagaaattacgataaatggccgacttcaaaaaataagtttattcgaaaaaaagattgtgacatgatttttgtcacaatcctaaatatctatgttatattcgcttcgtttgacactgaagaagtactatttgtactggaatttatgctccatttttccgtatttagaattctatgttctatactaccttaa

SEQ ID NO: 3550 - DNA (genomic), 270 bp, Enterococcus faecium; double-stranded, circular
  misc_feature (B) LOCATION 1...270
  hypothetical: NO
  anti-sense: NO
gtctcaccatttcatacaataccagaaaaccatttggttaacttactgttgatattatcgcaacaaatgttgccggttactcccgtaaggagatattcaactgtactcatatcataccttattaacctacataaagcaactactttagcccgatttacctacattttcatgacaggagtgaaaagtatattcaccttggtaggcttctctcttctatcatgctatactaatgttattgtatgtaaggaggcacatttttgtggtatctag

SEQ ID NO: 3551 - DNA (genomic), 186 bp, Enterococcus faecium; double-stranded, circular
  misc_feature (B) LOCATION 1...186
  hypothetical: NO
  anti-sense: NO
tggaagccattaaaaccaatcctttcgtatttcattcctaataataagaatattttaggggaggtatgttatttgaacgaatatttagaaaatcgtcgtattagcagagtttttatacgaacttatgttcttttacgtttaaaaagaaaagcccgaaggccagtctttattgtaaatttaagttaa

SEQ ID NO: 3552 - DNA (genomic), 273 bp, Enterococcus faecium; double-stranded, circular
  misc_feature (B) LOCATION 1...273
  hypothetical: NO
  anti-sense: NO
ctttctacatttttgcataaatttggcttaataccgagaaactggcttttgaacaccgtttacccagaggtcgtaagcctgccgtttcactccgagtcacaaggaacaatttcaaaaagcagcttctcatgtttgttgaatattgtgacttgtgaccgaggagttggcaggagaataccattcactggagagtttgtcacttgtcacaacttttttagttctacaaaaattgaaagcgttttgttggtgcgaacttcttgttgcagtgtatga

SEQ ID NO: 3553 - DNA (genomic), 219 bp, Enterococcus faecium; double-stranded, circular
  misc_feature (B) LOCATION 1...219
  hypothetical: NO
  anti-sense: NO
gccgatacatttcttgattgtgaggcgagaacaattattcgtcttttaagaaaaaaagtagtagaatcagttcatattaaaaataaaaaaccttccatttttgtaggtttaaaggaggtcattaccttgaaaaaaatcggctttttaagcctttggacattggatggagcaaggatcgcttgtgaaatcagctcaagatgcttatttgcaatcgattga

SEQ ID NO: 3554 - DNA (genomic), 444 bp, Enterococcus faecium; double-stranded, circular
  misc_feature (B) LOCATION 1...444
  hypothetical: NO
  anti-sense: NO
atggatacatttagaaaagcagggggttcagaaatgaaaagaaaatgggaactattgctaggaatggtcggtggcagtctatctttgattttctttggcgggttagcagttactttaagtaatatgtctgcgtcagagtttaaaaaaagttatcagtcgcttgctgtagatcattcaactttgtctttagaaaatacatttggattattacaggacatgactggtctgtttgccgttgtgttgtttatttcacttgcttttttagcagtagcattgtttttgactgctaaaggaaaatacttaacaactgccactggtttgtattttataacaggattcatattgttgattggcactcagtttattgcgtttccttttgcatttttttatttcgcagctggggcattcagtttatatcgagtaagaatgagaaaaggagcctga

SEQ ID NO: 3555 - DNA (genomic), 228 bp, Enterococcus faecium; double-stranded, circular
  misc_feature (B) LOCATION 1...228
  hypothetical: NO
  anti-sense: NO
tcctgtacattacgggttgttttcaatcatgaatctgtgtgtaggctccatcacgccgccagtaggtacaggactatatgtcggtgcaagtgtaggaggcgtaaaagcagaggcaatgctgaaaccgcttcttcctttttatggggttatcttagtcgtcttgtttttgattacttacttcccgcaaatcgtcatgtggctacccaatatgctgagttaggagaatag

SEQ ID NO: 3556 - DNA (genomic), 378 bp, Enterococcus faecium; double-stranded, circular
  misc_feature (B) LOCATION 1...378
  hypothetical: NO
  anti-sense: NO
cgaaacacattaagaatagaagcaaagcaaaagacggaagaacttttactaccttctaagtttttttcatatttgtttgctatacttagatctaaggaattagactttcgctgcccattatttaagtttgaggtagcgtcttgcgagggatcaataatggaagaagaaaaaatatttgaaaaacgctgggaattggcttcagttgaacaaagagcaaggtaccataatctaatgtcctcttaccgtaatattgattggacttacaaagaaaagaagtacttgctttggttatgtcagttagatgtaaatacctttgaaacatttgaagtgattctagataagattaaaaacagcaatgaaaaaagagctgatctataa

SEQ ID NO: 3557 - DNA (genomic), 2223 bp, Enterococcus faecium; double-stranded, circular
  misc_feature (B) LOCATION 1...2223
  hypothetical: NO
  anti-sense: NO
atgaaaacattgaaagaaccgacagctgaagagatcaagaaaaaaagaatctatgccgaatggggattgactgatgaagaatatcgaatgatcgaagaagatatcttaggaagaatgcctaattatacggaaactggactgttttctgttatgtggagcgaacattgttcctataaaaattctaaaccggttctacgcaaatttcctactagtggacctcatgtgttgcaaggccctggagaaggcgcaggcatcgtcgacatcggtgatggactagcagttgtcttcaaagcagaaagtcacaatcatccttcagccgtggagccttatgaaggagctgcgacaggagttggcggaatcatcagagatattttcagcatgggggctcgtccaattgcgttgctagattcattgaggttcggcgaattagataatccaagaacgaaatatttactagaagaagtagttgcaggtatcggcggatacggcaattgtatcggcataccgactgtaggcggcgaaattgcatttgatccttgttatgaaggaaacccattagtcaatgcaatgtgcgtaggtttgattgaacacaaacatatccagaaagggcaagccgctggcgtcggtaattcgatcatgtatgtaggtgcaaaaacaggtcgcgacggtatccacggagcaacttttgcctcagaagaatttaatcaagaagaagaacagcaacgttctgctgtacaagtaggcgatccttttatggaaaagctgctgcttgaagcgtgtttggaattaatcttgcatcattcggattctctaataggtatacaggatatgggagcagcaggacttgtttcatctagtgcggaaatggcttcaaaagctggctcaggacttatattgacattagatgaagtcccacaaagagaaactgggatgacaccttatgaaatgatgttatcggaatcacaagaacggatgttgatttgtgttaaatcaggagaggaagaaaaaatccaagaactatttcagaagtatgatctagatgcagtcactatcggtaaagtaacagacgacgggcaatatcggctatatcatcaaggagaagaagtagcaaatctgccagtcgatgcattagctgaagatgcaccagtttatcataaagaaatgaaagaaccagctcgaatcgtagaatttcagcagttagctccttatcagccagttatcgaagaacctggacaagtattgcttgatctgctgcagcaaccgacgattgcttcaaaacgttcaatctacgaaacttatgattcacaagtacaaaccaatacagttgtccgtccaggaagcgatgctgctgtgatgagggttagagggacgaataaagcgttagctatgaccacagactgcaacgcgcgctatctgtatttggatccaaaaatcggaggacaaatagcagtggcagaagctgctagaaatattattgctagcggtggtaagcccttggcgatcaccgactgcctgaactatggttctcctgataaaccagaagttttttgggaattatcgacttcagctgacggaattgctgctgcgtgtgaaacgttaggaactcctgttatttcaggaaatgtctctttatataatgaaacggatggtcaagcaatctatccaacaccaatgattggtatggtcggattgattgaggatcataaacatatcactactcaggaattcaaaaaatcaggggatctaatctatatattaggtaagacgtttgcagattttgatggcagtgaattacaaaagatgcagcttggaagaatcgaaggtgtgatccgaaactttgatctatccattgaaaagagaaaccaagagttagtattgacagccatccaaaacggattgattgaaagtgctcatgactgttcagaaggtggcttggcaattgcactggcagaatcagctttcaaacatcagctagggatatctgtacagtttgaattgtcctctgctcaattatttgcagaaactcaatcaagatttgtgttgacagtcgcaccggaaaataagacacgattcgaagaaatgatgggagatgctgctgttttagcaggtaaggtgacggatgaagcgataatcgaaatttcagcaactgacggtcagatcaaaatagaaactgcagtagcaagaaagtgctgggaggatgcaatcgtatgtcttatgaagtga

SEQ ID NO: 3558 - DNA (genomic), 1461 bp, Enterococcus faecium; double-stranded, circular
  misc_feature (B) LOCATION 1...1461
  hypothetical: NO
  anti-sense: NO
ttccgaacattttattttcaattattgttaaaagaaataactttttctgtattttttctgcaatttatcgagaagtcactttactttgcctcttattctttcttcgttacaataaggaatgggacaagtaaaaaaatgaaaaagcaagggacgaggtatatggaaaaaaagcaaaaaattattttaggagccacttctgctttaactatcgttattttaattctaagtttgttttttgtcatccgatcatctacaaaaaaagaaccaatcattcctgaaaaaaaaataacagaaaaagcaaaagaaccgacagatgataagcaacaactagttactcaagcaaaaaatctggctcaaagctacgattatgaccaagcgattgcgttattggaaaaagatagtaagaacggatctactgaaacacaacagcttcttcaaacactaaaaaaggagaaagaacaactgatcgactggtctgatcctactcagatctctcatgtctttttccacagcttgatcgtggacccgcaaaaagccttccactctcaacaggcacaaggatacaaagattatatggtgactgttgaagaattcaaccgttcgatcgaacaactttatcaaaatgattttgttttagttaatttgaatgatttgatccaaaaagacgaacaaggaaatctttcctttaacgggcttgcgctacctgaaggaaaaaaaccattggttctttcacaagatgatgtcagctattatgaatatatggataattccggttttcctagccgattggtcgtatcaaataacaatgaaatcaaaaatgtctataaagagaaagataaagaagaaatcggtgactttgacatggttcctctgatcgatgcctttgtcaagaaacatcctgatttttcttatcgaggcgcaaaaggtaccttggccctgacaggttacaacggagttttaggttatcgaacatcaaaatctcaatatggagacaatgaaaaaacaaaaaaagagattaaagaagctaaaaaagtggcggaacagttgaagaaagacggctggagctttgcttcccatacatggggtcacttgaatatgactcaagcttcactagaagatgtaaaaaaagacaatgaattgtggcagcaagaagttgcacctatcctaggaaaaacaaatattctgatttatccatttggtgcagacatcagcgactggcagccttattcagcagaaaatcaaaaatttgcttacttgaagagtcaaggtttcgatattttctgtaatgtcgatgcttctacaccagcttggggacaattaggtacggatttctatcgaaatgctcggatcaatatcgatggcattcgttttcaatctgatttagacggaaaaaatcctattcttgatccattcatcaatgtccatgatgtctatgacaaagaagcacgcgaatctgcttga

SEQ ID NO: 3559 - DNA (genomic), 834 bp, Enterococcus faecium; double-stranded, circular
  misc_feature (B) LOCATION 1...834
  hypothetical: NO
  anti-sense: NO
gagagaacattggaaaataaaaatgtaagtatgctgctttctttatatgataaagaaaagccagagtatttaaaggaagcattaactagtatttttgagcaaacagtaatgccaaaagaaattgtattagtttatgacggccctataaatgaaaaacttcaagtagttgtcacttatttccaacaaaaagatcctcacttgtttacagttgtaaaattagaaaaaaatcaaggattggggattgctttagcaattggattagaacatacgaaaaatcgcttagtagccagaatggatacagatgatataatggaaccccaacgattagaaaaacaattagagatcttccaaaaagatccagaaatagcgattgttgggagtaatattgaggaatttactggcacgcttagcaatgttatcggaaaaagaattgtacctgaatataacaatgcaattcgtgtattttctaaaagaagaaatccctttaatcatatgaccgttatgtttgataaaaaagctattttggaagtgggaaattaccaaccattaagtgggtttgaagattattatctttgggcaagattattaaaggcaggttataaaggatataatattcaagaaacattagtctatgcgcgaactggcaaagatatgtatgcaagaagaggcggaatgaaatatcttggttctggtcttatgggtcgttatcgtatctggaaagacggtttagggtcagtaaaagattttataattgtttcttgcggacatatttttattagcttactaccaaatcaattaagaggaaaattttatcaaacgcaattaagaaaatag

SEQ ID NO: 3560 - DNA (genomic), 672 bp, Enterococcus faecium; double-stranded, circular
  misc_feature (B) LOCATION 1...672
  hypothetical: NO
  anti-sense: NO
atgatgacattcggtttagtctatatttgccaaaagatacctctgatgcttcaaacaactcaaataccaacaaaactagcaccagcagtactgaaagcaagacaaaagaaaataaaaaatcatcggatgagtagtattagagggggaatcataatggaacgagcaatatttgcaggaggctgcttctggtgtatgatccagcctttcgacacgcttcctggtatccatacagtgatgtcaggatatactggagggcatgtaccagatccgacttatgaacaagtaaaaagccaaacgactggacatacagaagcagtggagattatctatgatccaacattgatttcatatgaacaattagtagaactttactggcagcaaactgatccaactgacgctttcggacaattcgaggatcgcggtgacaattatcgcccggtgatcttttatttgacagaagaacagcggatcattgctgaaaaaagtaagaaacagttagctgaaagtggacgtttcgaacagccaatcgttacaaaaatcgaaccagcccaaccattttatctagcagaagaagaccatcaagagtattataaaaagcatcctgaaaattttaaaagaaaccatgcacgccgggctgcctttatcgaagaaaattggaggaacgaagggtga

SEQ ID NO: 3561 - DNA (genomic), 693 bp, Enterococcus faecium; double-stranded, circular
  misc_feature (B) LOCATION 1...693
  hypothetical: NO
  anti-sense: NO
gctttcatgntagggctatcgctcatatcnaacnaaantggggatggtgcggtatttgtcagaaactatatcgagagtcatggcggaattgctgcgcaaattggctttgaagggtatgaatatgcgacttgtatcagtataaatgatgaaatttgtcatggattccctcgtaaaaagcctttgaaaaacggtgatttggtaaaagtcgatatgtgtatcgatttgaaaggcggcatttctgattcttgttgggcctatgtagttggagaatctacacctgagatcgaccgattgatggaagtaacgaagaaagctttgtacatcggtattgagcaagcacaagtagggaatcggattggtgacatcggtcatgctatccaaacttatgtagaaggcgaaaatctagcgatcgttcgtgattttattggtcatggcgttggtcctacgattcatgaagaaccagcagttcctcattacggagaagctggaaaagggttgcggttgaaagaaggcatggttatcacgatcgaacctatggttaataccggaacttggaaaatgaaaatggatcctaacggctggactgcgtatacaagagacggcggactttcttgccaatatgaacatacattggctattactaaagatggtccaagaattttgacatcacaaggagaagaaggcacttattga

SEQ ID NO: 3562 - DNA (genomic), 945 bp, Enterococcus faecium; double-stranded, circular
  misc_feature (B) LOCATION 1...945
  hypothetical: NO
  anti-sense: NO
aacacttttttcaggcatttttgccagaaacggaggtatgatttgaaaattggactgattgatgtggattcccacaactggccgaacctgtgcctgatgaagctgtccgcataccataaggcgcggggcggcctggttgagtggtggaatcccaaaaaccactacgactttgtttataaaagccgggtattcacagatacctactcgaaagatacgattgccgttaccaatgccgatgccgtcattttaggcggcacgggctacgaccttggggaaaacttaccggatgcggtggaacacacccgcccggacgctgcactgtatccgcagttttctgataccgcttacggctttttgagccgtggctgtccgcgaaactgcggattctgtattgtcagcggcaaggagggacggcgaagccgaaaggtggccgacctttccgagttttgggacgggcagaaagaaatcaagctgctggacgcaaatctcctcgcctgccctgaccatgaagcgctgattttgcagcttgccgaaagccgcgcatgggtggacttctcccaggggcttgacatccgcctgattacgccggacaatgtggcgctcctaaaccgggtacgcaccagggcggtgcattttgcctggaacaatccagacgaggacttgaccgggtatttccggcgctttctggaactgaccgccattaagagcgaccgaaagcggcgcgtctacgtcctgaccaattacggcagcacccatgagcaggacttgtaccgggtggaaaccctgcgcggcatgggatatgacccctatgtgatggtctacgaccgcccggccgcaccgaaaatcacccgccagcttcagcgctgggtgaataataagcggattttttacacggtcaaaaactttgccgattacattccaaacagaacaggagggataacgtga

SEQ ID NO: 3563 - DNA (genomic), 1179 bp, Enterococcus faecium; double-stranded, circular
  misc_feature (B) LOCATION 1...1179
  hypothetical: NO
  anti-sense: NO
aagatggcattttttaaagcgagacaaaatacaacgggagatcctttcctacaacatgtggtatcaatccaatcggatgattacaccaccagctttacaagcgttcgtgcattaagaaatagtgatgtgtttgcagccgttcgaattattgctagtgatattgcttcaagtccgattcaattggtcaaaaacaatatgccacaagctgataatgaactggtgaagttactaaacgagaaacctaattcagaaatggatggttggcatttaaagtttgctttggcggtcaatatgttgctaaacggtaatagctttgcagagattaaacgcaacggtgaaaaggtagaagaaattcacttattacctaactcaagtgtaacggttactcaattagataatggtacgttgtcttatcagattggtgataaaaaaagacgtgtgaagtctagcgatattttgcacttcaaatatttcacccaagatggtttaacaggattaccaccactttatgcgttacgtgatgaactgaaaattcaacaagctggcaaccgcacattgcacaatttctttactcgtggtgtcagtgggtcaggtattttgaaggttcataagtcagatttagacggatcagcaaagaacgcaattcgtgaaaagtttgaagaagccaacggttcaagtagtggagataatgctcttagaacgatcattcttgatgaaacaatggactacaaaacattagaaataaacaccgatgttttgaagcttatcaattccaatgattggaacacaaaacaaattgccaaggcgtttggtgtaccgattgagcgtttaggcgttgaaaatgaacattctagcaccgttcaaagtaatctccagtatatccaaagtacgctgattcattactttaatgtgtttgtgagtgaattagatacgaaacttgaaaccaatatccgctttaattccgatcagttactagagactgatcctgaaacaaaagtaaaaaatgtattggatcaggtcaaagggtcacttctcacgattaatgaggggcggtcgaaaatggggctaccccccatggatggtggcgatcgtttactagcaagtttgaactttacgtatttagatacgttggagaaatatcaattaaaagaacaggaaggagttacaccagttgaataa

SEQ ID NO: 3564 - DNA (genomic), 219 bp, Enterococcus faecium; double-stranded, circular
  misc_feature (B) LOCATION 1...219
  hypothetical: NO
  anti-sense: NO
ggtcnntcttttttttcccagaaacagggacttangggggccnnnagattaatatanaaaattggggggggggggagaaaatttttgtgggagaaagagggggagaaaaaccccccccccgggggggggttaaaaaaaaaaaaaaaaatcctctttgtggggcgcacccgaaatcatcccccgggtatgagcaccccgcccccgaaagaaaaattttaa

SEQ ID NO: 3565 - DNA (genomic), 813 bp, Enterococcus faecium; double-stranded, circular
  misc_feature (B) LOCATION 1...813
  hypothetical: NO
  anti-sense: NO
aggattcctttctttagtctagagaaattcagtggtaaaataaataagtgtgagaaaacgcattcgatgcatagatatagcgagaaatatcgtgaaaatggaggaatcagagtgaagtatgtcgaagtaaaaaatgaatacaaacgatacaaaatgggagaaacgaccattacagcaaatgacgatatttctttttcaattgaaaaaggcgaattagtgattatacttggtccaagtggagcaggaaagtcaacgattcttaatattttaggtgggatggatacacctgatgaaggtcagatcattattgatgacacagatattgcgcaattttcagataaacagcttactgcttaccgacgaacagatgtagggttcgttttccaattctacaatctcgttcctaatctaacagcaaaagaaaatgtggaattggcaacggaagtttctcctgatgcgcttgatcctgtagaggtattgaggcaagtgggcctagctcatcgattgaataactttccgtcccaattatcaggaggcgaacagcagagggtttcaattgctcgtgcactagctaaaaatcccaaacttcttttatgtgatgaaccgacaggcgcgctggattttgaaacgggcaagcaagtattgaaattattgcaaaacgctagcagacaacacggcaataccgttttgatcattacacataattctgctttagcgcccatcgctgatagagtcattcacattaatgatgctaaagtaaggtctgttgaattaaatgatcatccttcatccattgatgagattgtatggtag

SEQ ID NO: 3566 - DNA (genomic), 792 bp, Enterococcus faecium; double-stranded, circular
  misc_feature (B) LOCATION 1...792
  hypothetical: NO
  anti-sense: NO
tcgttgtttttcagtaaaaacaattgcccaatgactgatataatcgttatactttacacagtaggtgattatgtgaaaaaagaaaagaaatatgcaaaaatgccagatgggagcgaaatttactatgaaaagagcggtcaaggcttccctctctttttactgcatggcaatgacggcagcggccgctttttttcagaacaggtccctgtactcgaacgctactataccgtgtatctagtagatagccgaggacatggtcgttcgacaaacgaagcatctatgttgaattttcagttaatggccgaggatctgaatacgatcatgttgctggaaaaaatcgatcaggcagattttcttggatttagtgatggagcaaatctagcactggtatttgccagcagcttccctaaaaaagttcatcgattgattttaaattctggaaacacgcttgttaaaggcgttcgtttttctgccagagtcatcagtaatattcattatgcatgggtatggttactctctttatttcgcccaagtcttcgcaaaaatcttttagttatcaaacttttgctgcatgacatcgggcttacagaaaatgatttaaaaaaaatcaactcccccactttgatcatcgtgggaaaaaaagatgtaatcaagctaaaacattctttgtatatagctaaaactataccaaaagcttcctttgtgcttgtgaaagaacaaggacatgaattagctagaaaagatcctgaacgcttcaatcgagaagttcttcaatttctttctgaaacataa

SEQ ID NO: 3567 - DNA (genomic), 1173 bp, Enterococcus faecium; double-stranded, circular
  misc_feature (B) LOCATION 1...1173
  hypothetical: NO
  anti-sense: NO
aatcatcaatttaacgaaacagttaaaacaagccaaatagctactcaaggggggccttcttttatggcaaatggaacagataaaaaaacgtatgaagcagcagtagcagctttcatcaaagaaaacaaacccaaacgacaagttgtatatgatgatttatccaatcagcttgctacaccattcactttgaatgcagatgaaatggacaaattgatccaaaagattgaagacgcaggtatcagtgtggtggatgaaaatggtgatccatcaattcacagcttgaagagtgctgagaaaaaagctgaacaagcaaaaacagaagatctttctgcgccaaccggtgtaaaaatcaatgacccggttcgtatgtatctgaaagaaattggccgtgtctcccttttaactgcggaagaagaagtagcgttagcattgaaaatcgaagaaggcgaccaagaagcgaaacagcgtctggcagaagcaaaccttcgtttagtagtaagtatcgctaaacgttatgtaggacgaggcatgcagttccttgacttgatccaagaaggaaacatgggactgatgaaggcagttgaaaaatttgactaccgcaaaggatttaagttttcaacctatgctacatggtggattcgtcaagccatcactcgagcaatcgctgaccaagcacgtacgatccgtattccagttcatatggttgaaacaattaataaattgatacgtatccaacgtcaattgctgcaagaccttggaagagaacctacgccagaagaaatcggtgcggaaatggatcttccaacagaaaaagtccgagaaatcttgaaaatcgcgcaagaacctgtttcccttgaaacgccaatcggtgaagaagatgactctcacttaggtgatttcatagaagaccaggaagcaacaagtccagcagaacacgcagcttatgagttattaaaagaacaattggaagatgtactagatacattgactgatcgggaagagaatgtccttcgcttacgttttggtttagatgatggccggacgagaacattggaagaagtagggaaagtatttggtgttactcgggaacgtattcgtcagatcgaggctaaagcattaagaaaattgcgccatccttctcgttcaaaacaattaaaagatttcttagaataa

SEQ ID NO: 3568 - DNA (genomic), 315 bp, Enterococcus faecium; double-stranded, circular
  misc_feature (B) LOCATION 1...315
  hypothetical: NO
  anti-sense: NO
caaaaccaattatttgtcccctttaaatcccatatgctaaaattgattagcaaagaaggaggttatattatgagttggttatggacattgattgttggagccgtgatcggagcaattgcaggtgcgatcaccagtaaaggaaattcgatgggctgtgtaacgaatatcattgctggactagtcggttcaagtattggacaagcgattttcggcgaatggggaccaaaagctgcaggtatggcacttattccatctattttaggcgcagtgattttggtagcagttgtctcatttttctttggaaaacgatcataa

SEQ ID NO: 3569 - DNA (genomic), 423 bp, Enterococcus faecium; double-stranded, circular
  misc_feature (B) LOCATION 1...423
  hypothetical: NO
  anti-sense: NO
cccagtcctttagttcattggattaactcgaaaggagtggtggaaatgaaaaaaagttaccctgtaattttttctgctgaagaaaatggctactcagtagtttttcctgattttgctggagcaacacaaggagataattttgaagaagctatgtccaatgctaaagaatttcttgatgggattctagcttactatattgatgaagatatttcagttccttctccaacagatattcatcaactaaataatttgggcaataacaaaattgtttctcttattcaaagtgatccttctccatttatccaaaaaaagaccgtacgcaaaaacgtcacagtcccagaatggttagtagctagaggggaaaaagataaaataaatttttctaaagttttgacagatgcgttactaaaaatatacgagtaa

SEQ ID NO: 3570 - DNA (genomic), 1005 bp, Enterococcus faecium; double-stranded, circular
  misc_feature (B) LOCATION 1...1005
  hypothetical: NO
  anti-sense: NO
aggcgacaattcttcagcagaataattttgaatgatggagctgtttcaaaggctgggcgacaagcctcactctcctttgaagcagctttttttaaaaagaaaaacacacaggaggagttaaacatggcagacgttacagctaaaatggtaaaagaactacgcgaaatgactggcgtaggaatgatggatgcgaaaaaagcattagttgaagtagaaggcgacatggaaaaagcagttgatcttttacgtgaaaaaggaatggcaaaggctgcgaagaaaaatgaccgcattgcagctgaaggattggcttcagttgctgtgaaaggtaacactgcagcaatcgttgaagtaaactcagaaacagactttgtttctaaaaacgaaatgttccaagatttagtaaaagaaattgcagaacttgttgctgaaaacaaaccagcagacatggaagctgcaatgaaaatcaaaacagataaaggtacaattgaatctgacttgatcgaagcaactcaagttatcggagaaaaaatcagcttccgtcgctttgaagttgtagaaaaagacgacaatgctgcatttggtggatacttgcatatgggcggacgtattgccgtattgactgttctagatggaacaactgacgaaacagttgcaagagacgtagctatgcacgtagcagctatcaatcctcgttatgtaaacgaatcacaaattccagaagctgaattagaacatgaaaaaactgttcttacagaacaagcattgaacgaaggcaaaccagcgaatatcgttgaaaaaatggtagaaggacgcttgaagaaattcaaagcagaaatcgctttggtggaccaaccattcgttaaagatcctgatatgactgttgaaaaatacgttgcatcaaaaggcgcaactgttaaaacattcgtacgtttcgaagttggcgaaggtatcgaaaaacgcgaagataactttgtagaagaagttatgagccaagtgaaaaaataa

SEQ ID NO: 3571 - DNA (genomic), 552 bp, Enterococcus faecium; double-stranded, circular
  misc_feature (B) LOCATION 1...552
  hypothetical: NO
  anti-sense: NO
aggagacaattaggaatttatggaggtaatataatgagaacatataaaaataaagaagaattaaaaaaagaaataaataggacttatactaaatatattttagaatttgaaactattcctgaagaattgaaggataaaagagttgaggaagtggatagaacacctgctgaaaatttagcatatcaagttggttggacgaatttaattctaaaatgggaaaatgatgaaagaaatggattatctgttaaaacgccttctgatcaatttaaatggaatcagttaggagagttatataagtggtttacaaatacctatgcacatctaccattgaaagaattagaggaaattctcaatcgtaatattgatgatattaacatgatgattgattcaatgagtgatgaagatctattcactgcacacaaaagaaaatgggcagacgaggcaaccaaaacggctgtatgggaagtatataaatttattcatgtaaatacagttgctccatttgggacttttagaacaaagataagaaaatggaagagattagctttgtaa

SEQ ID NO: 3572 - DNA (genomic), 876 bp, Enterococcus faecium; double-stranded, circular
  misc_feature (B) LOCATION 1...876
  hypothetical: NO
  anti-sense: NO
caggtgcaattatttatggaaaagcctcaggcgaaaaagaaagtacttcgacgaaccagacaaaaaaaacaacgagtttgttggggtattgcaatacgtgacgatccggcattagatgagatttatcgaggaatcaaagatggtctgaaagaagaaggattaaaagaaggagaaaatcttgagatcaaatttcaaaatggacaagccgatcagagcaagctagccacaatgagtcaacagctagtacaatctgatccagatgccttgattggaatcgcaacacctgccgctcaatcattagcaaacacgacttcatcgatcccagttgtgttaggtgctgtaacggatcctgtgggggctggattagtcgcttctttagagaaacctggtggtaatgtaacaggtgtttctgatcagccgcctgttacttcacaaatcaagcttgcttctgatttgttgccaaatgcaaaaaaagtcggaatcttgtatgcttcttcagaggataattcaaaataccaagtagcacaagcagaagaagctgcaaaaaaagaagggttagaatcagtaaaatatgcggtgccttccactaatgagattgcacaaacggttcaagtgatgagccgacaagtcgattttatttatgttccattagataataccattgccaatgcgatgcaaacagtggtaaaagaagcaaacaaagcaaatatccccgtcattccatctgtggatacaatggtggaacaaggtggactagcaacaatcgggatcaatcaatatcaattagggcttcaaagcggtaagatggcggcagaacttgcgagtggaaaagaaaaaccggaaacgacgcctgtttatacatttgatcaaggggat

SEQ ID NO: 3573 - DNA (genomic), 360 bp, Enterococcus faecium; double-stranded, circular
  misc_feature (B) LOCATION 1...360
  hypothetical: NO
  anti-sense: NO
agacagcaattatttggtaaccaacgtattggaaacgacgtctatgaatgggatgatatcaacattgccatcatttctggtgatactatcatcgatttgggcaatacacttttgccaaaagatgataatattgtgattgtaagaaaagggataggcagaacacggatcttagtacccctgggagtggctattcgtttagagcatgcgacattagtaggaaatgtcttgtttgaagaagagcagttttccttaaaaaacgaacagatcaaaatctgcagcagtgattatgatgaaaatcctcgcagattgaagatcattaccaatactttggttggagatgtcgaggtgatacgaatatga

SEQ ID NO: 3574 - DNA (genomic), 339 bp, Enterococcus faecium; double-stranded, circular
  misc_feature (B) LOCATION 1...339
  hypothetical: NO
  anti-sense: NO
gtggagcaattccagggaagtgctaaaatgaaaaaaaatgctaagcaaattgttcatgaattatataatgatatatctataagtaaagatcctaaatattctgatattcttgaggttttacaaaaggtatatttaaaattagaaaaacaaaaatatgaattagatcccagtcctttaataaatagattggtgaattatctatattttactgcttatactaataaaataagattcactgaatatcaagaggaattaataagaaatttgagtgaaattggaagaactgctggaataaatggtttatatcgagcagattatggagataaatctcaattttaa

SEQ ID NO: 3575 - DNA (genomic), 594 bp, Enterococcus faecium; double-stranded, circular
  misc_feature (B) LOCATION 1...594
  hypothetical: NO
  anti-sense: NO
aaaaggcaattgactaaggtttaccaagtacagaagatagtaggtaacgaaggtattttatttatgctcgaatacatcaaaaagggaacagggaaacaggataaatgtgttccatgttccctttttgattgttcttattactgggtgcagaacagctttttcacattttttattctcggtgtttcagaagtagcctcttcgaaaaataagccgaattttcacaaaaatttgagaaacaatttatgtaaaaccccttcttatttcttgaagctgattctttctgtcacaacctttttctactttttcctcttcttatacatttggatcaatgcatcgattgccaaaaaaataatgacgaatgcggcaatagcatacgtaaatatccctaataaggaaacgacctctgcgttttctacaggtgctgcttggacaagcagggaggaccctacgatcaatgcagctaaaatcataccgaaaacaagccgattgatcatactttcgatcctgctcaataatttgtcttgctttttcaattccaaattgacttttccttgtcccgaagtccacatttctaatagatggtggagctgttga

SEQ ID NO: 3576 - DNA (genomic), 501 bp, Enterococcus faecium; double-stranded, circular
  misc_feature (B) LOCATION 1...501
  hypothetical: NO
  anti-sense: NO
aacaataaattaacaaacttaatcaaaaaggaggaggttggaatgaaatataaagagatgttcgttcctagtttgattcaattagcggtagaagtaaaaaataaagaagaagcttttttaatcgctgcacaacaattagaaaaaatggggtacgtcaatgagaattatttgaatggactgattgcaagagaaagagaatttcctactggattgattactaagtatttaaatatcgcgctgccacattcggaatgtgaatatgtcgaaaagccatttgtttttgttatgcagctgaagaacccaatttatttttatcaaatgggggataatcaggaaatgactgtagaaaatctattttttttaggaatcaaagaaccaaaagaacaagtaggattacttcaagcgtttatgaatttattcatggatgaaacattcgtggaaaattacaagaaacaagaaacaccgcaaaacatatacgaacttattacaaattatatttag

SEQ ID NO: 3577 - DNA (genomic), 615 bp, Enterococcus faecium; double-stranded, circular
  misc_feature (B) LOCATION 1...615
  hypothetical: NO
  anti-sense: NO
ttagtcaaattggtcggcgaagaagcattcactgtagaatgtgatgtttctagcgacgaaagcatcgaaaaagcaatgaatgccatcggtgaatatgctggggagatccacggccttgtccatgcagttgcttacgccaacaaagaagaattgtccggaaatgtgtctgatatttccagagacggctatcaattagctcaagatatcagcagctactctttaattgctgtatcaaaatacgcacaaccgtttcttgcaccaaacagcgggatcgttagcatgacttatctaggttcagaacgcgcaatcccgaattataacatgatgggtattgcgaaagcttctcttgaagctgctatccgttatttggcagctgagttctcgcctaaaggaattcgggtcaatggaatctcagctggggcaatcaaaacattagctgtcacaggtgttaaagactatcaaaaactgatccagttatctgaatctcgtacgcctgatcagcaaggtgtgacgatcgaagaagtcggtaatgcttgtgctttcttaatcagcccactttccagcggaatcatcggtgatattatctacgttgacaatggtgtccatctttcataa

SEQ ID NO: 3578 - DNA (genomic), 1338 bp, Enterococcus faecium; double-stranded, circular
  misc_feature (B) LOCATION 1...1338
  hypothetical: NO
  anti-sense: NO
cgaaacaaattaaatacaaggagatcggatatgtccataaaaaaaacacgtctagtcctattattggctagtctcattctttgccttgcttcttttctaccagctgttgctgtgcaagctgaagatactttcaaagtaaatgcaaaagcagcctttgctgtagatgcgcaaagcggtaagattctttatgatcaagatggagaaaaaaccatggggatcgcttcaatcacaaaaatcatcggtctttacatcgtccttgatcaagtaaaagaagggaaactatcatgggatgataaagtttcaatttcagattatgcagaaaatttgagtgtcaccccagatttatcaaatgttcctttgcataaagaaaacacctacaccgttaaagaattattcgactctgcaatcatccagtcagccaacgcttcaatggttgccttggcagaaaaaatctctggcagcgaagcaaaattcactgaacgaatgaaagaacaattgaaagattggggtatcaaagatgcaacgatcgttaatgcatcaggactgaataactcttatcttggcgaaaaccgaccagaaggtactggagaaaacgacgaaaatcaaatgtctgctcaagatgtggctatcgttgcccgtcatttgatcttggattttccagaaatactggatgtatctagcactacgacacaaatgtttggcgaaaacacgcaatcaccagtagaaatggtcaactggaactggatgctcccaggattcgtgaattataaagaaggcgtggacggattaaaaactggtacgactgaacttgcaggagcctgtttcgtcggtacgatcactaaaaacgatcaacgaatcatcactgtcgtattgaatgcagacggccatgcggaaaacccaagtgcccgtttcaatgaaacagctcgcttaatggattattgctacgacaattggtcagaaaaagagcttggaaaagccaatgcaagtatccctagtctaaaaaccattgatgtanaagaacgganagaatcaacagtgcccgttgtgcttaaaagtcctgtaaaagtatgggtacggaacgatatggatactggaaaattaacaatcacaccaactcttgacaaaaaacaagtcactgacaatgagatccaagcacctatggataaaggaacaaaaatcggtaccgcaacgatcaccttggcagaagataaattaggttatcttgaagacaacaacgcgccatccacagaaatcatcacggataaaaccgtagaaaaagcaaatattttcgttattggctggcgacgcgtcgcagaatttttcggtaacttgttttaa

SEQ ID NO: 3579 - DNA (genomic), 1065 bp, Enterococcus faecium; double-stranded, circular
  misc_feature (B) LOCATION 1...1065
  hypothetical: NO
  anti-sense: NO
atcataaaattaggaggaagaaaaatgaagttatggaagaaactagcctttacaggtgtttcagcgttgttgttgggaacattagcagcatgcggaggttctggttctaaagaccaggcagaagctagcaattcggacactttgcagatgtatcaaatcggagataaaccagataatttcgatcaattgatggaagtagcaaacaaacgaatcgaaaaagagatcggtgtaaaagtcaatatcaattacattggctggggcgattacgaaaagaaaatgaacgtcatcatttcttccggggaaaattatgatatcgcctttgcgaacaactatgtttccaatgcccaaaaaggagcctttgctgatttgactgaattagcgcctaagtacgctgaaaaagcttataatgatttagatgaagcatatattaaaggaaatctggtcaatggaaaattatatgctttcccagtcaatggaaatgtctttgctcaacaagtacttacttttaacaaagctttactagataaatacgatctttcaattgatggaatccaatcttacgctgatgcagaaaaagtcttgaaggaattccatgaaaaagaaccaaacacggcagcttttgccattggacaaggcttcaaagtccaagggaactttgattatcctttagggaatacgttaccatttgctattgatctggatggagatgattcgaaaatcatcaaccaatacgataatgaaacgtatatcggactgttacgtacaatgcatagctggtacaaacaaggactcattccaagtgacgctgcaacgagcaataaggattatccactagaaggaaatacttggctaatgcgtggagaaacacaaggaccgtatgattatggcgatacaattttgacaaatgcagcaaaacaagaacttgtctcaaaagcaattactgttccactaaaatctacagctcaagcacaaatggcaaattttgtcgtatcaaatacttcaaaaaataaagaaaaatcagtagaacttctagggctgcttaacagtgaatcctataattattga

SEQ ID NO: 3580 - DNA (genomic), 876 bp, Enterococcus faecium; double-stranded, circular
  misc_feature (B) LOCATION 1...876
  hypothetical: NO
  anti-sense: NO
ttaaaaaaattacacattgaaagtggaggagaaaaaatgaaaaaaattattcgttttgtagtcattacatttgtagcaattatttggttggcagggtgtagccaaggaaaagcagatacaactgacaaaaaagaaactatcgtaaaactagggattattggagaagatacagatgtatgggacaacgtgaaagaccgtttgaaaaaggagaacattaatttggaatacgtgaaatttacagattacaatcaaccaaatgtggctttagcagatggatcgattgatttgaattctttccaacatcaattctttttagacaattacaataaagaacacggaactgatttagtatcgatcggaaatactgtcaatgcaccgctgggaatttattctaacactttgaaggatgtagctgatatcaaagacggagcaaaagtagcaatccctaatgatgttacaaatggcggcagagctcttctgttattgcaaactgctggattgatcaaagtggataaggcaaaaggacaagcgcccactgtttctgatattaccgagaatagaaaaaatctagacatttctgaattagatgcttcccaaacagcacgtgctttgtcagatgtagacatttcagtgatcaatagcggtgtagctgtagatgctggatttaatcctgcttctgatgccatcttcttagaaccagtggatgaccatgcacgtccttatgtgaatatcatcgttgcaagaaaagaagatgaaaacaataaaacgtatcaaaaaatagtagacgcttatcaaacagaagacacagtcaaagtaatcgagaaaacatcaaaaggatcaagcgtgcctgcatgggaaacattcgggagaatataa

SEQ ID NO: 3581 - DNA (genomic), 1632 bp, Enterococcus faecium; double-stranded, circular
  misc_feature (B) LOCATION 1...1632
  hypothetical: NO
  anti-sense: NO
ggaaaaaaattgattactgtaaatgatgtgagtttgcacttttcagaccgcaaactatttgatgatgtgaatattaaatttacccccggaaactgctatggcttgattggtgcaaatggtgcaggtaaatcaacgttccttaaagtgttatcaggggatctgcagccttccacaggttccgttactatgggaccagatgaacggatggccgtattgaaacagaaccattacgactatgaagactatactgtacttgaaacagtcatcatgggacacaagcgtctgtatgaagtgctgaaagaaaaagatgcgatttacatgaaagaggatttcactgacgaagatggtattcgagcagctgaattagaaggagaatttgctgagcttaatggatgggaagctgaaccagaagcagctgttttactgcaaggtctgaacatccctgaagaattgcaccatcagcaaatgagtgaattaactggtggacaaaaggtaaaagtgttattagcacaaacactatttggtaaacctgatgttcttttgctagacgaaccaacaaacggtctggatatccaatcgatcaattggctggaagaatttttgatcaattttgaaaatactgtgatcgttgtatcccatgaccgtcactttttgaacaaagtatgtacacatatggcggatctagattttggtaaaatcaaactttatgtaggaaattatgatttttggttggaatctagtcaactagcggctaaacttcaagcaaacgcaaatgccaaaaaagaagaacaaatcaaagaactccaagaatttattgcccgctttagtgcgaatgcatcaaaatcaaaacaagcaacttcacgtaaaaaaatgcttgaaaaaattactttagacgatatccaaccttcttctagacgttatccattcgttggattcaaacctgaacgtgagattggaaacgacttattgcaggtagaaaatgtaagtgtaacgattgatggaaagaaaattttagatgatatatcttttaatttgagcaaagaagacaaggtcgctttcgtcgcagaaaatgatataacaacaacaacgctattcaaagttatcatgggtgaaattacgccagatactggaacagtacgttggggtgtgacaacaagtaattcttatttaccaaaggatacaacgaaagaattcgatactgatctaacgattttagactggttgcgtcaatatgcaagtaaagaagaagatgataacaccttcttaagaagcttcttaggaagaatgttgttttctggtgaagaagtattgaaaccagtgaatgttttatctggtggagagaaagtccgttgcatgctttcaaaaatgatgctttcgaaagctaacgtacttgtattagatgatccaacgaaccatttagacttagaatcaatcacagcattgaatgacggcttgatggcatttactggctcaatcttatttgcgtcacatgaccatcaatttatccaaacattggcaaaccgcatcattgccgtttcggataaaggtgtgatcgatcgagctgatacgacatatgatgaatttttggaaaatgcagatattcaaaaacaattgaacgagttatgggcataa

SEQ ID NO: 3582 - DNA (genomic), 828 bp, Enterococcus faecium; double-stranded, circular
  misc_feature (B) LOCATION 1...828
  hypothetical: NO
  anti-sense: NO
atgaaaaaatttaaatggtcgtatctttatttagggatcgtctttttattcttatatgcaccgatcttctatctgattttttattccttcaatgaaggaggaacgatgaacagctttacaggatttacttgggaaaattatgaagctgtttttgaagatacacgtttgatcattatcgtattgaatacgttcatgctggctttcttatctgcattgatcgccacgatcatcgggacatttggggctatgggaatctattacacgaaaaaacgacgtgcacggacagcgttgttgagcatgaataacatcttattagtctctcctgatgttattatcggtgctagtttcttgattttctttacactactaggattcggattaggttttcagagtgtattgctttcccatattgctttcagcattccaatcgtcgtcttgatggtcttgccaaaattgcaggaaatgaacgattcaatggtcgatgcggctagagaccttggtgctaataatttccaagtagtcaaaaatatcattttgccttatctttctccaggaatcatagctggatattttatggcatttacctattctcttgatgattttgcggttacatttttcgtcacaggaaatggctttacgacgctctcagtagagatctattctcgtgcaagacaaggaatcagtttagaaatcaatgcgctaagtgcgttagttttcttgttctccatgatattggtcattggatactactttattagtaaagaaaaccgtccaaaacggctgaagaaaaacagaagagtacgcgagggggtggcacggctgcgatga

SEQ ID NO: 3583 - DNA (genomic), 225 bp, Enterococcus faecium; double-stranded, circular
  misc_feature (B) LOCATION 1...225
  hypothetical: NO
  anti-sense: NO
gcgactttttcacaacctctggtacacggtgttccaaaagtagcttcttcggaaataagttggaatttcacaaaaattcaagaagtaattttcgtaaattccttcttatttcttgaagctgattacttctgtcacaacctctttttattattgagaatttggtcgaggaataatcgtttttgccatccaaatatccggtttgtcccagccatttgcatttggtaa

SEQ ID NO: 3584 - DNA (genomic), 525 bp, Enterococcus faecium; double-stranded, circular
  misc_feature (B) LOCATION 1...525
  hypothetical: NO
  anti-sense: NO
gagactttttcgaaaatccaaatgaagtccgagcacagcaatttatcagtaaagttatcaatcattgataggaggaaaaagatgcgcaggttaaaaaaaatacgcctgattttccttttaggcattgcttttcttgcactagccggatgtaaaggaaatgggttggcaaatgaagatattttagagcgaagcaaatctaccaatgaaatcatctggggtgtcaagtatgatactcgattatttggaatgatggatattgagagcagaactgtacaaggatttgatgtagatattgcaaaagcaatcactaaaaagatccttggtgacaatggaaaaacagaatttgttgaagtcacttctaaaactcggattccattattgaaaaacggaaatatcgatgcaattattgcaacgatgacgatcacagatgaacgaaaaaaacaggttgactttttcagatgtctatttcgatgctggccaagctttgttggtaaagaaaggaaaccaaatcaaaagtgtagatga

SEQ ID NO: 3585 - DNA (genomic), 1521 bp, Enterococcus faecium; double-stranded, circular
  misc_feature (B) LOCATION 1...1521
  hypothetical: NO
  anti-sense: NO
aggagaaaatttatgaaaaaagcaacgctcgtaaaattaggtcttagttttgcaggaattctagcacttgccgcatgcggcagcagttcaagtaacagttcttcagagacagaagatggaaaagctaaaatcacttggttaaatattttgcatcatgcttcaccgcctacagacacgattgtgaacttgatcgaagaaaaaaccgatacggaactgacattcaactggattcctgatgcttcaaaagaagaaagattaacaactgcattggcttctgatgaactaggagatatcgttacacttcaaattgcgatgttgaaaaactcttctgtccgcaatgcgttaaaatcaggcgtattctgggatgtatcagaatatttaaaagactataaaaatttaagtcaaatttctgaagatagaatcgaagctgcgagtatcgacggtgccttgtacggcgtaccgatacaaaaagactacgctcgtgctggcttagtcattcgaaaagactggttggataatctaggactagatgttccaactaccatggatgagctttatgaagtagctaaacaatttacagaaaacgatcctgatggaaatggtgtggacgacacagttggttttggcgatcgtgcgcctagtgatattcgttataccagctttaaacttttcacttcttattttggagcaccaaatggctgggctgtagacgataatggcaaattcactccagaatttgatacagaagagtatatgaaagctttgaatttttcaagagatctatttgagaatggctatttggcacaagactttgcagttacccaaaagactgatcagcaagaacaatttgcacaaggaagaactggaatctacactggaatggtggatatcaagaatctgaagacgatgggtcaaggtattcaagatgatatggaattagtgcctgtaaacaagatctcagatggtgaaggcggcggttatcatgtttggtcagaaggaaatggtattggcggcttgctagcatttcccaaatctcaagtaaaagacgaagcacaattgaagaaattacttcaatttgttgatgatcttttagaagaagatgtgtataaattgatgactggcggtatcgaaggaacgcattatgaattgaatgatgatggttctatcgaatttatcgatatggatctttggcaacaagaggtgcaaccgttatcaagctctcgtcctagtgaagtgacgttctctttcaaagatacagaccctgaaaaagaattctctaatcaattgatcaaagaaaatgaagaatttgctgtaatggatccttctgtgccattggattcaccgacgaacaatgaagtaggatcagaaattgaaaaaatcgtcattgatgctacggtgcaatacatcatgggacagcttgacgaagatggattcaaaaaagctgtagaagactggaaagcacaaggaggcgatcgaatcacacaagagtacgaggaagcatacaaagcagcggcacagtaa

SEQ ID NO: 3586 - DNA (genomic), 192 bp, Enterococcus faecium; double-stranded, circular
  misc_feature (B) LOCATION 1...192
  hypothetical: NO
  anti-sense: NO
cttccattttcatcttgcattagatctttcatatattcatttgtgctaattaaattagtatttgatacatttttatcaggagaatcatacaaccataaagctttattatttagcacagattctttagcagcttcccaacttgaaattcctgaactacttgtagattgtgtcgttgtagttgttgcttgttga

SEQ ID NO: 3587 - DNA (genomic), 1599 bp, Enterococcus faecium; double-stranded, circular
  misc_feature (B) LOCATION 1...1599
  hypothetical: NO
  anti-sense: NO
actttgaaatttgatgtaaagaagattctgcttccaaacctgccttatctgttcatcttctggtttttcaaccgtgtggcggagggctaccggctggcggagggcgcggatatggtgacaaaggcaatgggcgcagtatccggcctgggggcgctgatttccaaaaacccgctgcccagcttctacccgcgcgacctgctgctcggcgctgtcgtcgcggtcattatccgggccgtagtttatttcaaggcgaaaaacgccaagaaataccgccacggagttgagtatggttcggctcgttggggaaattccgacgatattaagcctttcatcaatccccaattcgaccagaacattctcctgacgcagacagagcgtgtcatggtggggagaaacaaaatccccaagtacaatatcaacaagaatgtgctggtaatcggcggttccggcagcggcaagacccgcttccacatcaagccgaacctcatgcaaatgaacgccagctatattattactgatccgaaaggaacagtctttctcgaatgtgagaagatgctccagcgcggcggatatgagataaaaatactgaatacgattgatntcaagcagtttatgaagtataacccgttccgctatatttactgtgagaacgacatcctgaagctggtcaactgcatcatggaaaataccaaaggcgaggacagcaagggcggcgaagatttatgggcgaaagccgaagccttctactatcaggcgctgatcgcctatatttggtacgaagcgccggaggaagaaaagaacatgaccaccctgctggaaatgctcaatgcctccgaagtgcgggaggatgacgaaaatttcaaaaatgccgttgacctgatgtttgacgcgctggaaaaacgcgatccacaacattttgcggtgcgccaatataagaaatacaaaatggcggctggcaagacggcaaaatccatcctgattagctgcggcgctcgtatggctccctttgacatccgggaggtgcgggaactgatggagggcgacgaactggaacttgaaaagattggcgaccgcaagacggcgctgttctgtatcgtatctgacacggatatgacattcaatttcatttctgcgatggtttatacgcagatgttcaacgtcctgtgcgacaaggcgctggaaaatggaggcgcactgaaaacccatgttacctgcctgctggacgagtttgcaaaccagaaaatccccaacttccagcacctgatttccgttatccgaagccgggaaatttccgcgcatatcgtggtgcagacgcagagccagttaaaggctgtctacaaagaccatgcggaaactatcatcggcaactgctcctgcgtcctgtttttgggcggcaaggagcgcagcaccctgaaagagatttcggaaacgctgggaaaggaaaccatcgaccttttcaatacctccgacacgcggggaagccagcgcagcatgggggtaaattaccagaaactcggaaaagaactgatgtcaaccgatgaattggcggtgatggacggcggcaagtgcatcttgcatgtgcagagcgacagactccta

SEQ ID NO: 3588 - DNA (genomic), 273 bp, Enterococcus faecium; double-stranded, circular
  misc_feature (B) LOCATION 1...273
  hypothetical: NO
  anti-sense: NO
tggtctctttcctgtatctctttcgtcagtgtttcaagatcagtcggaattcctttttcttggttctctttgaaacgtctttctgcacgctcacttacgcttgctactaaaaagattttcacttctgcattcggtaatacagctgtcccgatgtctcttccgtccatgacaacgccaccgcgttcccctatttttcgttggacagcaactaattcttctctgacttttccatgtgcagagacttcagaaacagcttttgtgacatctggttga

SEQ ID NO: 3589 - DNA (genomic), 294 bp, Enterococcus faecium; double-stranded, circular
  misc_feature (B) LOCATION 1...294
  hypothetical: NO
  anti-sense: NO
attatgaaatttttcgaagtaaaatcaccatactattatgcgttaatcgcagcaaagaatgaagaagaatgtgcagaattgtatgaacaagtagtaacagatatcgaaaatcgtgaagaatttattcgatgtttgcatgagttaaatcgaaatgaagcaattcaagaggatgcgaaaaaaattagtgaagaaacgttacaaccaatcggtatggaggaagctacaaaagacatttttacaattattgatgaacaaaaatcttgtgtattaagcattgattctacattggtttaa

SEQ ID NO: 3590 - DNA (genomic), 339 bp, Enterococcus faecium; double-stranded, circular
  misc_feature (B) LOCATION 1...339
  hypothetical: NO
  anti-sense: NO
gaaatgaaattatttgggaaagaaaaaagaaacccgctcttgtggtggtgggtggaaattgcacatcaggaaacaatgcaaaatgcagaaaacaagaaacaagagcaaggcattaaaatattaggttcgggctgtgcaaaatgtatggaattggaaaaagcaactagaacagcaatatcggaacttcaattagattatgagattgaacacattacagattttgcagaaatcgctagttatggagtaatgtctacacctgcattggtgtttaatggcgaagtaatatcctatggaaaagtattgaccgtagacgaagtaaaagcattattgagcaaataa

SEQ ID NO: 3591 - DNA (genomic), 570 bp, Enterococcus faecium; double-stranded, circular
  misc_feature (B) LOCATION 1...570
  hypothetical: NO
  anti-sense: NO
tatccgaaattagcagattatttatccaaccgggtcgatttttcccgtaaagaacaacagcagtcccattggcattggttcacattaattttatttggattaatgactgttgcaacgttatcacaaaaactaatattgctgactttgttcatcgcaatcgttgcattgatcaaaggtcctgtgatgatcttgtgggggatgttgtattcctttttggttgggctttttccgcctatcggtattttgctttcagcgattttctttttattgaatatcggaacatttacaaagaactggcggatgaccttagtcgggatctatttttatttctatccttttggagtgatggcacttagtgaagtcatgcattgggataatcattggtttatagctggctccttgcttttagggttgatcttgttacacgtgatgttgacaaagctctatcaacattatggtatcggacgtacgattttctggtatgtcttttcgatcccatttgcactgcttactgctctcttaccaagccgtttgaagacaaaaataaaaggttaccataaaatcaagtga

SEQ ID NO: 3592 - DNA (genomic), 219 bp, Enterococcus faecium; double-stranded, circular
  misc_feature (B) LOCATION 1...219
  hypothetical: NO
  anti-sense: NO
atatggctttccacatttttacatatatttagcttaataccgagaaactggcttttgaacaccgtttattcggaacaagaggttgtgacacgtcttttgtcacaacccctttgtctttattcattattattcttgtcggaactcatcatattgtttttgcatttctttcaataccttatcatagccagccttgtccaaagcgtctttcaatttcggtaa

SEQ ID NO: 3593 - DNA (genomic), 231 bp, Enterococcus faecium; double-stranded, circular
  misc_feature (B) LOCATION 1...231
  hypothetical: NO
  anti-sense: NO
aaatggctttctacatttttgcataaatttggcttaataccgagaaactggcttttgaacaccgtttaccaagagtttgtgagcctgccgtttaactccgagtcacaaggagcaatttcaaaaaacagcttctcaggtttgttgactattgtgacttgtgaccgaggagtttgcaggagaacaccgtttaaggaagagcttgtaaaatcagcggtacgacctgagtattag

SEQ ID NO: 3594 - DNA (genomic), 1539 bp, Enterococcus faecium; double-stranded, circular
  misc_feature (B) LOCATION 1...1539
  hypothetical: NO
  anti-sense: NO
accaagaaattgaataaagcgagggatcaatcaatgagcttctctttagaagacatccgtcatttactattaaaagaaaatctattaaaagaatttgtttcaacaagaggctggcatcttgatgtaccagaaaaagctgaatttcttcagttaagttatgattcaagaaaagctgatgcttctactttgtttttctgtaaaggaatgaatttcaaagaagaatatttggattcagcaatcgaacagggtattcaatattatgtatcagaacaaccatacgaaaattcagcagtaggaatcatcgtaacggatatccgtaaagcaatggcgcttcttgctatggctttttacgactatccgcaaaataaattgaaagtgatcggattcactggaacaaaaggtaaaacaactgctgcgtactttacaaaagcaatcttggatcacacaacaaataaaaaaacagcattgctttctactatgaatacaacgttagatggcaaaacatatttcaaatcccatttgacaacgcctgagtcattagatttatatcgtatgatgtcagaagcagttgaaaatggtatgactcatctagtgatggaagtttcttcacaagcttacaaaacacaacgcgtatacggcttgactttagatgtcggaatcttcttgaatatctcgcctgaccatatcagtccgatcgaacatccgacatttgatgactatttctattgcaagcgacaattgatcttgaattcaaaaacagttgttttaaatcatgaaagtgactattttgatttacttagggaaacagccgatctattccagattccaacgatcacttatggtcgttcggaagaaagcaattatcaagtgatccgttcagataaaggtactcacggttttactttatcttctcatgaagatcgcttagctatctgcgatactgcttatgatattttgctggctggaggattcaaccaagaaaatgcagccagtgcgatcattgccgcagcactaacaggtgcctccagtcaagatgcacaagacggattaaaagaagctcgtgtaccaggccgaatggatcaattgatccaatccaatggagcgcatgtctatgtggactatgcacataattatctaagcttgaaaacattgctgaaatttgccaaaaatgaacatccagatggccgtgtaattgttgtattaggcagcccaggaaacaaagcaatctcccgtcgacatgattttggaaaagtgctatcagaaacagctgacatcgcctttttgacggcagatgacccagcatttgaagatccgaaaaaaatcgcggaagaaatcaatgaagcaattactaatccagatttgatcgttcattatgaaatggatcgtcctgaagcgattcgacgcgctttagcagaaagcgctccgcaagattcagtcgttattgcgggaaaaggcgtggatccctatcaaaaaatcaatggtgtagatgaaccttatgaaggggattatgcaatcgtgaagcggttgattgaagaataa

SEQ ID NO: 3595 - DNA (genomic), 483 bp, Enterococcus faecium; double-stranded, circular
  misc_feature (B) LOCATION 1...483
  hypothetical: NO
  anti-sense: NO
acccttatttcttcgtggacaatggcgacgatggaaccggcgcaatccccggcaccccgggcgggccggctatcccggactattccggcgaaccgatgggcgatggcagctttgaagccatgctgcgggaagcggagaaatacctgggctatccctatgtgtggggcggctcccatccatccacttcctttgactgttccggttatgtttcgtgggtcattaaccactcccggcgtgggcagcgtcgggcggcaaacggcacagggcctttacaacctgtgtacgccggtatctgcggtgaacgcacagcccggcgacctgattttctttaccgggacatacagctcgccggggccggtcagccacgttgggatttatgtgggaggcgggcggtttattcactgcggcgacccgatttcctacgccaatacgggaagcccctattggtctgcccatctgtacgggtatggcagaataccctga

SEQ ID NO: 3596 - DNA (genomic), 1785 bp, Enterococcus faecium; double-stranded, circular
  misc_feature (B) LOCATION 1...1785
  hypothetical: NO
  anti-sense: NO
gagaagaaattgaatgcgggggaggaaaaaatgaaagtatacaaaaaattatttagttatgtccctaaaatgaaatactacggatggttagccactttattttctgatttttctgtcgtattaacagtctatggatattacagtatttacaaatttcttcagtctctaattattgtaggagatgaatatttagctaagagttatgcggttcaaactgttgcttggttaactttaggagctttattttatattttttctggcttattttctcatatccttgggtttcgcttagagactaatttgagaaaaaagggaattagcggtttaacagaagcaagttttcgtttttttgatttaaattcttcgggatatattcgaaagacaattgatgacaacgcggctaaaacacatatggcaattgctcacttgattccagatagtgctcaagccatagtaacacctgttttatcagttgccttaggctttttcattaactttaaaattggattggttctaatcgccatgttagtaattggtgtattcttgttaaagaaaatgacagagaatacaaattttattcaaaaatatcaagaatcgttagatgtgttaagctctgaaacggtagaatatatccgcggaattcaagttataaagatatttggtgctaaagtaacatcatttaaagccttgaataaagcaattaacgattatgctaagtttgcatataagtattctttgagtgggaaaacaccttttgttctttttcaatggctattttttggcatagtttgcattttgatagttcctataaccttttttataacttctcttaccactcccaagatcttagctgttgacttgttgatgttgttttttttaagtggaattatttttgtttctttcatgagaataatgtatgtaagtatgcacttgtttgaagcaagatatgcagtcgaaacactagactccctttatttagaaatgaagcaagaccaactaaaatatgggaacgagacacagattaaaaattgtgacattgcatttgaaaatgtcagcttttcatacaaagaagagtgtgttttagaaaatttcaacttagttttagaacaaaaaagaatttatgcattagtaggaaaatcaggaagcggaaagagtacgatagctaaactaatttcaggtttctacaatgtggataagggacagattaaaattggtggtaagcctttaaatcactattcaaaagacacaattattaacacaattgcttttgtctttcaagatacgaaactattcaatcagagtatttacgataacgtttctatagcaaatcctcaagcgccagcaagtaaagtatttgacgcgctaagattagccggttgcgaatcgattttagaaaaatttcccgaaagagagcataccttaattggtagtaaaggagtttatctgtcaggaggagaaaaacaacgtatagctattgccagagcaattttaaaagatgcaaagattgttattatggatgaagccagtgcatctattgatccagataatgagtatgaactacaaaaggcttttcaatatttgatgaaagaaaaaacagttattatgatagctcatcgattatccagcattaaatctgtagatgaaattcttgtcttgtcagaaggaaaaatagtagaacgtggaaatcataatgaattaatggctaaacatcgagtgtataaacaattggtcactaattatgagaatgcaaatgattggaggcttgacaatgaaaaatttttataa

SEQ ID NO: 3597 - DNA (genomic), 303 bp, Enterococcus faecium; double-stranded, circular
  misc_feature (B) LOCATION 1...303
  hypothetical: NO
  anti-sense: NO
gcagtcatttcaactggatcaatgatcgtcgtgtattttttggctagaagtgctgttcctatgagcaaaacaactaatagaacagataaaacagcagttgactttttcttgatcaatttaaataattcttgttttacaagcaatgtcatttttcttcttccccctttactgaatccagaatttccaatagagaagattccaaatcattcgtcagatgctggacgtctgtcacatggatattttgtgcagacaatagctggatcacggttcctaataattcttcgttttcttttaaaagcttga

SEQ ID NO: 3598 - DNA (genomic), 1995 bp, Enterococcus faecium; double-stranded, circular
  misc_feature (B) LOCATION 1...1995
  hypothetical: NO
  anti-sense: NO
ccgtccatttcttccaaaaacaaacgaaacgaaaaatacacttttaggcgttgttggtatggtattcgcaagctttgcaatctggttgtttatcaaaaaaagaacaggagtgaaaaaatgaaaaatcataaaaaaataaacgttatgttaggagtccttttccttattttaccattactcacaaacagcttcggcgcaaaaaaagtgtttgcagaggagacagcagctcaagtcatccttcataaaaagaaaatgactgatttacccgatcctttaatccaaaacagcgggaaagaaatgagcgaattcgatcaataccaaggattagccgatatttcattttcagtttataacgtcactcaagaattttatgcgcaacgagataaaggagcgtccgtggatgcagcaaaacaagcagtccagtctttgactcctggtacaccagttgcttcaggaacgacagatgctgatggaaatgtcactttatctttacctaaaaaacaaaatgggaaagatgcagtctacacgatcaaagaagaaccaaaagacggagtgtcagctgccgcaaacatggttttagctttccctgtatatgagatgatcaaacaagcagatggctcttataaatacgggacagaagaactagatactatccatctctaccctaaaaatacagtcggtaatgatggaacgttgaaagttacaaaaatcggtactgccgaaaacgaagcactaaatggagcagaatttattatttctaaagaagaaggaacaccaagcgtcaaaaaatacatccaaagtgtcacagatggattgtacacttggacaactgatcaaaccaaagccaaacatttcattactggtcattcttatgacatcggcaacaatgactttgccgaggcatctattgaaaaaggccagttgatcgttaatcatttagaagttggaaaatataatttagaagaagtaaaagctcctgataatgcggaaatgattgaaaagcaaacaatcacgccttttgagatcctggcaaatagccaaacaccagtagaaaagaccatcaaaaatgatacgtctaaagttgataaaacaacacctcaattgaatggaaaagatgtcgcaatcggtgaaaaaattcaatatgagatttctgtcaatatcccattaggtatcgctgataaagaaggaacgcaaaacaagtacacaacattcaaacttatcgatactcatgacgctgctttaacatttgataatgattcttcaggaacgtatgcttatgccttatatgatggaaataaagaaatcgacccagtaaattattctgtcactgagcaaacagacggattcacggtttcagttgatccgaattatattccttcattaactcctggcggtacattgaaattcgtttactatatgcatttgaacgaaaaagcagatccaaccaaaggattttctaaccaagcaaatgtcgataacgggcatacaaatgatcaaacaccaccgtcagtcgatgtcgttactgggggcaaacgatttgttaaagtagatggtgacgttacatcagaccaaacacttgctggagcagaattcgtcgttcgtgatcaagatagtgacacagcgaaatatttatcgatcgacccatccacaaaagccgtcagctgggtatcggcgaaagaatcagcaacggtttttacaaccacaagtaacggtttaatcgatgtgacaggtctaaaatatggcacgtactatctggaagaaacgaaagcgccagaaaaatatgttccattaacaaaccgtgtagcatttactatcgatgaacaatcttatgtaacagcaggacagttgatttctcctgaaaaaataccaaataaacacaaaggtacacttccttcaacaggcggtaagggaatctatgtgtatatcggtgcaggagtagtccttctactgattgctggactgtactttgctagacgcaagcacagtcagatttag

SEQ ID NO: 3599 - DNA (genomic), 477 bp, Enterococcus faecium; double-stranded, circular
  misc_feature (B) LOCATION 1...477
  hypothetical: NO
  anti-sense: NO
tggacaatttcaacaacattagctgagaggttttattttattatgagactatatcatttacgtagtttggaggagttgaggaaattggattttaacaaaaaatttttttgggaaatttctgatttgagttgtttcgtagaatctgagcgtctaagtaatggtaataatagtgtgttaaatgaatatgacaaagtagtaattaataaagtaaaaagtttatgtgaagaagctagagaatctatcagtcatattaatggtagcaattttaaacaaacattatttaatctgattaagctagatgctaaaatatcaagttatttattctttttgatacatgatgaatttatggattatcaaaaattggatcagttaattgaaagagaaagctgggaagattattacgtgggtctaactttttcagaaaagttaaacaactacaagttaatagattataagtatttgagtgaaagcaattaa

SEQ ID NO: 3600 - DNA (genomic), 639 bp, Enterococcus faecium; double-stranded, circular
  misc_feature (B) LOCATION 1...639
  hypothetical: NO
  anti-sense: NO
gttaaaatttcaaagttttacgtaaggagctatttgatgacaaaaaatatttttgattccatcgctaaccattatgattcccctgaccgtcaagcattagccaagattattcgcgaagaactaactacttatctaccgcgcgacagccaccaaaaagtcctgctggattacggaggcggaactgggcttgttagtttaccgcttgcggaaagattcaaagaactgatcattgccgatgcttcagaaactatgctgaaaatggcagaagaaaagatccaagcagcagatctgaaaaatgtccgaacgatccacgctgatgcttctgtcgaatttcctgctgtccaagctaatctcatccttctatcacttgtacttttacacattcctgatacggagaatattcttacaaaactttatgaaattttagctcctggcggtcaattgatcatcgtagactttgacaagaatgaacaaattagtcatccgaaagtccataatggctttagccaagaagaattgaataatcgattggaaaaaacgggctttgtctctgctactagtcataccttccatcgtggggaaaagctatttatgaacaaaaacgcttcgcttttcttatccatcagccaaaaagcttaa

SEQ ID NO: 3601 - DNA (genomic), 405 bp, Enterococcus faecium; double-stranded, circular
  misc_feature (B) LOCATION 1...405
  hypothetical: NO
  anti-sense: NO
gagggaatttcattggcacaagttcaatatatcggcacaggccgtcgtaaaaacgcagttgctcgcgtacgtctagtaccaggaactggcaaaattactgtaaataaaaaagatgttgaagaatacattccacatgctgacttgcgtgaagtaatcaatcaacctttcgctgttactgaaacaaaaggcgcatatgacgtatttgttaacgtaaacggcggaggatacgctggacaatcaggagctatccgtcatggtatcgctcgtgcattgctagaagttgatcctgacttccgtttagctcttaaacgtgctggcttacttactcgtgacgcacgtatggtcgaacgtaaaaaaccaggtcttaaaaaagctcgtaaagcttcacagttttcaaaacgttaa

SEQ ID NO: 3602 - DNA (genomic), 189 bp, Enterococcus faecium; double-stranded, circular
  misc_feature (B) LOCATION 1...189
  hypothetical: NO
  anti-sense: NO
gctttgatttctgtaacgacaccggcaccaactgtacgtccgccttcacggattgagaatttagtaccgttttcgatagcgattgggtggattaattcaacttccattgttacgttgtcgccaggcataaccatttcagttccttctggtaattcaacaacacctgttacgtcagttgtacggaagtag

SEQ ID NO: 3603 - DNA (genomic), 201 bp, Enterococcus faecium; double-stranded, circular
  misc_feature (B) LOCATION 1...201
  hypothetical: NO
  anti-sense: NO
aggatgatttctatggcgagaccgagaaaatacaatacagaagaagaaagaaaagaagcaatgaaaaaggctaggaaaaaatgggttgaaaaaaatcaggaaactattgcctatataagagccaaatcattagctaaaaaattcattgaaatgtgggcagatgaagatatcgctttgataggcgaccgttatatccgacgt

SEQ ID NO: 3604 - DNA (genomic), 1851 bp, Enterococcus faecium; double-stranded, circular
  misc_feature (B) LOCATION 1...1851
  hypothetical: NO
  anti-sense: NO
gataatgtttcacgaaaggagatcaacttgtccttcgaagaaaatcgaagtaaaatggcaagagaaaggagcgggaagatgaacgacttattaaaacaatactttggctatgatgagtttagacctggtcaaaaagaaattatccagaaagtcattgatcaggaaaatgtattaggaatcatgcctaccggaagtgggaaatcaatctgttaccagcttccagctttactattagatgggcttactgtggttgtgtcccctttaatctctttgatgaaggatcaggtggacgcggcgaatcaattaggtatacccgccacttttatcaatagctcgttagatggttacgaaacagctagacgcttccaagaaatcgatagacagcagtaccgtttactttatatcgctcctgaacgttttatcatgccggattttatccaagcaatgaagcgatggaacgtccgtatgatcgctattgacgaggcacattgtatctctcagtgggggcatgatttccgcccaagttatttacagatggcgaaccagctagatcaactgccaaatcgtcctgtaattgttgctttgacagctacagcgactgtgcaagtagctgctgacataaaaagacttttaaaaattccagaaaacaaccatattcagactggttttgaacgagaaaatctacgatttcaagtaattaaagatcaaaaaaaagaacaatatctaatcgaatatttaaagatcaacaaaaatcaatctggtatcatttatgcagcaacgagaaaagaagtagaccgtctctatcatttgcttaaaaaattcgatttttccgtgggtagatatcatggtggtctaaatgagaatgagcgaacagaaatgcaagaagcctttttatacgatcgcttgcagctgattgtagcgacaaatgcatttggtatgggtataaataaaagcaatgtccgttttgttatccattatcaaattcctggctctctagaagcatactatcaggaagctggtcgggcgggaagagatggtctttccagtgaagccatcctgcttttctctcctcaagatatccaagtccaaaagttttttatccagcagtcccaaagagaagaagggcaaaagcaaaaagaatatgaaaaattaaaagcgatgacagaatacgtgtatattgagtcctgtcttcagcaatacatcctaaactattttggcgagacaagcagtccgtgcaaccgttgtggtaactgtttagatgacagagaaatagtagaagtaacgacagaagcacagatggttctttcttgcttaaaacgtatgggtgagaactatggtaaacaaatgctgatgaaagtcttagcaggatcgaaagaacaaaagctgcaagctttaggttttggacatttatctacctatggactgatgaaaaaccaatcgcaaaaagaaacgatgcagttaattgaatatttgatatcgaatggctatcttctgaccatcaatggtgagtatcctgttttgaaagtaacagaaagagggatacaagtattgaaaggacaagaatctgtttatcgaaaggaacccaagaaagtccagcagctatcggatgaagaaaccgatacactatttgaagtgctgcgggaactgcgaacggatctagcatcagaagcaggcgttcccccgtatgtcgtattttcagattccacattgaaagaaatgagccgaatacgtccatcaagcagattggagatgcttcagataaaaggagttggccaaagcaagcttgataaatatggcgaagcctttttatgtcggataaaaaatgcggactctaacgttctggataagtag

SEQ ID NO: 3605 - DNA (genomic), 264 bp, Enterococcus faecium; double-stranded, circular
  misc_feature (B) LOCATION 1...264
  hypothetical: NO
  anti-sense: NO
cgtaatgtttcaagagactcttctgttagttcttcctctactgtcttgatgatacgagcaggatttcctgcaatcactacattgtcgggaaaagatttggtcacaaccgaacctgcgccgactactacgttgtcccctagagtgacacccggcgtgacgataactcctccgcctaaccaaacattattaccgattttaatgggttttgcgtactccagaccgctgttacgtttcactggatgtagtggatgcgtcgccgtgtaa

SEQ ID NO: 3606 - DNA (genomic), 504 bp, Enterococcus faecium; double-stranded, circular
  misc_feature (B) LOCATION 1...504
  hypothetical: NO
  anti-sense: NO
tacaccgtttccgtcgtttttataagaaagaaggggagtttcttgctgaaatacttttttgaccatcaattgattcattacccagataaagaaatcacggattggcgtgaagctatcgccgaaagctgtcttgtattgatcgataaggaaattattgatgaaacgtatgtggaggagatcatccattgtgtagaaaaatacggtccttatattgtgatcgcacctcaagtagcaatgccgcattcttcagaaaaaagtgatggtgtttttggaacagctatttcatttaccaagttgaaacagccaatccgttttgaaagtgaaggggagaatgaggagaaaacggctagtttgttttttacactcgcagcaaaagatccagaagaacatctagaaaatatccaaaaattatccgaattattaatgacagatggattggttgagcgtctcatctctacgaactccatcgatgattaccaagttgtgatggcagaatataattaa

SEQ ID NO: 3607 - DNA (genomic), 600 bp, Enterococcus faecium; double-stranded, circular
  misc_feature (B) LOCATION 1...600
  hypothetical: NO
  anti-sense: NO
gtttcagtttcttgttttattttcaagtcctgctttttatccatcgtacgcaagaaaaggttcttaaaaaggaggaataacatgttgcgtttgattgctaaaatcgatgatagtattatcaacaagttcgccaagcaacggaaaacggatagtcgaaaaatcaattttttgaaatttatcagtaatatctctaatggtggttttatttggttgctccttgctgctgttttagtcttgatacctgatactagagaatatggtctagccattcttatcggcagtttgatctatttttttgttggtttgctttttatcaaaaaaacgacaagacggaaaagaccttatgaaaaaaatcgtcggcttgtcctttacacaagtaaaccgaagacttcttcttttccttcaggacatacagcgctagcctttttatcagtagctgcgttgttcgaattaagtccagttgcaggaatattagcctttttatttgcttgtttgatcgcttattcgaggatttttttacttttacattatcctactgacattttaggaggagctattttaggaagtgttattggcatcctatgcgctgccgttatctga

SEQ ID NO: 3608 - DNA (genomic), 498 bp, Enterococcus faecium; double-stranded, circular
  misc_feature (B) LOCATION 1...498
  hypothetical: NO
  anti-sense: NO
atgaaagtttctttgattgctgcgatggataagaatagagtgattggcaaagagaatgacattccttggaggattcccaaggactgggaatatgttaaaaatactacaaagggacatccgataatattaggtaggaagaaccttgaatcaatcggaagagccttacctgacagaagaaatattattctgacgagagataaggggtttacctttaatggttgtgaaattgttcattcaatagaagatgtttttgagttatgtaaaaacgaagaagaaatttttattttcggaggagaacagatttataatttgtttttcccttatgttgagaaaatgtacatcacaaaaatacatcatgaattcgaaggagatactttttttccagaagtgaattatgaggaatggaatgaggtatttgcccaaaaagggataaagaatgataaaaatccgtataactactattttcatgtatatgaaagaaaaaacttattgagttaa

SEQ ID NO: 3609 - DNA (genomic), 234 bp, Enterococcus faecium; double-stranded, circular
  misc_feature (B) LOCATION 1...234
  hypothetical: NO
  anti-sense: NO
tttttttcttctaatttatatgtgccgtcttgcaaatctccgccagctacaacttttgcagatgatgcggttgtgctttttgcagtcgaagattgtgctgtagatgattcagaagaagagtttgagcttccgttgtcatctgcgccgcaagcgcctaacactagagctgaaaatgctaatacggcaaatccagttacaaaacgttttttcttcattttaataccccaccattcc

SEQ ID NO: 3610 - DNA (genomic), 483 bp, Enterococcus faecium; double-stranded, circular
  misc_feature (B) LOCATION 1...483
  hypothetical: NO
  anti-sense: NO
acgatttcttcttggaaagcaactaactctttgatagcgtcaaaaccaaacagcaatgcaccaagcatgtcttcttctgaaacttctttcgcgccgctttcaaccatattgatggcttgtttcgttccggcaacagtcaattcgatatctgtttgttctgcttgttctactgttggattcaagacgtactcgccatttacacgaccaacttctacgcctgcgattgggccgtcaaatgggatatctgagattgatagtgctaaagaagaacctagcattgctgccatagctggcgagcagtctgtttttacactcatcacgatgttcgttacttggacttcattacggaagccttctgcaaacatcgggcgaattggacggtcgatcaaacgggcagtcaatgttgcttccgtacttggacggctttctcgtttgatgaaacctccagggattttccctgctgcatacattttttcttcataa

SEQ ID NO: 3611 - DNA (genomic), 1500 bp, Enterococcus faecium; double-stranded, circular
  misc_feature (B) LOCATION 1...1500
  hypothetical: NO
  anti-sense: NO
atttcttcttcaaacttaacgttatctgaacaagagaaagtaattgccaaaccgattttaaaagaagtaaatgacagactttcattcttggaaaatgtgggactagactatctaactttgagtcgcgcttccggaacattatctgggggagaagcgcagcgaatcagattggctacacaaattggatcgaatctttctggagttttgtatattttagatgaaccatcgatcggattgcatcaacgcgacaacgatcgactgattggctcattaaagaaaatgcgtgatcttggcaacaccctcgttgtagtcgaacatgatgaagatacgatgtgggcagcagattatttgattgacgtcggacctggggccggagaacaaggcggacaaatcgtggctgcaggcactcctgaagaagtagctaatgatgaaaattctttgacagggaaatatctttcagggaaaaaatcaatccctgtaccaaaagaacgccgtaaaggtaatgggaaagcaatcaagatcactggtgcttcagaaaacaatctgaaaaatattagtgttgaatttccattaggagaatttgtagcagtcacaggtgtgtctggttctggaaagagtacattggtcaatagtatcttaaagaaatcgttagcgcaaaaattaaataagaattctgctaagccaggtaaattcaagacaatttccggctacgaaagtatcgaaaagatcatcgatatcgatccaagcccaatcggccggacgccgagaagtaatccagcgacttatacaagtgtatttgatgatatccgtgggttatttgctcaaacgaacgaggcaaaaatgcggggttataagaaagggcgttttagtttcaacgtaaaaggcggtcgttgtgaagcttgtcgcggggatggaattattaagatcgaaatgcactttttgcctgatgtctatgttccttgtgaagtatgtcatggtaaacgatataattctgaaacattagaagtgcattacaaaggaaaaagcattgctgatattttggaaatgacagtagaggatgctgtagaattcttcaagcacattccaaagattcatcgcaaactgcaaacgattgttgatgttggcttaggttatgtgacgatggggcaaccagcaacgacattgtccggtggtgaggcacaacggatgaaacttgccagtgaattgcacaaaatctctaatggaaagaatttctatataatagatgaaccaacgacaggacttcatagcgatgacatcgcccgcttgttgcatgtattacaaagattagtagatgctggtaacacagttttagtgattgaacacaatctagatgtaatcaaaacagcagattatatcattgatttaggaccagaaggtggagaaggtggaggaacgatccttgcgactggaacaccagaagaaatcattaacgtaaaagaaagttatacaggtcactatttgaaaaaaataatggtataa

SEQ ID NO: 3612 - DNA (genomic), 1209 bp, Enterococcus faecium; double-stranded, circular
  misc_feature (B) LOCATION 1...1209
  hypothetical: NO
  anti-sense: NO
caccttgaatttggaggtgagaacttggcacaacggaatttagattatcggctattaaaagaccgacgcaacgaatacggcgtttcacaaaataaattggctacggcttgtggacttagtcggccgtacttaaatcagatagaaaatggtggcgtaaccgcatctataaaaaccatgaggaaaatttttgaccaactggaaagctttaatcccgatttgcctttgacgttactgtttgactatgtaaggattcgctttcccacaacggatgcacgaaaaattattcaagaaattctccatttgaaatttgagtatatgctccatgaagattatgccttttactcctatcaagaacagtatgtcatgggtgatattgtggtgatgttgtctcatgaagaagataaaggtgtgcttttagaattaaaggggcgaggttgccgacaatttgaaacttttttactcgctcaaaagcgtagctggtacgactttttcgaggattgtctaaaggccggtggcgtgatgaaacgcttggacttggcaatcaatgatcgagtggggctattggatatacctgagctaacgaaaaaatgtcagaaggaagaatgtatctccttgtttcgtacctttaaaagttatcgttccggggaacttttaaaggctgatgaaaaggacggcatgggcaataccttatatatcggcagtctcaagagtgaggtttatttctgtttgtatgaaaaagactatgaacaatatatcaagttagggattccattagaccaaactgagacgaaaaatcgttttgagattcgactgaaaaatgaccgtgcttttcatgcgattcaagatttgttaaaaggtcgtagcattgagagcaccacgttttccattatcaatcgttacttgcgatttgcggataaagtagaaggtaaaaggcgaaccaactggcccttgaatgaacaatgggggcgttttattggacggaatcggaaagagattcaattaacttccgagccaaaaccgtatgccattgaacgaaccttgaattggctaggccgacaagtcgcccctacgtggaaaatggctaaggagttggatcgattgaatcggacaacctatatccaggatatggtacagaatgcacgcttatcagaccgacataaaaagattttggagcaacaaagtatggcaattgaaaatttgattatatga

SEQ ID NO: 3613 - DNA (genomic), 1374 bp, Enterococcus faecium; double-stranded, circular
  misc_feature (B) LOCATION 1...1374
  hypothetical: NO
  anti-sense: NO
ttgatctcttcaataaggaggaacaaaatgcaaatatatgattacatcgtaattggtggcggctctggcggtattgcttcagcaaacagagcagggatgcatggcgcaaaagttttgctgattgaagcgaatgaattgggcggaacatgtgtcaacgtcggttgtgtacctaaaaaagttatgtggcaagcaagtacgattttggaaacaattgaacgagatgcctcaagttacggtatccaagcagatttaaaaaatgttgatttcgccggtctagtagaaagacgagaaaaatatattgattttctacacggtgcttatcaaagaggattagatagcaatcatgtcgaggctataaaaggttacgctacttttatcgatagtcaaacgatcgaagtaaacggtgaaacctatcgtgctcctaaaatcttgatcgctactggaggccgtgcaagtaaaatgaccattcctggtggagaatacgcaattgattcaaatggattttttgaattaacagagttacctaagagagcaatcgttttaggtgctggatacattgcggctgaactttcaggtgtatttcgtggtttaggtagtgaagtcatgtgggcatatcgaaaagaacgaccacttagaacgtttgataaaatgctttcggacaatttgatccaaatgtaccaagaagctggaataaaaacttacgcacatcatattgctaaagaaattactaaaaacaatgacgaatatacggtgctatttgaaaatggtgaaaccttaactggtgattgtgtactttttgccggtggacgtgtaccgaataccgaaaaattaggtctggaaaatacaaatgtggaattggacaaaaaagggtttatcaaagtagataaataccaaaatacaacggatgaacatatttttgctgttggtgatgtgatcggtaaattagatctgactcctgttgcaatcgcagctggtagacgtttatcagaacgtttatttaatggaaagaaagattcttatcttgactataaacttgttccgacagtcgtctttacgcatccaccaattgcaacaattggtttgacagaagaagaagcattggaaaaatatggcgaaaatgaattgaaagtttatcgttcacgctttaccccaatgtactttgcattaaatgattatcgccaaaaatgcgaaatgaaattgatctgtgtcggaaaagaagaaagaatcgtcggcttacatgctattggtgttggtgtcgatgagatgctgcaaggttttgccgtggctatcaagatgggtgcaactaaagaagactttgacaatacagtagccatccatccaacaggagcggaagaattcgtaacgatgcgataa

SEQ ID NO: 3614 - DNA (genomic), 1398 bp, Enterococcus faecium; double-stranded, circular
  misc_feature (B) LOCATION 1...1398
  hypothetical: NO
  anti-sense: NO
ttagttgaatttattcgtcagcaaatcgtttttggaggttacataatgggaatacgcagtcattttgcgattgcagttggaaaaacgtcgcaatgggcattaaaaactttttttaaaggcggatcaagtttaccaggtaaactagcgctgaaagtcgatccacatatactagatagtttggcaaaagactaccaagtcgtcgttgtcaccggaacaaacggtaaaacattgactaccgctttaacagtcaatattttgcgccagcaattcgatgaagttctaaccaaccctactggtgcgaatatggtacagggaattgtatcgactttcttgcaggcaaaaccaaaaaaaggacagaaaaagtttgctgtcctagaaatagatgaagcaagtttgagcaaagtcacagaatatatgaaaccagaactgttcttatttacaaatattttccgtgatcaaatggatcggtatggagaaatctatacgacctataaaatgattgtagacggtgccgcaaagtcaccaaatgcaacgattatcagtaacggtgattcaccaatcttcaattctatcgaaacagtcaatcctagaaaatattatggctttgaccatgaagaagatcgtgaacaaatggctcattacaatacagacggtgtcttatgtccaaattgtcatcacatcttgcattataaaatgatcacttatgcaaacttagggaaatattactgtccaaattgtgacttcaaacgtcctgaattggattatcgattaactgatatggtacggatggacaatgtgtcagcagatttcgtgatcgatggtcatgaatacggaatcgaagttggcggtatgtataatgtctacaatgctttagcagctactgcagtggcagagtacttcaatgtcgatcctgataaaatcaaacaaggtttaggatatgacgagaaagtattcggccgacaagaagtcatcaatatcaatgggaaaaaatgtacattagtacttgtcaaaaatcctgtaggtatcaatcaagtaatcgatatgattggtctagctccttatccattttctttagtggctttattaaatgccaattacgcagacggaatcgatgtcagctggatttgggatggtaattttgaaaactttgccgatatggatatcccagctgttatttctggaggagaccgtcatacagatatgactttacgtctaaaagttgccgggattccagaaaataaattgacagaaacaaaagaattaccagaagtaatcgaaaaaatcaaagaattgccaactgagcatgtctatattttagctacttacactgctgtattgcagcttcgtaaagaactagctgctcaaggatttatcaaaggaggaatgaaccgtggctaa

SEQ ID NO: 3615 - DNA (genomic), 420 bp, Enterococcus faecium; double-stranded, circular
  misc_feature (B) LOCATION 1...420
  hypothetical: NO
  anti-sense: NO
agaaactcttctattccaaaaacaaacagattaagagaaacaacgaatgcgtctgtaaaaaataagccaatcgaagtattcaagtggaaatattttttaaaaatgaggggagggatcgtcgtaccgccgctagaagagttgtttttatataaaatcgcaactcctaaagcaaaaatcgcacttccaaaaatgacagacaacaaccgatctgaagtaatcattgtttctggaactattgcaatgattaaaggaaaaaacaagcttccgaaaagtactttaaaaaagggttttttacctaaaaatagaagagctagtaccaacataacgatattcaacactaaaataactatagctcggtcaaatcctaaaacagcttccagtaatattcctagaccgctgacacctccagcagcaatatga

SEQ ID NO: 3616 - DNA (genomic), 420 bp, Enterococcus faecium; double-stranded, circular; identical to SEQ ID NO: 3615
  misc_feature (B) LOCATION 1...420
  hypothetical: NO
  anti-sense: NO

SEQ ID NO: 3617 - DNA (genomic), 402 bp, Enterococcus faecium; double-stranded, circular
  misc_feature (B) LOCATION 1...402
  hypothetical: NO
  anti-sense: NO
acgaaatcttctatttcgttaataataaggaaagaggtgaagtacatgaaaaaattaattggcgtacttgtcgttttaggcatatttctcggcggaagttttgcagcttatcattatttttacggcggcgaagcttattatacaaaaatcacgacgaatggcgaaatgtcagctacccaagcagataacggagagaaattcacgacttatacctacaagcaagcggcttataataaagatggtgaaaaaaaacaggtgacgcttcgcgaagaaagagaacatccattaaagatgaatgcgtatcttaaactcaaagtcaatcctcgtaaaggtgtattaagctgggaagaaataaaggcttctgaagtgcctaaaaatgcggcagaaaaaatcgataattag

SEQ ID NO: 3618 - DNA (genomic), 1029 bp, Enterococcus faecium; double-stranded, circular
  misc_feature (B) LOCATION 1...1029
  hypothetical: NO
  anti-sense: NO
ttgttgtcttctcctccccgcctacctctcgcccctcgcggtgtccctggccccccctgtttgtcctggtggcttcggcttgaagctgctcttcccgcgggccggtgccttggttttgtctgtcgccccccccggctgtgcgcatacgactncctatattatggaataaatgtcagcaatctaacagtcgaaaaagcaaatgaaaaattaaaagaagcttattctgataaaaaactggctattaaagaagatggaaaagtctggcaggaagtaccaaaatccgagctcggctacaaagatgatttcacttcggagctttctccgatcctaaatgaacaaaacggatggacttggggaatgacttatgtctcagcggcagaaaaacaagaaatagatcctgtcagtcaaaaccaccaaaaactagacactaccgttcagacattgacaactaagctgactgatttgaacaaagaccggacacctactactgatgcaacgatcgaaaaagcaggtgactctttcgttatcaagcctgaagtcaataagaaatacgatcgcgtcgatgctgcggtcaaacaattaaaaagtgcggtaaactctggtaaagatacaattgaattgactgaattcaaagaaaaaccaaaagtaacatctgaagacagctcactgaaagaacaactcgcatccatgaatgctatcgcaaatgtaaaagctacttacagtataaacggtgagactttccagatcccatcaagtgatattatgagttggctgacctacaatgatggaaaagtcgatttagatacagaacaagtacgtcaatatgtaacagatttaggcacaaagtataacacaagtacgaatgacacaaaatttaaaagtacaaaaagaggagaagttacggtcccagttggcacttacagttggacgatccaaacagacagtggagacagaagcattgaaaaaagcgattctggcaggccaagattttactcgttcacccattgtgcaaggtggcacaaccgctga

SEQ ID NO: 3619 - DNA (genomic), 306 bp, Enterococcus faecium; double-stranded, circular
  misc_feature (B) LOCATION 1...306
  hypothetical: NO
  anti-sense: NO
ccagaccctttggtgaatatacgcacatcacagcggtggagatgcttacaaaatcacccaacaaaaacagagtatcaaggagtttttttggctcaagaacaaaaactggtgcctgtgacaatggtccagataaataaagcaaatcaatttatctttttatttgaacacggcaaagcaccacttgctatgaaagacatctttctttttttgatgaagaaccgtgagaaagctgtttattatcagtcaaaacaagaactcattcctctttatggagtgaaagagatagagaataaagtggtgatataa

SEQ ID NO: 3620 - DNA (genomic), 939 bp, Enterococcus faecium; double-stranded, circular
  misc_feature (B) LOCATION 1...939
  hypothetical: NO
  anti-sense: NO
aaaagtgaatttatattgaaaaagaaaaaaaaaagtaaagccggggaatattccggtatgaaaggaatggagagaacaatgaccatccaatggtttccgggacatatggcaaaagcccgacgagaagtttctgaaaaaatgaaatatgtggacatcgtatttgaattggtagacgcacgattacctttatcttctcgtaatccaatgctagatcagatcattcagcaaaaacctcgccttgttttattgaataaagcggatctggcagatccacaacagacaaagctgtggcaagaatattttcgtaaacaaggccatcttgcattagctatcacggcacaagaaagtaaaggaattaaaggtctagtacctgcggctaaagaagcattgaaagaaaaacgggcaagagatgctgctcgggggatcaagcctcgcgctattcgggcaatggtcttaggtattccaaatgttgggaaatctacgttgatgaatcgactagtaggcaagaaaattgcacagacaggaaataagcctggcgtaacaaaaggtcagcagtggcttcgtttaggtaatgagttggaattgttagacacaccagggattttatggcccaaatttgaagatgaagaaatcggcaaaaaactagcgctgacaggcgcgatcaaagaccagcttgtccatttagatgatttagcgatttacggattagacttttttgcccgatattattcaggaagaatcagcgatcgttatggtttatcaatcgagcaagaagaaaaattggcaccggaattactgatggatattacagcaaaacgtgggtataaagaagactatgatcgtggcagcgaattagtcgtgcatgatattcgtcaaggaaaacttggacgatacacactggatcgttgcgaagaaatggagcaaaaaagtgatgactga

SEQ ID NO: 3621 - DNA (genomic), 186 bp, Enterococcus faecium; double-stranded, circular
  misc_feature (B) LOCATION 1...186
  hypothetical: NO
  anti-sense: NO
agtttaccttcaggacttcncaacgattattatgaaaaacttatccaacttgcttcggatgaaggagtagcagtcgttttggattgttcaggtgcacctcttgaaacaattctaaaatcgtcggttaaacctactgccatcaaacctaataatgagaactttcacagttgcttggaaaagaagtaa

SEQ ID NO: 3622 - DNA (genomic), 225 bp, Enterococcus faecium; double-stranded, circular
  misc_feature (B) LOCATION 1...225
  hypothetical: NO
  anti-sense: NO
ctgtcgccttcaaataaatcatcttcgattgccatggaagtcaacacatgtccaggttgcagggtaaactgttctgcaatcgctgtttggatcgtctgtgctagaatacagctgatggctatacttttgacatacgtagattttcctgatgcattggaacccgtgactaatgtattcttctgccagttgactggattaactaccgcttcttttaacaatggatga

SEQ ID NO: 3623 - DNA (genomic), 1935 bp, Enterococcus faecium; double-stranded, circular
  misc_feature (B) LOCATION 1...1935
  hypothetical: NO
  anti-sense: NO
aggcttacttcgattagaacagtcggaattagctatttggtagtaaaaagaggagaaaatacaatgaaacatccagtaccactattaaggaccagacaggattactttgacttatttaaaaagataaatcaaccactccagccgttttatcgagcaagtggcgcacaaattgattatatacatcaaggggtaggatatggaaataaaattgcaggaatggaaggattctctcgggttttatggggagcggggcccgcaattgaccaattagatgaacgatggttgaaattaattctatcaggaataaaagctggaacagatccttcccatcccgattattggggagaaatacatgaaagagaccagcgtatggtagaaatgcccgcaatgttattagcgttatatcatcatgaacaattattatggaaaaaattagatacaggagaaaaaagccagattattcattggttctcgcaaatttttgaatatgaatgtgcagatggtaattggcaattttttaagataattgtcggaacaattatccaaaaatttggttatccagttaaagaatcagcactgaaagaagcatttgataatatagaaaattgttatcttcaaaatggctggtatcgagacagttcaagaggtcgccaagattattataatccttttgcatttcattattatggtttgatttatagcgtactagaaccagaaaagcccattagccagatatataagaaccgagctattgatttttctagagactatattcatttttttgcggaagatggtgcaaatgtgccttttggtcgaagcatgatttatcgttttgcagtttcaagcttttggtcagctatgttgtgggccgatcttttgccttttaaattaggtgaaatcaaggggttagtcaatcggaatataagatggtggatgcaaaaagaaatatttgatgaaaaaggtatcctgaatattggttatacctaccctcaattgacattgactgaaccctataatagtacgttatctccattatggctgaataagatttttttattgttggcgctacctgaagaccatgagtattggacggctaaagaaatgcctatgcctattcgtgaaggaactaaacttctttcagaagccaatttgctcatacaacatgataatggacatacattttttttgaatgcgggacaattagggccaaatttccatacattgaccaatgaaaaatatttaaaatttgcttattctagtcaatttggtttttcgataccgcgagcgaatcaattgaaagcagaaatggcaatggattcaatgctagggattcagcgagcggacacatatatcacgaccagttttaagaatgagagcatcaaaacctatggacagttcatcgttcgaaataatgtacgagacattgtatgtaagaaagaggtacttgcctctacatgggaacctactttacaggcaaaaatcagaacttggcttattccttttgaaggctggcagattcgcgtacacaaagtagaattagatacagaatatgttctatatgagacagggtttgctattgaatgttctcctgagaaagaaggaataatcatagaagaagacaaggaaaactatagggtgagtgaagctggcttttcaggtattatctgtttaagtgacgatactattaaacgaaaatccacagctattatgggtttgcccaatacaaacttgatgacatgggaaaacacttttattcctggattagagggtacatttggaaaaggaacccattggctcggaacaggagtggttgctcatcaagatcgggattatagtttagaagtatggaacaatcgtcccaaaattgattttgatgggacaaccgggctaactatccaaaataaaaacaataaaaaaagactaaaattatgctaa

SEQ ID NO: 3624 - DNA (genomic), 246 bp, Enterococcus faecium; double-stranded, circular
  misc_feature (B) LOCATION 1...246
  hypothetical: NO
  anti-sense: NO
atgattacttccgttgaaatcacgaaaaaatatcagcaatcagtcagagaactcgttgccctggctgtccaagctggcgtacctgtaccgactttctcatcagccatcgcttacttcgattcatacagagcagaacgtctgcctgcaaatataatccaagcccaacgcgattactttggcgcacatacctatgagcgtgtcgacaaagaaggaatcttccattactcatggtaccatgaagaataa

SEQ ID NO: 3625 - DNA (genomic), 195 bp, Enterococcus faecium; double-stranded, circular
  misc_feature (B) LOCATION 1...195
  hypothetical: NO
  anti-sense: NO
aaattcgaattaaagagtgagaatatgtgggagctaatttatttagttttatacttaataggaaaatcaactgaatttgtatataacaataaggtaatatttatattgttcttaatagtttgtattatcgtatttgatgtctatgatttactaattcataagaatgaaaatagtaatattggtagaattagataa

SEQ ID NO: 3626 - DNA (genomic), 1053 bp, Enterococcus faecium; double-stranded, circular
  misc_feature (B) LOCATION 1...1053
  hypothetical: NO
  anti-sense: NO
atggaaacttcacaaaaaatatcaccgaaaatttttctgaataaagtcctcgctggtacagcaacaggaatcattattggattgattcctaatgcagtattaggtgccattttaaaatattttagtgcgtatccctttgcggtaacgatcgcacagttagcagttatttttcaactagcaacacctttgatcattggtggtttgattgccttacaatttggatttgatccgatgagaatgatggttgtagccggagcttcttttgttggttctggtgtaatcaaattcacacctgatttgggtgaaacgggtgtttacgttggtgctggtacaggcgatattattaatacgatgctgacagcatcgattgctgtcgggctgattttactgattggaaatagttttgggtcagtgtcgattgtgttaacaccgattgttgtaggtgtaggtgcaggtttacttggtttttatttattcccttttgtaacagcaattacttctgcaattggatcattgattaataacttcactaccttacaaccgctgttaatgtctatcttgattggttgttcctttgcctttttgattatctctcctatttcaacagtagcaatcggaatggcaatccaactagatggtgtttctgctggtgcggctgcgatgggcgtagctgcaaccacttttgttttagtagtgaactcttggaaggttaataagtcaggtgtgacaattgcgattgctttaggcgctatgaagatgatgatgcctaatctatttagaaaacctgtgattcttattccttgtttagttagtgcagtgattacagctattcctgtcgctctattttctatttcaggtacgcctgcttctgctggtttcggcgtggtcggacttgttggtccgttggcttctttagatgcagggctaaatggctttcttgttgttctttgttggttagtcatccctgtttttgcggcactaattactcaatttttatgcgagaaagtatttaaactgtatgatcgagaagaagtcttcaaatttttaggctag

SEQ ID NO: 3627 - DNA (genomic), 324 bp, Enterococcus faecium; double-stranded, circular
  misc_feature (B) LOCATION 1...324
  hypothetical: NO
  anti-sense: NO
gcaccgacttcaaacgctgcctcttccccgtattcgcgaatacgttcatccatttctttacgagatttctcgaccatttcttcgatacgcgctggatggattcgtccatcttgtatcagtttttccaaggtcatccgtgcgatttctcttcggattggatcgaatccggaaagaacaactgcttccggtgtatcatcgatgattaaatcgataccagtcagcgtctcaagcgttcgaatattacgaccttctcgtccaatgatacgacctttcatttcatcattcggaagggtaacgactgaaacagtcgtttctgaaacttga

SEQ ID NO: 3628 - DNA (genomic), 1452 bp, Enterococcus faecium; double-stranded, circular
  misc_feature (B) LOCATION 1...1452
  hypothetical: NO
  anti-sense: NO
aggcacgaattatgccaagctcagaatttttattgggtcattcactccaagcctttgatgagcaaggacgactcattgatgaagaacaagtcgcaaaattacgtgaactattcaaagatttcttactctttgtcacaatcactagtcaattgcaacatgcgcaccaagcaaataaacgtgaagccgaaagcttttcatgggaaacgatttaatcgaggggagcaaacaaagatgaaattaataggtatcgtcggatcagcagctgaactttcatataaccgtaaattattaacatttatccaaaaacaatatcatgaactatttaatttagaaatcattgaaatcaaagatttacctctgttcaatcaagatgatgatcaaacaaatagtcctgctattcaacagctaaatcgcaaaatcttaatggctgatggggtaattattgctacgccagaacacaatcatacggttccagcaggattgaaaagtgcacttgaatggctatcatttaaaatccatccacttgaaaataaacctgtaatggttgtgggtgcttcttactacgatcaaggaacttcacgcgcgcaattacacttgcgccaaattttggacgcaccaggcgtgaatgcattagtgatgcccggaaatgaatttttattgggaaaagcaaaagaagcatttgaccaagaagatcgcttgattgatccacgaactgttgactttttaggcagtacattagcaagttttgtaaaattcattaaagtcgtgtctaccttagcagggcctaaaaagcttccaccagaagatttgcatgcgacaggaacaattgctacgacaatacccgatgttgatatgtcagatgatcattggttggaaaaagcttctgaagcagtcggtgccgtttctggaaatacttacgtcaaattaaatcgtgggttattgacagtggatcaaatcaattactttttagattcgatgccgatggaattaacttttgcagataataataaccaatttttatattataatttgcgccaagaagcgaaagagatgttagctgctcgtgtgcccggtcaggtagggaatccattagccaactgtcacccagaaaaatcgtataaaaatgtagagtgggtaattcaacaactgcgaagcggagcaacagatgcggtacgtgttcatgtaccaaaacaagtgccagaaaaatatattgtgcataattaccaagcaatgcatgatgaaaatggagagtatgctggaatcaatgaatacattcttgatttcaaaccaatcattgagtggtatttacaacaaacgggtcaacaacttgttggaaatgaagatgcggtttcaagtgcatctgttcatggtggaaaaacagatgcagtaaccagcgccagcacacacgatgaaactgcagtagatgcagtttcgagtgcttctgtaaaataa

SEQ ID NO: 3629 - DNA (genomic), 399 bp, Enterococcus faecium; double-stranded, circular
  misc_feature (B) LOCATION 1...399
  hypothetical: NO
  anti-sense: NO
ttttctgcttctgcacccattttgccagcgcgtttttgcgttgcagttcggggttatcccgcagggcggtctgccatgcaaggtcagtgtgcgcccgcgccgctttctgctgggctttccgcaaagtgcggtagggtttggagcggcggcggttccgttccccggcgcaggacgcgccccgcgccctgttcggcaaccatttcgattttgtgggcagattccagagccacgttgtcacgctcatattcacggagtttgccatgcagctttaagactgccgccgtttttgccgcatttccggcacgggaggacagggagggcttttggtactccggcaggatttcatcctcaaaacggagccgccgctttatcttcccgctggcttcgtcaggctggtga

SEQ ID NO: 3630 - DNA (genomic), 903 bp, Enterococcus faecium; double-stranded, circular
  misc_feature (B) LOCATION 1...903
  hypothetical: NO
  anti-sense: NO
atgggtgcttcattaaatgaaatcaagacacgtatcgcttcaacgaaaaaaacgagccaaatcacgcgggcaatgcagatggtgtctgcttctaagttgacaaaatctgaagcttcttcacagaagtttcaggtttatgcaacaaaagtaagagaaatcgttacgcatttgactgctactcagttaaatgatattgcctcagaaaatcctagaggggatatcaattacaacagcatgttgctcagccgtcctgttaagaaaacgggttatatcgtcatcactgcagatggcggtttagtcggtggatataacagctcgatattgaaacaaacgatgtctattttagaagaagaccaccaatcacccgatgattacgtgatgatcgcaattggcggaactggtgcagacttctttaaagcacgcggtatcaatctagcatatgagctgcgcaatctatctgatcagccaagctttgatgaagtccgcaaaatcgtaaatatggcaacaactatgtaccaaaacgaagtattcgatgaattatacgtatgttataaccatcatatcaattcgctaactagtcagtttcgtgtagaaaaaatgctgccaatctcagacttagatccagaagaagcaactactttcgaacaagaatatatttttgaaccttcaaaagaagaaatcttgtctcagttattgcctcagtatgctgaaagtttgatctacggtgcgatcgttgacgccaaaacagcagaacatgctgctggtatgacagcaatgaaaacagcaactgataatgctgctaatatcattgatgagctgacggtttcttacaaccgtgcaagacaaggggctattacccaagaaattaccgaaattgttgccggagcttcggcactagaatag

SEQ ID NO: 3631 - DNA (genomic), 420 bp, Enterococcus faecium; double-stranded, circular
  misc_feature (B) LOCATION 1...420
  hypothetical: NO
  anti-sense: NO
aaaggcgaattttttaattataaaaaaaggtgtgtgttcactatgggaaaattagtcgctgttgcacagtcgctgcttgatatactcaagtggctgatggaaggaagcaattggatatttgtgttgccactattgcttattagtctatttatcatgtttcgcatggtcagaaaaaaagaaacgtttctgatttttatctggtatgcagcatccgttggggttgctaccttgatggttgaattggcgttaggtagttgggaagcttgcgtatttgctttattttttgctgtactgtatctaatcatttatatcccatatatgaaaagaaagtctcggataggcagaaaaggtagacatacaactactttttctagtacagattctctcgaacaaagtagaagaacgagaagaagacggtaa

SEQ ID NO: 3632 - DNA (genomic), 516 bp, Enterococcus faecium; double-stranded, circular
  misc_feature (B) LOCATION 1...516
  hypothetical: NO
  anti-sense: NO
atgtcagaatttttcattcaggaaaagcagcttggacgtgcaactcggacaattgtcaaaaacgaaaaaggacattccctgtttttgatggttggtcgctggggaacaaagggcgatgcattgtctctttatgccatgaatggcgatctcgttgctcacatcaagcagataagcctgacattcggtacgcgttttgagctgtataaagagttcgaaaaggtgggaaccatgcagaaaatattcaattggcccggtgacttttattatattcgtagacttcactggacagtccaaggtgatatctataatcatcaatatcaaatccatcatttcaatcagcaaatcatgaaaatggataaagcaacacttttttcaggagattactatgtattggatgtctcaaatgatgaagatgctccagtttgtatttgtattgctgcggttttagattactggctctaccgtaaagacaaaagtcgcgataagcctgtttcttaccgacttaacttaagttaa

SEQ ID NO: 3633 - DNA (genomic), 945 bp, Enterococcus faecium; double-stranded, circular
  misc_feature (B) LOCATION 1...945
  hypothetical: NO
  anti-sense: NO
atgacagaattaatcacaatcaaagacctgaaagttcattaccctattcgcagtggattcttcaatcgagtaacggatcatgtatatgctgtagatggtgtggattttattatcgaaaaaggaaagacatatggtttagtgggagagtctggctctggaaaatctactacgggaaaagccgttgtgggattagaaaaggtaacagccggacaaatcatgtatgaaggaaaagatgtaacgaagcgaagcaaccgcaaaaaaatgggttataacaaggatgtgcagatgatcttccaagattcaatgtccagtttgaatcctaaaaagcgagtgttggatatcattgctgaacccatccgaaattttgaacggttaagcgatcaagaagaaaagaaaaaggtaaaaggactgctagatatcgttgggatgccggaagatgcgctatataaatatcctcatgaattttcaggcggacaacgtcaacgtctaggagtagcccgtgctgttgctaccaatccaaaactgatcgtagccgatgaacctgtatctgctctggatctatctgttcaagcgcaagtattgaatttcatgaaacgaatccagcaagaatacggcctcagctatttattcatttcacatgatttaggtgtagtaaaacacatgtgcgacaatatcgcaattatgtacaaaggtcgatttgtagaaatcggtacaagagaagacatttataatgacccgcgacatatctatacgaaacgtctgctttcagctattccgcaaatcgatgtagaaaatagggaaagccacaaagaaaatcgacgaagagtagaacaagagtatatccaaaaccaaaaagaatactatgatgcgactggtcgagtctacgatttgcgtacgatcacaactacacacaaagtggcgttgaaagatggaggtgcaagctaa

SEQ ID NO: 3634 - DNA (genomic), 855 bp, Enterococcus faecium; double-stranded, circular
  misc_feature (B) LOCATION 1...855
  hypothetical: NO
  anti-sense: NO
atggcagaattgattaacggaaaagaattagctgaaaaaatgcaggcagagattgctgaaaaaatccaaaaattgaaagataatggtatccatcccggattagttgttttattggtaggggaaaatccagccagccaaatctatgtaagaaataaagaacgtgtagcaaaagaaatcggaatccattcattggtagagcgttatcctgagacgatttctgaagacgaactacttgcagaaattgaaaaatacaatcaagatcctagttttcatggtatattggtccaattaccattgccaaagcatatagatgaagaaaagatcctgttagctatccgccctgaaaaagacgtagacggttttcatccgatgaatttaggcagactccttgcgggtaaaccggacaagattccttgtactccatacggcatcatgaaaatgtttgaagcttattctatcgatccggcgggtaaacgagcagtagttatcggacgaagcaatatcgtcggtaaaccgatggctcagctactcttgatggcagatgcaactgttactgttgctcattctaaaaccgaaaatctggctgaactggcacaagaagcagatattttagtcgtagcaataggacgtggacattttgtcacaaaagaattcgtaaaaccaggtgctgtagtgatagatgtagggatgaatcgtgatgctaacggtaagctgatcggtgatgtgaaatttgatgaagtggagcctattgcaggctggatcactcctgtgccaaagggtgtagggccaatgactatcacgatgctgatgtatcaaaccgtaaaatctgccgaagcttttggagcaggtgaatag

SEQ ID NO: 3635 - DNA (genomic), 183 bp, Enterococcus faecium; double-stranded, circular
  misc_feature (B) LOCATION 1...183
  hypothetical: NO
  anti-sense: NO
acaaaagaattaattttgtggcagtcaagtaacgacagaaatagaaaagaaagaggctatgcgagagtgaatcaacaagttaattgggttaatgattttgaaaaagaatttcgactgaaattttttggaaatcctacagcagaaagtacagaagaaaaaaattatgactggtcagaattttag

SEQ ID NO: 3636 - DNA (genomic), 540 bp, Enterococcus faecium; double-stranded, circular
  misc_feature (B) LOCATION 1...540
  hypothetical: NO
  anti-sense: NO
tacctttattcaataggattagtttctacaaaaaatgaaaggagaaaaataaatatggaacggtttatagcatcaaatgccacagtgattggtgatgtgacattgtcagaagatgtgacgatctggtatcaagctgttttacgcggggacagtaattggataaaaataggacaaagaacgaatatccaagatggtacaatcatccatgtcgatcatgatgcacctgtagatattgcggagaatgtgacggtaggacatcagtgcatgctacatggctgtacaatcgaaaaaggggcgctgatcgggatggggaccacgatattgaatcatgcggttattggtgagaatagtttgattggtgctggatcattagtaacagaaggaaaagttattcctcctaatgtcttggcttttggtcgcccagctaaagtgatccgtcctttgacaaaagaagaaatacaaaaaaacaaagaaaacatccagcattatgtcgagataggtcggatgcatgcgcaaggaaaattcaaggagcaaagatag

SEQ ID NO: 3637 - DNA (genomic), 642 bp, Enterococcus faecium; double-stranded, circular
  misc_feature (B) LOCATION 1...642
  hypothetical: NO
  anti-sense: NO
tccatttattccgaaaaaggtgttacgatgtctgaaattgctgatttgatcgaaaaaatgtacggtcatcactatactccacaaaccatgtccaacatgactaaagttctgactgaagaagtaaatgcctttaaatccagagccttaaatgataagtatgtcgctatttttatggacgctacttacattccactaaaacgtcaaaccgtatccaaagaagcgatttatattgccattggtatacgagaagacggcactaaagaagtactgagttatgcgattgctccaactgaatcaacatacgtttggaatgagctgctacaggatattaactccagaggagttcaagaagtcttgctttttattacggacggcttaaaaggcatgaaagatactatccatcaaatttatcctaaagcaaaatatcagcattgttgtatccatgtatctcgtaacatcgctcataaagtacgtgtcaaagaccgaaaagaaatctgtgatgactttaaggctgtttatcaagctaactcaaaagaagaagcgaataccttcttatccggcatgattgagaaatggaagaaaaactatcctaaagtgacgcagtcactcantagaaaaccaagacttattaactttttatga

SEQ ID NO: 3638 - DNA (genomic), 438 bp, Enterococcus faecium; double-stranded, circular
  misc_feature (B) LOCATION 1...438
  hypothetical: NO
  anti-sense: NO
tgggattattcacaaggaacaccgatttcaatccaattgcgtacaaaagtaaaacagcaaggggaagtgcaagatttttattttgatttgaaagggcaaatggtgacaattggcgatacgctgtacatacgttatatagagattcaggaggagacgggcgatgagattcctgtaacgatcaaattagttccagatggtcatgtacagctgatccgtgcaggagaaatgcggatgcgtttgaaatttggctatatagaacggttagaaacatcctatcggacaccatacggtatgatccagattgctacttttacgaaagaactgcatgttagtttgaaagaccatcccacaggagggaaggttcgaatcgattatgatctgttcatgggaccggaaaaaatcggcgaatattatttgaccttggattttacagcgtaa

SEQ ID NO: 3639 - DNA (genomic), 1971 bp, Enterococcus faecium; double-stranded, circular
  misc_feature (B) LOCATION 1...1971
  hypothetical: NO
  anti-sense: NO
aaaggagaattgaacatgattgtaagtaaaaaactagcaagaaatctagtaagtgaagggtatgacttaagattagtagaaaagtatcaaccgagcggtggaattaaatttgatgagcgttatatttctactggtgatggatatgtaacttcgattgctgttattgagtttgcagaagatgtaaatagtcgatggttaacggatataatggcaattccaaatactattgcaactttcgatgtatgtacggcggataaagaagacttattacacaaaatcaatacgtctattggagaattagattaccgatcaacaaatgagaatagaacaactgacaaaacagacgctttactagataaatacaatttagaagattttgcacaagaaattacgaaacgtggtgaagttgtcaaaactgttcatgctcgtatttttgtttatagcgattctttagaagaattagagaaaagaattagtgagattcgtaaagatttggctagtgtcaatcacaaggcaattgttccgcaatttagaatgaaggatgaatggatgtctttatttcaagatggcatggaacaagaatcaaaattatttgccaagaaaggcttaactgttccggcaaaaaatattggtggcggtattccatttcaccacaagagtttgaaagatccacgtgggttttatttaggaactacgtcaactggtggtgcttttatatttgatccattttattctacgaagcaaagacggtcgtttaacggctttattttaggaaagatgggttttggtaagtcaactttaattaaacagctacaggaaggcctacaagcgaaaaattgttttattcgaggatttgacaagtcaggtgaatttgaaggcatggtgaagaaagcaggcggtgtatacgtcgatttaggcggtggtgatatggtagtaaatccattgcaaatttatgcaacagtcatgaaaaaagatcaatttggaaatgatgttgtagatgaatcaaagagttttcaaaatcatatcactaagtgtagtaatcaaattcgctttttagaacctgaaattgatacggcaactgtacgtgaatatactttgatgttacaagacttttatattcattatggaattttgccaaaagaatggagagaagcgagagacgacaacgaacgaaatcaattaaatacaaatatttgtaacttgcctaatgattcatatccaatctatggagagtttcttaaatttattgaaaatcaacaattcaaaattaaaaatgctactcctgaacgtgtccgttctattgagctaattaagcttatcgttacggatatgtgtacaacttatccgcaaattttcaacggagtaacaacaatgccaaactttgatacaacaaaaattgtttactataacattgattctattagtaaaatgagtgccccagtattccattgccaattatttacagcgttaacgactatttggaacagtgccttgcaaaacggaaagattcaaaaagaaaactttaaaaaatatggcagtgattattataagtatgcacaagatttcatggttttgatcgatgagtgtcacaatgttatcaattcaaataacaagtatgcttgtgaatatgtactaagttttgagcgagaaatgcgaaaaatgcgtgcaggtgtttattttgcaactcaaacgcctgaagaaattatccctaaagattctggatcagaagtagcagatgtgattagaaacatttttaatctatgtacttttaaatgcttctttaatttagattctgcattgttggaagacataaaaaaagttttaggaaatacaattactgatacagaaattatgcttttaccagaattagaagtaggacaagctgtagttcaaacttccagtgaagacacctatatgattaattttgatccatatccagagcaaattgaacgattcgatggtggtcaataa

SEQ ID NO: 3640 - DNA (genomic), 1443 bp, Enterococcus faecium; double-stranded, circular
  misc_feature (B) LOCATION 1...1443
  hypothetical: NO
  anti-sense: NO
ttgatgtattcactaatgaaaaaaatcattaccgaaaaagatattcgacgtcatgtttctttagtagaacaattgctgaatcatacaaagataaccgtaaatgaattagctgaaatcatagggacaaccgaacgaacgattttttctgaccttcaatctattcgctctcagctgcccgaaggctgggacatcatcagcgatcaagcaggaatcagtttgcaaaaccagcaaaatttattaacaaatgacctttgggagatttttttcaaacaatcagtcagtgtcgaactgctgaaaaatctgctttttacaaaaaaagttgctgtccctgattttctagccgaccatgggctttcttatgggacattgaaaagacatgtgactaaaatcaatcagcgtttagcaagttacgacttgcagatcgatttgacgaaatatacagcttgtattcttggaaaagagcgtgcgattcgtactttttatcatcgattgctgattcctttcactcataacaactattttttcgaggattattcgatccatgaatcccattattttcaatttttaagaaacctcagtcaaactgaactagcggttgaaacagaagagattttcggaacatgttggttctttatcaatacgatccgtataaaagcgaattgccgattagattcttctatccataccaacagcacactctcctccctgtatgactctgcattgaaaaaattgtatttaacggaaggtatttatcttaaagacactgagctttcttttgcttctttctgctttctggaaagttggaattacaacaataactatggacaagaaaccgctcgctgcctgcatcattctccatttttagaggtcctcgaaacgtttgtagaggaactagcttcagagctgtctcttgatcaactaaaaaaaacatctctgactgataacttggctctcctcatattaaaatatcatgaatcgccgatattgattgaagcattggaccgtcaataccatcgttttttagaaacatatgatcagcaatatgcacacttgtatcaacagaaagagaatttactgaacgatctaaaaaaagaaatagaaatcaatgaaccaaattactttctccaactcttgtctctactgatccaacaaacgattttttctatcaaaccgaatttgttcaatgtctattttattttccaaggagaaccttcatggaaggcgttcttgcagcaggaattaaaagattacttaggaaaacgtgtctgcttcttacctatcgaactaaccgatctttccactatttcttttgaaaaaacagatatcttgatttccaatttccctctagattctctagatatccctattgtatacatttcttctattccaacgaaaaatgagctcaatcgtttgactgaactcactttcaaaacttttttatag

SEQ ID NO: 3641 - DNA (genomic), 1245 bp, Enterococcus faecium; double-stranded, circular
  misc_feature (B) LOCATION 1...1245
  hypothetical: NO
  anti-sense: NO
gatatggaattctcaattgataataatatcaatgacggcgcagtaatcaaagtcatcggagtcggtggtggcggtggaaatgctgtaaaccgaatgattgaagaaaacgttaaaggtgttgaattcattacagccaacacagacgtgcaagcattaaaaaattcaaaagctgaaacagttatccaattaggccccaaatatactcgtggtttaggtgctggttctcagccagaagttggacaaaaagcggcagaagaaagtgaacaatccttacgcgaagctttagacggtgcagatatgattttcatcactgcaggaatgggtggaggaaccggtacaggtgctgcaccaatcgttgcaggtatcgcgaaagaattgggcgcattgactgttggtgtcgtgacacgtccattcacttttgaaggaccgaaacgtggccgttttgctgcagaaggtatcgctcgtttgaaagaaaatgtggatacattattaattatctcaaataaccgtttattagaagttgtagataaaaagacaccgatgcttgaagctttccgtgaagcagataatgttttacgacaaggtgtacaaggtatctctgatttgatcacagcgccaggttacgttaaccttgactttgctgacgtgaaaacagtgatggaaaaccaaggtacagcattgatggggatcggtgtggctagtggagaagatcgcgtagtagaagcaacgaaaaaagcaatctcctctccattgcttgaaacatctattgatggagctgaacaagtacttcttaacatcacaggcggtttggatatgacattgttcgaagcacaagatgcttcagatatcgtagcaaatgcagcaactggcgatgtaaatatcattctaggtacatctatcaatgaagaaatgggcgatgaaatccgtgtgacggtcatcgcaacaggtatcgatgaatcaaaaaaggaacgcaagtctagccgaccagctagacaagcacaaatgcaatcacctgctcaaaagactgtattagatatggatcaagctaaaccaacttcttcagaagaagaaaacagttttggcgattgggatatcagacgtgaacaaaatgttcgtcctagagttgatgattccaattttgacaatatcgaaaaaaaagaatttgatacattcaaccgcgaagaaacaaaatctcatggcgatgatgaattaaatacgccaccgtttttccgtcgtaaaaaataa

SEQ ID NO: 3642 - DNA (genomic), 213 bp, Enterococcus faecium; double-stranded, circular
  misc_feature (B) LOCATION 1...213
  hypothetical: NO
  anti-sense: NO
caaagacattcgccactcttgtttttatttcttctatttcatgactgttcaagacgaccttcaaattatccaacactttttcgaatttatccaaaagtagcagaagttcgtcgtcaaaagaaggataaccaatttgtagtcggaataaaaaacgatcgagctgtgcttccggcaaaggatatgttccttcatactcgattggattttgtgtag

SEQ ID NO: 3643 - DNA (genomic), 567 bp, Enterococcus faecium; double-stranded, circular
  misc_feature (B) LOCATION 1...567
  hypothetical: NO
  anti-sense: NO
tatacgcattctattgatcactgtcaatatctcaatttttattttcatttccttttggtcatactccacgatttttggtacgataagaataaaggaatcaatacatctctgctattcatgacaaggaggaatatgatgaaaaaaatagttggagcggatgaatggatacgcgcagctagctgctttttgagatatcaagtttttgtattagaacaagggattcctgcagaactagaattcgacggaaaagatatcccgcaacaaacctattatctatttcttgatcaaaaaagaccagtagctactttgcgttatgaaaagaaaacacctacttgcttcaagccggaacgattttgcgtagcaaaagaataccgaggaaaagggttaggcggtcagttgcttgaagctgctgaaaaacgggcggtttcagaaggttgtcagactagttatgtagtagctgaaatgacggctgtagatttttatgaaaaacaagggtatcatacttgcacagaaccttttattgaagatgaagtactttgtatcggaatgaaaaaaagtctagcttaa

SEQ ID NO: 3644 - DNA (genomic), 1023 bp, Enterococcus faecium; double-stranded, circular
  misc_feature (B) LOCATION 1...1023
  hypothetical: NO
  anti-sense: NO
atacagcattccaagaatgggcaaaggaggaatagatccatgcgtgccatttcaatcaagcatcctggttctgtagatgtattagaacaaattgaagtgcctgttcctaaaccaaaacaaggcgaattactgatcaaagtccatacagcagctgtcaatcgaacagatattatgaaaagagaatcagtctctttgaaacctccctaccctattttgggagtcgaagtagctggagaggtagttgagaataaaagtgatatctccacttttactcctgggacaaaagtatacggattagtcaatctaggtggttatgccgaatatgctgtgatgcctgccgatcgtgcaatccttctccctgatacgctagactatgtttctgctgctggaatctcagaagtttttttgactgcttatcaaacactttactggcttggaaaattacaagaaggcgaaactgtcttgatccatgcaggagcaagtggtgtgggaacagcagcgatccaattagctagacagctttctcacgcgaaaatcatcgttactgcaggatcagaagaaaaactcgccttttgtaaagaacttggtgcagatgaattgatcaactataaaaaacaagactttcaagaagaggtacgaaaaatcactgaaggtcggggagtcgatgttattttggatttcatcggcgcttcttactgggaaaagaatttagcttctatagccgttgatggacgttgggtcttgattggtatgctaggtgggaccatcgtgcctgagatagaccttggtgtattgattgggaaacgtgtccaactgcttggtacattattgacacctagaagtgatcagtataaagcagagctcgcacaaacttttatgcaaaaagctgggccttttctagaaaatggcaagattcggccaatcattgaccgtacattccaattcagcgcagtcaaacaagcgcatgaatatatggaagcaaacaaaaacatcggaaaaatcattttgaagataactgaataa

SEQ ID NO: 3645 - DNA (genomic), 1599 bp, Enterococcus faecium; double-stranded, circular
  misc_feature (B) LOCATION 1...1599
  hypothetical: NO
  anti-sense: NO
ggggggcattctatggtgaagagaccggctaaattatttcataagcatcgacttattgaacatacaaatggtttatctttagctgaagtaaatggaacagttgatgtaccaaaggggaaaagtttttttaaaacacttcttgcttactctggacctggtgcgttagtagcagttgggtatatggacccgggtaactggtctacttcgatcaccggaggacaaaatttccaatatttattgatgtcagttattttgatgtctagtctgattgctatgcttttacagtatatggcagcaaaattaggaatcgtgagccaaatggatttggcacaggcaatccgagcacgcacaagtaagacattaggtgtcattttatggatcttgactgaattagccattatggcaacagatattgcagaagtcattggtgcagcaatcgccctctacttactttttgatattccattggtgattgccgtctttattactgtattagatgttttcgttctcttactactgacaaaagtcgggtttcgtaagatcgaagcactggttgtctgcttaattttcgtcattttattcgtttttgtctatcaagttggcttgtctaacccagattggcacagtttatttgctggctttatccctaacagtcatacattctcagactcaccggtcatcggcggcgaaactccgctgactggagctttagggattattggtgcaacagtcatgccgcataacttatatcttcattcagcagtttcacaaactcggaagatcgatcaccaaaacgaagaagatgtagcacaagctgtacgtttttctacttgggattctaatatccagttgtcaatggcttttctagtcaatgcactgctattgatcatgggtgtcgctgtcttcaaaaccggttctgtccaagatccttccttttttggtctgtatgaagctttatctgatccatcagctatgagcaatggtattttgattgctgtagcaaaatctggtatcttgtccactttatttgctgtagcacttcttgcttctggccagaactctactattactggtacgttgaccggtcaagtcatcatggaaggattcatccatatgcgtatcccgatttggctaagaagactggtcacacgattgctttctgtgattcctgtattgatttgtgttttgtttacaagtacaaaaggaacgatcgaagaacatgccgctttgaataacttaatgaatgaatcccaggtgttcttggcttttgcgttgccgttttcgatgattcctttactgatgatgaccaacagccaagcggagatgggtagccgatttaaaaattcattcatcgtaaaacttcttggctggttctctgtgattagtctaacttacttgaacttacgaggattaccaggacagatcgaaagtttcttcggcgagcaagccacttccgctcaactagcattggctgatcacatcgcttatgtaatcattgttcttgtccttctcctgttggcatggacgattggtgatttatataaaggaaacaaaaaatatgaacagcttttgcaggaaacggtagaagaaatcgaataa

SEQ ID NO: 3646 - DNA (genomic), 423 bp, Enterococcus faecium; double-stranded, circular
  misc_feature (B) LOCATION 1...423
  hypothetical: NO
  anti-sense: NO
gtgaaggaattgaaaaagcaaagcaatgtgattcttggatttgttttagttttgattattgttctttttgctgtattgaacaataaaaatgttcctgtaagttttggcttcacttccttttctgcgccattgatcttagtgatcatcggttctgcgctgattggtgcactgattgtatttttgactgcttcggcaacactatggcagcaaaaaaagcaaatcaaacagctgactcaggaaatgtcagaatatcaaacagaacttcaaaagaaaattgaagaagcaaaagaagaacagcaacgcgagtttagaaacgaacgtgcggagttggaagctgcttatcaggcggagttacaagcgaaaaccgcacaaaccagtcaattgaaagtcgccggaaggacaatcatcgccaagatcgccccc

SEQ ID NO: 3647 - DNA (genomic), 813 bp, Enterococcus faecium; double-stranded, circular
  misc_feature (B) LOCATION 1...813
  hypothetical: NO
  anti-sense: NO
aaagaggaattcgcaatgaaagtatctcaaaaaatcatattatctattttgttactgcttacattagtagttggctatttttcgattgagtttatccatggattttcgtctgcaaaacagagttcaactgtgaaaaaggtagagccgaaaagtgtccctaccacactaaatgtggctttgattggttcagatgctcgttcgaaagacgaaaacggtcgctcggattcacttctggttgcacaatacaaccagaaaacacaacaagcaaaactgatctctatcatgagagattcatatgtcgatattccaggttacggaatgaataagataaatgcagcttactcttatgggggagttgatttattaaatcaaacattaaaggaaaatttcaaatttgaagctccctattatgcaagtatcacatttcaagattttatcgattgcgttaatgaactgtttcctggtggagtcaagatcgatgcagaaaaatctctagatttagatggcgtatatataaacaaaggagagcaagtgatcaaagctatctctcagcagctgaaagacgtaacttcaatattcaagctacccaaagcggttgggaaattacttggtagtatccaaacgaaccttccagaaagtgtgcttctggattgtggtatggatttcctcaaagacaataataaaaagatcgatacattatccgtaccagtagacggcagttgggacttcaacgacaatacgccttccggaagtgttctggaattagatttgaccaaaaaccaagaagcaatcaaaaaatttctgaataattaa

SEQ ID NO: 3648 - DNA (genomic), 678 bp, Enterococcus faecium; double-stranded, circular
  misc_feature (B) LOCATION 1...678
  hypothetical: NO
  anti-sense: NO
ttggaggaattgagatattttaccacatatagattaaaaacgaatcagcctaaacaatatgtatcagacatgttaaatattattgaagaaatagactcagaaatgaaagctttctcaaaaacttctatggatttgggagaaagatatgattttaaggggtttatggaagataaaatggacgaggtatcaagtagggaaattccagaaggcacacctaaagctgttagggacaccaaagatactcttcttgaagcgattgataacgtgaacacagctttactaactaatgatgtaaaattattagaacaaggccagctttgttttagtatagctcaagccatatatacagagtttttagatggaaatataaaagagaagtcacttaatgaaaaacttaattcatttgtagaaacatacacagctataccacctacttggaaacttgtaaatgaagataaaggaatcacgataaatactgatacagagatttctacagatgctcaatctttatcagatttattagctaatctaacaggtatcagtaatgcagtgacagagaaagttggtaaagatattccacttcggttacttgaaaatgggaaaaaagattattctgtggtatttaagaacggacaggtaactgattacaacgaagtatttaaaaaagttattgaataa

SEQ ID NO: 3649 - DNA (genomic), 666 bp, Enterococcus faecium; double-stranded, circular
  misc_feature (B) LOCATION 1...666
  hypothetical: NO
  anti-sense: NO
tggcccaattccggggtaaagagtcttcatcgcttaagttcaaacttagcttacactatcaagattattcgatactttttcatcaagaagctcaccaaaggtgaactagtcggaattatagatagttttcctagtccattatgtaaaccagttagaaatagacaagcaaaactattgaatcaaatagccaaagttggctataactcaacaaaaaaatcttatttttatggtcttaaaattcatatgatcgttactaagactggctttccgattacttactcaatcacgaatccaggtgtccatgacgtgaaagtgttagagactttatcggaagaagcgaatcttcccaatatcctaggggacaaaggatatattagccataaaatccatgaaaagcttgcccttaagggcattactatatccgttccgccacgtaaaaacatggataaatcagaaaaactagaccacagcttacttggaaaacaaagaaaaacagttgagactgttttttcttccttagaaaaattaggttgtcaaaatttcaactcacgttctgttaaagggctagagagtagatttgaaagcatattactggcttacagtgttctattaagtcgagcacaacgacgttttgaaggaactttgagatattctttaggatattaa

SEQ ID NO: 3650 - DNA (genomic), 1650 bp, Enterococcus faecium; double-stranded, circular
  misc_feature (B) LOCATION 1...1650
  hypothetical: NO
  anti-sense: NO
agtgtaaattcaaggtatagaaagaggttccctatgaaaaaaatacctattacaatcttaactggctatcttggttcaggaaaaacgatacttctaaatcatattctgtacggtgatcacggaaaggaaattgctgtcattgtaaatgacataggggaagtaaatgttgatggggtattagtcgacaagaaaggttttaaaagaactggagaaaaacttgtttcgatgccgaatggatgcatttgttgtacattacgcgaagatttgattgttgaactagatcaattagtgcaattttctgacttgaatcaaattgttattgaagcttcaggaatcagcaaaccaattccaattattcaagcaattatattagctaaaaaccctttagacattgatttgacccaacgattagagattggtgccattattatagtagtggatgtaaaacgtttttgggataatttcgaaacgggtgaaaagattcaggaaagaaaagctgaaggtaatgtagttgaagaagaacaggatattcgtggcttgttaattgatcaattcgagtgttgtaacatattacttttaaataatagtgacttagtgtcaaccaagacgatttacaaaattaacggtctaattgctaagttacagtccaatgccaaaataattaggacaattaaaggtgaagtagacttatcgaaaattctaaatacaaatctttttaatatagatgagacttcctattcagtgggctggttcaaagagttagagcttggctatcaaaatcatattcctgaaacagaagaatatggtatctcaagttttatctatcgaaatcggttactccttgacgcacaaaaatttgcccatcttacggataaaaattttcctggcaatattacaagagcaaaagggtttctttggtttgcccaacatagtgatttttcgacgatctttgaaacatcgggtagctataaaagtattgaatcattaaattattgggtagctagtttacctaaaattgagtgtcaaatgattatacaaaaaaatcccgaattgaaggaagcctggcatccgttgtttggtgaacgcattaataaactagtttttattggtatgaagatggatcaacaatgtattaaggaacaacttgagggttgtttaactgattctcttaatgcagataatttccgaaaaatttcaccatttccatggaaaaagtctaatatgtttagccagatatcgttaatgaaatttttaagaaaagctggtgtcaagataggcgatgtcataattattggcattttgattattacctcttttattcccttatttgtattctctatagaaaaggagaatgaaacaactgaagatgctatcaaatatgccatcgttcgaattgatggcaaggaaatggatcgcttcgatttggataagatcaatcataaactcgtgaattatcatcctgcgaagggacaatataatattgttgagattaaagatggaagaattcgagttaaagaagataatagtcctgatcaaatcgcggttagaactggatggatctcaaaacccggtcaaacgagtatttgtttaccccataagttagttattagtattgagaaaaaagaaagcacagattactacatttactaa

SEQ ID NO: 3651 - DNA (genomic), 297 bp, Enterococcus faecium; double-stranded, circular
  misc_feature (B) LOCATION 1...297
  hypothetical: NO
  anti-sense: NO
actttgaattcattccgtgtgaacagaacagtagggggaagtaaaatgaaagaaaagcctataaataaatggtcattgtataaaaattcaatgtttggagttgttatctttggtgtttgtgctggattattccttttcatattattacaaacggtgactcttttctcttctaatcctacttatggatggagagacagtatagccttagggatgtttgcgggaggatatggattcttattgttgttctcaattctcacactaagtccaatccatggactcattcaactttggaagtaa

SEQ ID NO: 3652 - DNA (genomic), 510 bp, Enterococcus faecium; double-stranded, circular
  misc_feature (B) LOCATION 1...510
  hypothetical: NO
  anti-sense: NO
cttatgaattcttcaaaaaaacaaatgaaaaacggaaatatttatttagtaatcgcactgatagtcgttataatcttattttacagttcttctcaaacttacggacagcaatcacaagtttcgcgattagaaagctggctgcctaatcagccatttaaagacacattagcgggtatacgttttaattatggtggaagtatggtgagtatcgaccatctgggctacgccaaatttttagagttctttttaaggaagggcgcacatttcggtacctattttattttgggaggcagcttgtttttaggtgttttccccaagctaaaaatttggtggctgacagcgatccttgcttggctttcagcaacagggtacgcaggtttggacgaattccatcagatgatgaccggtggacgaacacctatgttccaagatgtcatgttggattcgatcggtgctctgactgctgtgatattatgtgtgctttttgcggcattcaagaagcgtttatag

SEQ ID NO: 3653 - DNA (genomic), 207 bp, Enterococcus faecium; double-stranded, circular
  misc_feature (B) LOCATION 1...207
  hypothetical: NO
  anti-sense: NO
ctgattgattctatccatccaatcgaagaaaacaagcgatactctgctaagaaaagacaaagaagtgtacctaaaagattgactagagaatgttcaaataaagcagatagaagaaaactgattgtacttaaaaagagcacccacaacaacaggaacagaaagctctggaaaagatactcatacatcggcaggattcgtatctcctga

SEQ ID NO: 3654 - DNA (genomic), 1212 bp, Enterococcus faecium; double-stranded, circular
  misc_feature (B) LOCATION 1...1212
  hypothetical: NO
  anti-sense: NO
tccagcgattcattacggaaaaggaagaggaaagtgaataaagaatgggaaaaatggacagataaagaaacaaaagaatttcaagatcagttcattcaatggtatgaacaagaaaaaagaaacctgccttggcgctataatcgtgatccttatcgtatctggatctctgagatcatgcttcagcaaaccagagtagacacagtgatcgattatttttatcgtttcatggaatggtttcctacaattgaagagctagcaaatgctccagaagaaaagcttttaaaagcatgggagggccttggttattactcaagagcccggaacatccaagctgctgctaaacagatcatgtcagaatttgatggggaaatgccgcaaacgcctgaagaaattagctcattgaagggaataggaccatatacgacaggcgcgattgcaagtatcgcatttggacttccagaacctgcagttgacggcaacgtgatgcgagtagtcagcagattgttttgcattgaagcagacatcgcaaaagcttctagcaggaaaatctttgatgaagcgatgcggaaaatcattgatgaaaagcatccaggtgaattcaaccaagcaatgatggatctaggttcagctatctgtacaccaacttctccaaagtgtgagacttgtccgatccaagccttttgtttagctaacaaacgaggaatccaaacgagttttcctgtaaaaacaaaaaaagcaaagccaaaagacgtttattatatcagtgcagctcttcaaaatcattctggagcgtattattttgaagaaagagatagccaaaaattgctggcgaatatgtggacatttccaatgatggaagtgacacaagaggagtatgagcgattgaaaaaagaatgggaaacaaagccagaaatcgatctgtttgatgacctagtagcagaagaagagcaaaatctcccatttgaaaagcaggaactctttgtttggcagacacgacatttaggagaagttactcatatttttagtcatctgaaatggcatgttctccttttttacggacgggcaaccgagggagcagaacaagaatttaccgagaacaaaacttcgaagtggttgaagcctgatgcatttgattcggtcgtttttcctaaggtccaaatgaaactggtagatcagttagagaaaaatcgaaacaataggaatcctttctag

SEQ ID NO: 3655 - protein, 97 aa, Enterococcus faecium
  misc_feature (B) LOCATION 1...97
  hypothetical: YES
AICSRNTGITLPREPRTFPNLTAENFVHPSSFNPVTIISAIRFVEPMTFGGLLALSVETMTKFLTLAALAASATFFVPKILFLTASFGLYSINGTCL

SEQ ID NO: 3656 - protein, 60 aa, Enterococcus faecium
  misc_feature (B) LOCATION 1...60
  hypothetical: YES
KRCSALSNKKRFCKIASPILQNCALLPIVYLLNTVYQEIMNLPIIAESQGIISEKARHVL

SEQ ID NO: 3657 - protein, 256 aa, Enterococcus faecium
  misc_feature (B) LOCATION 1...256
  hypothetical: YES
GVCSSMRKPIIAGNWKMNKTASEAKEFAEAVKNKIPSNDKVDSVIGSPALFLQELMTSAEGTELKISAQNCYWENSGAFTGETSPAALADLGVHYVIIGHSERREYFHETDEDINKKAKAIFANGMTPILCCGESLETYEAGKTAEWIEGQITAGLADLSAEQVSNMVIAYEPIWAIGTGKSADAQIADEICGVVRQTVEKLYGKEVSEAVRIQYGGSVKPENIAEYMAKENVDGALVGGASLQADSFLSLLDAVK

SEQ ID NO: 3658 - protein, 65 aa, Enterococcus faecium
  misc_feature (B) LOCATION 1...65
  hypothetical: YES
INRSSIRTALIIFLPPKKNLPLHLLHVPHQEWSSLIPVGIYLPVPEYPPLLIPWLPILFRAELAD

SEQ ID NO: 3659 - protein, 94 aa, Enterococcus faecium
  misc_feature (B) LOCATION 1...94
  hypothetical: YES
ERRSWIDKLSSHTSCPKIVAVPPSFFIIPKSVRIVVDFPEPFGPINPTTSPECTVKETSFKASKRPKLFFKCVTLTISAIKTPLLFLKIYTKQD

SEQ ID NO: 3660 - protein, 63 aa, Enterococcus faecium
  misc_feature (B) LOCATION 1...63
  hypothetical: YES
WASSGLCVTMITNFSFDNSWINSMIWILVSVSNAPVGSSHKRISGSLASARAMATRCICPPDN

SEQ ID NO: 3661 - protein, 444 aa, Enterococcus faecium
  misc_feature (B) LOCATION 1...444
  hypothetical: YES
YNGSGLNNIERGVHMSSVVVVGTQWGDEGKGKITDFLSENAEVIARYQGGDNAGHTIKFNGVTYKLHLIPSGIFYKDKISVIGNGVVVNPKSLVKELAYLHEKGVETSNLRISDRAHVILPYHIKLDQLQEDAKGENKIGTTIKGIGPAYMDKAARVGIRIADLLDKEIFEERLRLNLDDKNRQFVKMFDSEPLDFDDIFEEYYEYGQQIKQYVTDTSVILNDALDAGKRVLFEGAQGVMLDIDQGTYPFVTSSNPVAGGVTIGSGVGPSKINKVVGVCKAYTSRVGDGPFPTELFDETGEQIREVGREYGTTTGRPRRVGWFDSVVMRHSKRVSGITNLSLNSIDVLSGLETVKICTAYELDGELIYHYPASLKELNRCKPIYEELPGWSEDITGCKTLAELPENARNYVRRISELVGVRISTFSVGPDRTQTNILESVWAQI

SEQ ID NO: 3662 - protein, 109 aa, Enterococcus faecium
  misc_feature (B) LOCATION 1...109
  hypothetical: YES
SGGSAWKGHRSTDKSYPGDNRLISPKSPHRRGGLAPRCRLVASWGCSRSQGLGCSPIKAARELGSERRETVRSLSVAGVGNLRGAVLSTRGPGWTYRWCTSCSAKGIAG

SEQ ID NO: 3663 - protein, 109 aa, Enterococcus faecium; identical to SEQ ID NO: 3662
  misc_feature (B) LOCATION 1...109
  hypothetical: YES

SEQ ID NO: 3664 - protein, 64 aa, Enterococcus faecium
  misc_feature (B) LOCATION 1...64
  hypothetical: YES
TVFSCQHLGHKAIFIKHEKLFFNIIPCNSELNGRLTTSLCSQHFICFYSSIVLDLRTTNCQCRL

SEQ ID NO: 3665 - protein, 326 aa, Enterococcus faecium
  misc_feature (B) LOCATION 1...326
  hypothetical: YES
KSFSIRKVDWMRYGRLVALLVILSSISLFIGVSNVQLSELLQLDGQSLQILLVTRLPRTICLILVGATSSICGLIMQHLTQNKFVSPTTAGTMDSARLGILVAMIFLPGASLIVRSLTAFCFAFAGTLLFLSLTRLFLQKNQLMLPLIGVMLGNIIGSVATFFAYQFQLVQNMTSWLQGNFATVIRGNYELLYAVVPLLLLVWLFAYRFTIIGLGESFAVNLGIDYQKMQFLGIGLVSLASAVMLIMVGSIPFIGVIIPNLVSRIYGDQVHKTIGVTALAGSLFLVFCDLVARVLIFPYEIPVSVIVGIIGGAIFLYLLIRGRRYA

SEQ ID NO: 3666 - protein, 284 aa, Enterococcus faecium
  misc_feature (B) LOCATION 1...284
  hypothetical: YES
ISLSQNGGRLFLLQRERLRRSYERNYGKTEAKEVRRVRQLPKPLYAKHGKRAVLLLHAYSGSPNDVRMLARFLEKADYTVYAPLFKGHGTMEPYDILQEKAESWWADTKKAIHFLQSEQFSDIAVLGLSMGGIFAVRALEEESVIGGGFFCSPLSPVKTNVPENFEKYVRQVLKTAGKSEKEINEKAVAYRSLAEQQLMDIQDQAAIVESRLSDIQQPIFLAQAGKDEMIDPNGVFETARKLSRQRVTLRWYPESGHVITVGTARRELEKDVLEFLEKLPWNEE

SEQ ID NO: 3667 - protein, 209 aa, Enterococcus faecium
  misc_feature (B) LOCATION 1...209
  hypothetical: YES
YFISIEKRRSDCGGSPKKQRRTLNACHAIIKGGLTGIELTFTVPQADQVIKELLSFYKDQPEIVIGAGTVLDAVTARLAILAGAEYIVSPSFDQETAEMCNLYQIPYLPGCMTITEIKTALKSGVDIVKLFPGSAYGPSIISAFKAPMPQVNIMPTGGVSLDNMKEWFDAGVVTVGVGGNLLAPAATGDFDKVTEVAQQYAAKMKEIKR

SEQ ID NO: 3668 - protein, 85 aa, Enterococcus faecium
  misc_feature (B) LOCATION 1...85
  hypothetical: YES
NHISRTTVICISFINGVFCIIIVKKEVVTMSRPLDKRCSRSNFFGNKPKFHKNLRNNFRKSLLILDAEQLFLSNTQIKTLISQPL

SEQ ID NO: 3669 - protein, 86 aa, Enterococcus faecium
  misc_feature (B) LOCATION 1...86
  hypothetical: YES
IKISAPSVVVIPTACPVGKIVVISPSAGATSSPTSGSIAIPFPITPEEKTWSGTSLNGSTLPVKGLFKVCRAEVIGSPAFACLFSN

SEQ ID NO: 3670 - protein, 350 aa, Enterococcus faecium
  misc_feature (B) LOCATION 1...350
  hypothetical: YES
TFSSRKKLTSTTGNELIKFKLEPGDFIMSGAGTIGRISRVPKQIKPGVFNQALIRLRINKEITDSEYFIQFIRADFMQRKLTGANPGSAITNLVPMSEVKKWIVQFPILEEQKKIGNFFKQLDDTIALQQRKLDLLKETKKGFLQKMFPKNGAKVPEIRFPGFTEDWEQRKFKEFSKKTGKKNTKDLDFPAYSVSNKAGLISQTEQFDGSRLDDLEKTNYKFVEPNEFAYNPARVNVGSIAFNNLGMTVIVSSLYVVVKMSEDLDNEFILQFIKSPTFIKEVKRNTEGSVREYLFYENFANIKFPFTRNKEEQQKIGAFFKQLDDTIALHQRKLDLLKETKKGFLQKMFV

SEQ ID NO: 3671 - protein, 282 aa, Enterococcus faecium
  misc_feature (B) LOCATION 1...282
  hypothetical: YES
TFSSRKKLTSTTGYIIIFYTRFSGETPDVLALNTSFFILYLCVGLIILVYYWKISNKKLADQLLEQQVRMQQDYIKDLEKNYQDLREFKHDYQNLLFSLHSYISEGDLEGLRSYYDQTILPTRQMMNLFPANLSMLDNMKVPEIRSLLSLKLMMAQEKGLIVQLHFPEPIELDTKHTVNLVRMLGIILDNAIEGASAAKKKKIELTILKKNHSVMIRVINTTTNTLPLNQLKQKGFSTKTNPKNEGLGLFILDELTKTNPYLFLETSIENQRFSQTIYIQIK

SEQ ID NO: 3672 - protein, 469 aa, Enterococcus faecium
  misc_feature (B) LOCATION 1...469
  hypothetical: YES
NRSSLCFFSLCHTFIFLMCSICYNKREMGELLMTIEEAIEWIHSRLPFGSRPGLDRVEALLEVVGHPERKVKTIHIAGTNGKGSTVAYLRSLLEEAGLTVGTFTSPYIETFNERIAINGKSIPDNDLIQLVKKYQPLIKQLDQFEAVAGITEFETLTAMAFDYFLMKKVDVAIIEVGLGGLLDSTNVAVPMLTGITTIGLDHTEILGDTIEEIAAQKAGIIKQGVPVVTGNIAPEAFTVIQQTAKAKNAPLYVYGENYKINYLHPDEMWGEVFEFFNEIGKIPQLTTPLLGQHQAENAGVAIELYFVYCQLEKLPFREKDVLKGLKKSRWPGRMERLSNEPLVVLDGAHNTHAMNRLVENLKKEFKGYQINILFSALRTKNVREMLERLQQVPNVHIYLTTFEHPKAIELSEVSDLASERVSIVSLWQFGLADILEKMTNEDVLVVTGSLYFISEVRHLLIQLGGDHEV

SEQ ID NO: 3673 - protein, 399 aa, Enterococcus faecium
  misc_feature (B) LOCATION 1...399
  hypothetical: YES
TASSNRPHGLLHYGGKTIMATFKQYETKKGKFWLYEAYLGMNKMTGKPDKVRRRGYKTKKEAQLALSRLQVDYDKNGIKKANNETFKEVYDLWLETYKTTVREATFMKTEIKFRKWILPKYGNLRVNEVTVKKAQQIVNSWAETTDQYKVLHSTSKRIFSYAINLGIIETNPLDNVLMPKRTTTKHKEKVKVYSKEQLITLFDYLNSKPETYRNDFDKTLLRFLFYSGVRISEALALNWSDIDFQENTVTINKTLSQSKNGYKISDPKTDCSAGVLPLDERTISILKKWQINQRKYMLTLGVTDPTMIFCGIYKELITHHAIYARLITICEKAMVPFLGVHVARHTHASMLLDAGATMVEVQTRLRHTKISQTIDCYGHLAKETKEKTVEKLVQHLNID

SEQ ID NO: 3674 - protein, 223 aa, Enterococcus faecium
  misc_feature (B) LOCATION 1...223
  hypothetical: YES
HVSSHLVKRKIPLGERSQHSSLMAAAIGTGLLWFGWFGFNSGGALRADEQAVNAFGSTFIALAFAMITWLIIAKVKGNGFDFVDVLTGSVAGLAAITPCAGYVEAKSAMLIGIIAGIVCHAAVDFRKKKQWDDALDVWGVHGMGGFTGTILIGIFASNSHLLTNPSSWYFLGIQVIGVIITAVYAYVLTTVILKSAMHFTTITTTKEEQEEGLDFFFFGNKLN

SEQ ID NO: 3675 - protein, 231 aa, Enterococcus faecium
  misc_feature (B) LOCATION 1...231
  hypothetical: YES
GFPSTHVLTHLLGGKTMNLILMGLPGAGKGTQAEKIIDAYGIPHISTGDMFRAAMQNETALGLEAKSYMDKGALVPDEVTNGIVKERLAEPDTEKGFLLDGFPRTLDQAKALDAMLKDLNKKIDAVIDIHVGEEILVERLAGRFICSNCGATYHKIFNPTKVEDTCDRCGGHEFYQREDDKPETVKNRLAINIKNSEPILAYYKEQGLLNTIDGAREIDAVFADVQKIIEK

SEQ ID NO: 3676 - protein, 90 aa, Enterococcus faecium
  misc_feature (B) LOCATION 1...90
  hypothetical: YES
NKASVSLIETVKPKSIAAPCHPLQAYGPTGIVPREGFSPINPQNEAGILIEPPPSLAPAKGTIPDETAAAAPPLDPPGVHSRFQGFLAGP

SEQ ID NO: 3677 - protein, 661 aa, Enterococcus faecium
  misc_feature (B) LOCATION 1...661
  hypothetical: YES
ERASRHFELVSKYQPAGDQPEAINQLVDGVVGGKKAQILLGATGTGKTYTISNLIEKVNKPTLIIAHNKTLAGQLYGEFKEFFPNNAVEYFVSYYDYYQPEAYVPSSDTYIEKDSSVNDEIDKLRHSATSSLLERNDVIVIASVSCIFGLGSPFEYQKQVVSIRQGAELDRNQLIRDLVSIQFERNDIDFQRGRFRVRGDVVEIFPASRDERALRVEFFGDEVERIREVNALTGEVLGETEHVAIFPATHFVTNDEHMEHAVANIKAELEQRLTVLRNENKLLEAQRLEQRTNYDIEMMLEMGYTSGIENYSRHMDGRKEGEPPYTLLDFFPEDFLIVADESHVTMPQIRGMYNGDRARKQMLVDYGFRLPSALDNRPLRLEEFEKHVNQIIYVSATPGPYEHEQTDTVIQQIIRPTGLLDPVIEVRPIMGQIDDLVGEINERVEKDQRVFVTTLTKKMAEELTDYFKELGIKVKYLHSDIKTLERTEIIRDLRLGEFDVLVGINLLREGLDVPEVSLVAILDADKEGFLRSERSLVQTIGRAARNEEGKVIMYADKVTDSMRLAMDETSRRRTIQQKYNEEHGIVPKTIIKEIRDLISITKESEDDTKEAVQVSYEEMTKEEKDTLLMKLEKEMKDAAKALDFETAANVRDMILELKASK

SEQ ID NO: 3678 - protein, 522 aa, Enterococcus faecium
  misc_feature (B) LOCATION 1...522
  hypothetical: YES
KGASFMQTQEAIKTFLLKKKSNTKLDIFLFLSEHRFFITTQYLADHFHMSESNFLLYIKELEQDFERLNLTELHIDKQKPFLKLNFEGIDPAYCYYRLFGRYCNESVSYQILTSLFSCQTNSIISLSQQTNYSASYLYTKMKKINAFLALYGLSISFSNNGRKSFSGKEVQIQYAALDIYWNIFSSTATEFYDEDPQVVAFMMNTFFKKEVLDRLNSGMIDKLYFLLKICKENFPATSVKDVQKEFTEYEYIDFFIDPSVDILRPNLPICREQRILVNILARLSITKIESEETSLEQYKLLKKANVPHVLYSREMVESFCTVFDLFIPEKEKILYSLAFARNKLYNGFLNFNQPNTPLPTFMLYQEHSVLKEVQTAIEQFYMDFREQNQHLLPVILEKENVQWMVEDLVHLYDRYKKQPRIVIGVNYTRDFYISKDLIVKIEQIFSNESIKIQNDFMENCNIVISDCPLKQLPSHIKKIYILKGIITPEDWKKVIMRISEYIFELKEEALMDQSKKENQVTS

SEQ ID NO: 3679 - protein, 495 aa, Enterococcus faecium
  misc_feature (B) LOCATION 1...495
  hypothetical: YES
GPASHXNLTTEIQLLNEKVNYLTNKLFGRSKETLFEETNGQLNLFSDEEISVSVPEAAATIIPVKGHQRVVGTKADKIKHLPITEKEHLLPLEEQFCEHCGSQMKDIGRTKVREEIRFHQAMLDCLTHYQHTYCCKSCEKEGLSSFKKAIVPKPLISNSLGSNSLVAETIRMKFGQKVPAYRQENYWKQTHGLDISRDNITNWHIKAVQNALDPLGERLRVYLNQEEILHGDETSYRVIESAKTDTYYWQFCTGKDSQHPIVYYHHDESRAGDVPKTFLKEFTGYLHCDGYSGYNAVESVRLVYCFAHVRRKFFEAIPKGKKNTDIPAAQAVKQLDKWFVLEKKWKDFSPEKRLSCRQQELRPLFIAFYEWMATIDPVAKSKLDAAVQYACKLRSGFEPIFEDGRLELTNNRAERNIKELVIGRKNWLHSTSLEGARTSGIILSVYKTAELNGLNPVKYLEFLFDKIPNLPVLSAETLDQLLPWNKDVQQHFSRN

SEQ ID NO: 3680 - protein, 65 aa, Enterococcus faecium
  misc_feature (B) LOCATION 1...65
  hypothetical: YES
PEYSGLNPDPSSSKAEIFPSISIVPDVGVSTPVMIFNIVDFPDPFSPTKPIISPFFISTFTFFNA

SEQ ID NO: 3681 - protein, 89 aa, Enterococcus faecium
  misc_feature (B) LOCATION 1...89
  hypothetical: YES
RSHSIENQDLLTFYDFPPSIRRTIYSTNLIESFNKQIKRYSRRKEQFQNEESLERFLVSIFDTYNQKFLNRSHKGFQQVTDTLVSMFTE

SEQ ID NO: 3682 - protein, 235 aa, Enterococcus faecium
  misc_feature (B) LOCATION 1...235
  hypothetical: YES
VLNSKAYIPQSRERIFLIGHSRDACTEQVFPIIGPSSTSDQNIRNLVNINPSNRGMGGQVYGSDGVAPTLTGDEGIKIALPARDGISVAGLLPGKFEQGNRVYEVTGTAPTLSTKQGGTKIMIRKNETEYQEVKPEDSVNLAFPNSTSRRGRLGKQSVHTLLTGDQQAIVTDQYQIRKLTPRECWRLQGFPDWAFDRDSQVNSDSQLYKQAGNSVTVPVIFDIARRLKELDVHGL

SEQ ID NO: 3683 - protein, 356 aa, Enterococcus faecium
  misc_feature (B) LOCATION 1...356
  hypothetical: YES
QNCSSLIVKRKETHMKKTSLLFAASSLSLGLLGLSGCGNNSSVATVADADVNEIVTLRFAYASNSQPVIDAMNEFGRLVKEKTDGSVQIQYFPDGQLGGERELIELTQSGAVDFTKVSASALESFSKDYSIFSVPYLFNDEEHFFKVMDNEEIMEPIYQWTKNLGFTGLTYYDSGQRSFYMVDGPIHTPEDLEGKKIRVMQSETAIKMVELLGGSPVPMGSDEVYTSLQSNLINGSENNEFVLYTAGHGGVAKYYSYDEHTRVPDIIIMNDAIKEQLTDEQEKAIEEAAKESTVFEIEAFAKAIEEEKALAQEEHGVQFNDVDNTPFREAVAPLHDIFKNDPTYKDLYQKIQEQGA

SEQ ID NO: 3684 - protein, 355 aa, Enterococcus faecium
  misc_feature (B) LOCATION 1...355
  hypothetical: YES
KFCSRLYTRSLWLFDSSSSFRLPFIPERLYKLKNLFKTGIKQRNLFWQYNLKTRRNTAMTEPKLIDPRNLYHTEKFPKQDQDTPALQQNMIPVPDCGEESYEGNNQLENRRVLITGGDSGIGRAAAIAFAREGADIALQFFPGEEKDAEEVAKYVKDAGRKIVLLPFDLRDEQAPKEIIDKAVSELGGLDTMVLNAGQQISCQSIAELPLEQVKDTFMINIIAMFALVKEAVPHIPAGGAIVTTTSVQAFNPSEHLLDYAATKASIANFTIGLAKQLAPKGIRVNGVAPGPIWTQLQLDEGQPSDSIPEFGQQSLLERAGQPGELAPVYVFLASNKASYVTAQIYGVTGGEAINL

SEQ ID NO: 3685 - protein, 72 aa, Enterococcus faecium
  misc_feature (B) LOCATION 1...72
  hypothetical: YES
AYRSCSRGLIPGRVXSSRDPPTCHELRSLSGRLYEKQMSDKCAQHLLGHKSDTMASQYRDDRGREWDKIEIK

SEQ ID NO: 3686 - protein, 90 aa, Enterococcus faecium
  misc_feature (B) LOCATION 1...90
  hypothetical: YES
DMRLDKFLKISRIIKRRSVAKEVADKGRIQINGKLAKSSSDVKVGDILKVQFGNKTLEVKITELHESTKKEDAQKMYEIISENRTETLEK

SEQ ID NO: 3687 - protein, 351 aa, Enterococcus faecium
  misc_feature (B) LOCATION 1...351
  hypothetical: YES
SRRSSWTGSETSQNKKLSISKERRLEIMRKVIIDCDPGIDDTLALSLAVKSPDIEVVAITVVCGNVPADIGTQNVLKCLERCDRLDIPVYQGMEKPLKQPFISAQDTHGMDGLGETNFPMILRKQAEPLHAVDFLADYFKEKTNTSVIALGPLTNIAFALKVNPNIGKHMDRFVSMGGTYKSHGNCSPVAEYNYWCDPEAASYVFENLKQTIEMVGLDVTREIVLTPTILEYCCQMNPEEGEYLKAITRFYFDFHWKQERILGCVINDPLAVAYFIEGAICEGFKSFTAVETQGISRGQTLVDRYEFWQKPANSKIMTKVDTRLFFRKFLTVLLNAQEETIMKDLERLKMG

SEQ ID NO: 3688 - protein, 180 aa, Enterococcus faecium
  misc_feature (B) LOCATION 1...180
  hypothetical: YES
IYSSASGKDSFIAFRRSSRRAAITSLAPFSANSFVVASPIPLEAPMMTITFSDKSFILFSSCFEKSLAYTHYLLFHLTVQIIRSTGLTILAGIPATMVLSGTSFVTVAFAATMAFSPIVTPGRIVAPAPIQAFFLMWIGFTDKPLRSFGSVRWFTVMRLTRGPINTESSKQMPPKSTNIT

SEQ ID NO: 3689 - protein, 93 aa, Enterococcus faecium
  misc_feature (B) LOCATION 1...93
  hypothetical: YES
LGSSLMSNYTVAIKNSAKVDLRKIKQTNLKKQFEEVIQTLKEDPYMPTQSFEKLRPTHEGRYSRRLNRQHRVVYKVDEENKVVEIYSAWTHYE

SEQ ID NO: 3690 - protein, 78 aa, Enterococcus faecium
  misc_feature (B) LOCATION 1...78
  hypothetical: YES
TVGSRPLGKWCSRDSLSAIRSNFVIAQGRTSLSHPLLFHKIVLFAVKVANWCHDDTVQVIDDCTEALLFLHQVIDYFF

SEQ ID NO: 3691 - protein, 73 aa, Enterococcus faecium
  misc_feature (B) LOCATION 1...73
  hypothetical: YES
MRRLVDQTTDNLIFQVPLFRLFPLSFVFYLNFAIWTNRGCEKAVLHQVIRTAKQKTAMSITAVLLNLRLIDHI

SEQ ID NO: 3692 - protein, 425 aa, Enterococcus faecium
  misc_feature (B) LOCATION 1...425
  hypothetical: YES
EIRLKKQLVVKKSFKPFGEWAIKLTQDSKRATEKRRRINLTSKEISELLAEGIITIILLLLLNVSILVVISSVINSSPSLTNAIWDSKNIFAERLNTDLFWNGRNFIIPFFFLLDIGVLYWRLIRRYRQMQLRHIISELHYIANGNYDHRIPFELSGDLSRVVTSINGLVDSTVAAIEDERKIEKSKDELITNVSHDIRTPLTSIIGYLGLIEDGQYHSEEDLLKYTHTAYIKAKQMKSLVDDLFEYTKVRQPAVPVNFSAFDMIQLIEQLAADFELEASKKNIQILVQSKVDSLIMDGDTEKLVRVFNNLLTNALKYGKGATKIVIEVERIGSEVVATVKNNGAMIPQQAIDNLFDRFYRVEESRSQATGGTGLGLAIAQSIVALHGGYIYAKSDKQWTSFIMHLPIKKNEKLPIDTQEVIDES

SEQ ID NO: 3693 - protein, 755 aa, Enterococcus faecium
  misc_feature (B) LOCATION 1...755
  hypothetical: YES
LTRLIKERMLLMSSKAELLNGMNPRQKEAVLHTDGPLLLMAGAGSGKTRVLTHRIAYLIEEKEVNPWNILAITFTNKAAKEMKERVNAILASGGEDVWVSTFHSMCVRILRRDVDFIGYNRNFTIIDSSEQLTLMKRILKELNIDPKKYDPRSILGTISQAKNSLQTPQDFAKMQGSYYEEIAAKCYAAYQKELQYNQCMDFDDLIMNTIRLFEEHPDSLTYYQNKFHYIHVDEYQDTNHAQYTLVNLLAGRFRNLCVVGDADQSIYGWRGADMQNILDFEKDYPDAAVILLEQNYRSTKNILSAANQVIENNSNRKPKNLWTENKEGNKITYYRADNERDETRFIVDRMQEEIRSNHRNYGDFAILYRTNAQSRVMEETLLKANIPYKMVGGHKFYDRKEIKDILAYLNVLVNPQDSISFERIVNSPKRGIGPGSIEKLRSFASLHEWPLLEAAQNVDLANIGGKAGQQLGAFGEMIQEVTQMIPYLTVTELTKEVLDRSGYLEDLKIQNTLEAQARIENLEEFLTVTQEFDKQFEQQNEEDADAPEEKLTVFLNDLALVSDIDNLEEDASQVTLMTLHAAKGLEFPVVFLIGLEEGVFPLSRALMEESELEEERRLAYVGITRAEEALYLTNAFSRTLYGRTQYNRPSRFVEEIDQELLEIEGMRPTPKKTPVFAKKTAYSYKQPETAVVPSKSATGGENNSWKPGDKVKHKKWGLGTVVRVSGTSKDLELDVAFPSQGVKRLLAAFAPIEKA

SEQ ID NO: 3694 - protein, 123 aa, Enterococcus faecium
  misc_feature (B) LOCATION 1...123
  hypothetical: YES
KKRLGGIRMCGRYFFDLESELLQNYYREAQTKQPKQAAELAAGEVFPSNLVVTLRKEEENILTPEIMKWGFTGFKKGQLMINARAETVEEKKTFHQPFLQNRCVFPMSGMKKKTNLCFQIRKK

SEQ ID NO: 3695 - protein, 85 aa, Enterococcus faecium
  misc_feature (B) LOCATION 1...85
  hypothetical: YES
EKRFYSESYKAFFDKKNPHQAKKCPQFDDSLLDGGFSNYLTDFLISLLAFLCSMISFYVKNGLFKFFSGDFIRHMFNIICCHGFI

SEQ ID NO: 3696 - protein, 226 aa, Enterococcus faecium
  misc_feature (B) LOCATION 1...226
  hypothetical: YES
MERFDVERMIQMKIFVVGANGQIGRHLIKDLAPSSHEIFAGVRDVASQTLVKKENVSYVSFDLTWSVEKMTEAFKGIDVLIFAAGSQGKNLLQVDLDGAIKTVIAAENAHVSRYLMVSAVYADEPAKWPESMTDYYITKHYADEWLKRTNLDFVILQPVTLTNDEEVTSIQLTKPNEKASKTITRSTVAAVLAALVEETDISRTTLVLSEGSKELNTAFQEWAKEE

SEQ ID NO: 3697 - protein, 239 aa, Enterococcus faecium
  misc_feature (B) LOCATION 1...239
  hypothetical: YES
IRLSLFDLAIYGFLLLFILFVFVLGHQKKEWKLPSWLNLFTFLNGMLGNFLFLFSSFYVGILYGLEKLSIFMYLPYAAGLIAAKIVGPWILKRLTWSPLAMQLLGLSSSLLVLLIPNGFAIGVFLLSFWHVVTGSWLNKEYYQTDTAIPMDRRIVVKYTTQNKGSVIHQFLLMTLLFVLAKEMGEPIHLLLITLNHESVPIESVQLLILAKWINVGLLLSGLVTVYHLWKKAKKNEAIH

SEQ ID NO: 3698 - protein, 99 aa, Enterococcus faecium
  misc_feature (B) LOCATION 1...99
  hypothetical: YES
GVLSNYKNRGECVMEIDNKNILNRLKRTEGQIRGIQKMIEDEKECMDVITQLSAVRSSIDRVMGMIVADNLKNCFEKPDSNPEEQAAKLEQAIKMIIKK

SEQ ID NO: 3699 - protein, 174 aa, Enterococcus faecium
  misc_feature (B) LOCATION 1...174
  hypothetical: YES
RGRFFLGGRKMIKAVRIDERLIHGQVAMTWTKSLNLTGLVVASDEAATNDIQKMTLKMAAPSNVKVIIKTVDDAIHLLKDPRAKDMRLMVLVPNVKDAVKVAKAFPTEIELMNVGNAGKMTPPSEDKKTLSKEVMLTTSEIQDLKELVELYPDTVFQPTPAMEKRSAISILSDF

SEQ ID NO: 3700 - protein, 119 aa, Enterococcus faecium
  misc_feature (B) LOCATION 1...119
  hypothetical: YES
SKLSSAVSKFWMTSSFSSSTCSAAFFANSLAVCCSANFVKSSTVIKSSSSSSMSRSSISVSSISNTRMSRPSDCYSFTNTRNDSGTPGFGIGSPLTIASYVFTRPTTSSDLYVKISCKV

SEQ ID NO: 3701 - protein, 66 aa, Enterococcus faecium
  misc_feature (B) LOCATION 1...66
  hypothetical: YES
SLLSLTSDVLVYALELLAEARPYKKQKKTLILKNGLMKNNTCRLGFTISYQIRGYDKRLFTIPSSE

SEQ ID NO: 3702 - protein, 217 aa, Enterococcus faecium
  misc_feature (B) LOCATION 1...217
  hypothetical: YES
ETLSLTLRHMYLKKAQISQHYLGLICLEGSKAGATAASVWAAHHVLPLNVTGYGKLMGASIEGAHRFYNFLNDLSFKVGDKEIEVHPLTYPDFNMVDYVFKEKGNDDLVAMNKLNHDVYDYSSYVKGSIYGNEFLTSHTDFAIPDYGNSPLQFVNQLGFSDEEWNRAGKVTVLRASVMTPYMNKEEHFEEYAEKIKAALQEKLEKIYADQLLASEAK

SEQ ID NO: 3703 - protein, 123 aa, Enterococcus faecium
  misc_feature (B) LOCATION 1...123
  hypothetical: YES
PLLSQPLFDYAFTSITLESSLMTSRSKSLMRALVTIPATMLPLTFTAVRAISINGSTEITNPTIAAGKFIAPKTISEANVAPPPTPXTPKELIVTIATSIKINSKLKTFTPAAGATIVANIAG

SEQ ID NO: 3704 - protein, 79 aa, Enterococcus faecium
  misc_feature (B) LOCATION 1...79
  hypothetical: YES
MTLSAMGAKAELCVMIKTVLPCCLLAFCNNFNTCLPVSKSSAPVGSSHKRSLGFLASARAIETLCCSPPDNWDGKLFNR

SEQ ID NO: 3705 - protein, 145 aa, Enterococcus faecium
  misc_feature (B) LOCATION 1...145
  hypothetical: YES
CMRFLDLFAGIGGFRLGMEQASHHCIGFCEIDKFARRSYKAIHDTSKEVEMHDITSVSDEFIQSLGPVDILCGGFPCQAFSIAGKRQRFSDTRGTLFFEIARFTTLLRPKLLFLENVRGLLNHEGGATFETILRTLDGLGYDVEW

SEQ ID NO: 3706 - protein, 70 aa, Enterococcus faecium
  misc_feature (B) LOCATION 1...70
  hypothetical: YES
QVRLATTTPRISLNYSRKSSADPLKSTEKTVENHKRKSQCNEITYKKLSRNLILGCSYYLRQGSFFMTSR

SEQ ID NO: 3707 - protein, 187 aa, Enterococcus faecium
  misc_feature (B) LOCATION 1...187
  hypothetical: YES
KVRLMKITEFSEVFKTFSNIYNRIPEIEQNVVVDNDYYIENDFNKPRKYDNLYNFIHNRTTINNNSNTRVLINSAYFHIKYLKKYEYEEVVLDYGLNRQSFLIYAINNGNLPSNKKNIIIETYAYLEGGSKKLIKSCNIEYQLSVGEIKCVFEEDLELDLKKIFASIHDYIGLIPVVLVNFFLEENV

SEQ ID NO: 3708 - protein, 503 aa, Enterococcus faecium
  misc_feature (B) LOCATION 1...503
  hypothetical: YES
KRLSEKRIVFFLLGGLKMTEKKMSLIDRCKQIDIVDFARNNGMAVVNKGRDYRLEDHDSFVFDRRKQRFYWNSQNISGDIIELAKLFFIDKEIQDSKQQFKAATDFILKNEDKTERVENLHFETEKYKDHPVDYQPLTEKGRNYLKEERKLPDWLIDYAEKEGLIAELKPKHERQNFLVQDDRLDHAVAFLWKDPQTKETVGASYQGTFIDYERFGERGTYKHIDKNSTANHGFNLKIGDPKQLKFFESSIDLLSYAALNRDQLNDTWLVSMEGLKHHVISHYFGEAVSELRKKQAFPQSIEICVDNDRAGHIFYEKEQLMGAVDPFTNQKVRCERGIANDWQVPKEYKVIYEEVAKEMKVEPEAIMAIHKTENNLQLTNQLVSAHKVNASFGQQLSVNDSIEAINLKDICREVAKELKGCERVDGTYDFDRFYQEKGDINAQILFSYKAEQYYKSYKNHEHEFVPEVKKDWNDQLKHEIHQQEIRKQKRAMLFQQSKQQERE

SEQ ID NO: 3709 - protein, 277 aa, Enterococcus faecium
  misc_feature (B) LOCATION 1...277
  hypothetical: YES
QTLSSIMLEEMPMMNKLIFGRYMPGDSLIHRLDPRAKLLASFYFIGIIFLANNWETYLLLAFFTLLSVFLSKVDLKFFIRGIRPLIWLILFTVALQVLFTSGGETYWSWGVFHITEFGVMNGLFIFCRFVLIIFMSTLLTLTTPPLELSDAIEYLLRPLKAVRFPVHEISLMLSIALRFVPTLMDETEKIMNAQRARGVDFGEGNLVQKMKAVIPLLIPLFVSSFNRAEDLATAMEARGYKGGEGRTKYRVLHWHNRDTMVIIAFVLLTVLLIFLRG

SEQ ID NO: 3710 - protein, 289 aa, Enterococcus faecium
  misc_feature (B) LOCATION 1...289
  hypothetical: YES
FFISAVPPTIGEHSKQDISDFCLSGAVAAPIVGRLETVIIACVIWGIINGYTSQRATYRAVCSVLFPNGDFPSRSRFTRLSSNLAYTIKIIRYFFIKKLTKGELVGIIDSFPSPLCKPVRNRQAKLLNQIAKVGYNSTKKSYFYGLKIHMIVTKTGFPITYSIANPGVPDVKVLETLSEEANLPNILGEKGYIXHKIHEKLALKGITISVPPRKNMDKSEKLDHRLLGKQRKTVETVFSTLEXLGLSNFDSRSVKWLKSXIESILLAYSVSIKSNTTTFGGNFEISLRI

SEQ ID NO: 3711 - protein, 216 aa, Enterococcus faecium
  misc_feature (B) LOCATION 1...216
  hypothetical: YES
FCISKKHVTMKLINGGSVIKKLRRLKNMARKKTITREQILAAAYEVAATDGFTRFTARNIANKMNCSTQPIYLEFKNMDDLRQALFEQIYDHLQYEVFTVEHTGNTIIDLAFNYIHFARREKKLYRSLYLEEYGGGKEMQNFSYTYFVNTVKRDPAYVNLSEEQIESLYNGTWIIATGIAALMSSSIIHPTDEQIEKMIQDSIDAILKFKEPIEID

SEQ ID NO: 3712 - protein, 393 aa, Enterococcus faecium
  misc_feature (B) LOCATION 1...393
  hypothetical: YES
IRRLCMEKNRKFNLVATAASGLEALVGKELRDLGIECQVENGRARFEGTMETIATANLWLRTADRVKIVVGEFDAYTFDELFENVKALPWEDFLPLDAAFPVAGKSIKSKLYSTPDCQAITKKAIVERLRTYYHRPASVPLTETGAHFQLEVALLKDHVMVTLDTTGPSLFKRGYRLEKGGAPLKENMAAALIMLTNWRKDRPFYDPVCGSGTLCIEAALIGHNIAPGFNREFACESWDWFSQEIMENVRSAAEEKADYDIELDITGSDINGRMIEIAKANAEEIGLGSSITFKQQAVKDFKTDKEYGVIVANPPYGERLGEEETVRKLYKEMGDVFRPLKTWSKYILTSDLAFEEFYGQKATKKRKLYNGALRTDLFQYWGTRPPRKKEKDE

SEQ ID NO: 3713 - protein, 222 aa, Enterococcus faecium
  misc_feature (B) LOCATION 1...222
  hypothetical: YES
YSISKEKEDLLMDGIFGFTGIVLFIIGLIMLIVRFIKKTNKKTPMILLIIGIIFTTVGFSLSSSNEANDNNKQESSSSDTQTTTSNSSNKSLTQFEEFLETNNHDWGAFLDSYYSITPATEQNTAFTKYISGKTYTFEGTVIESMTTRIAIIADKEYDDKSWNDISATPKVSYVIFAKDLNNADTFTKGDKVTFTGEISSRGSNIEKSYAQWDMINSKVSKK

SEQ ID NO: 3714 - protein, 915 aa, Enterococcus faecium
  misc_feature (B) LOCATION 1...915
  hypothetical: YES
FAISFFYVQAGSLNIRDYWLILTPISQNYFTYAVSCTLLFCSIPYTVGFLNKLSKTTIKYLLLFLTIGLVGCSTLFNKDPFALQNGQSILWIFYLFLMGYGLKEWNWKEKVRYKLPQVFISLIVLFGLIILMTQISLIIRGNTDTALRFSKPYSLFAMYYTFSSFLFLEMLSDKLGIKGRGNFLAVFLIVTQVICNFPLVSYRVSTFMKREFPNSGKAWLINIGQFFICYLLAVSLLVIFLFYIQKIRFIHRFIEYFAFDSIEQLTQRWKKRIHWLFVHKSYFLVAAFFYCFTFVQIFVLEPKEGWKETIQVALKIFTQRQAPMILTIIIIMGFFFLLLLISNRFWYALTATLIINLLLTISTVIKMEMREEPVFPSDLKILTGLSELLSMVSPVLLIVGGLILLLLLITSIIVQRRLQKQYSLKIHWKRRFISIAVLLGCFSGVFFINHKNSPSFLLFNLFKVNKTFFNQQGAVKDNGPVIQFLNNIDIKIMEEPAGYSKEKINGIMKKYNTKADEINQTRSDWLNNQTIVLNLSESFSDPARVPNLTVPTDPIPYIKSIITEGTGGLMLSVGYGGGTANMEWEGLTGLSISNLSASLVTPYTQLVERQKISPNITDLFDEKIAIHPFTAALYRRKQVFDKFGFDRFYYLDSPDKLTYTDKIEQSPRISDDSAYKETLKALQSNTETSQFIQLSTMQNHMPYDDYYSELNYTAEGTAVIPNRRKELQTYMQGLHYTDTAVKKFIQEIDKIDKPITFVFYGDHLPAIYSGNDSKKYGLEQHQTDYFIYNNKYSREQAATLNKEVVAPNNFGAMALEHANIKVTPYYALLTEVSNHLPALTIDPTESLSNRFNGKQVFVTEDSQIIQEKNLTEKQKEILEDYRLIQYDLVAGNQYSATWATQKIGSLSNDVGKEKS

SEQ ID NO: 3715 - protein, 226 aa, Enterococcus faecium
  misc_feature (B) LOCATION 1...226
  hypothetical: YES
KGRFQMKKKTFKKLLFLGGTAALLLSGTSYYLHIHSPEHTMNTAQKSSTQKTKKTKEKAEVLLDVPLESQFDSPSLENGCEVTSLSMLLSFYGYETTKNQLAEQLDYVPVFNADGTHGDPNEGFVGDISGGEWAMVVYVPPVASLAQQIVQTDYHTFPKTDAQLDDIKKALFKGNPVWTSVTINFEVPDETDFMTRTTNNGEVRVTPLVHACVVTGSDKVIISPAP

SEQ ID NO: 3716 - protein, 1070 aa, Enterococcus faecium
  misc_feature (B) LOCATION 1...1070
  hypothetical: YES
KGRLVTMKWSIPEKVIARGRQYLQEGRVLSVVPDQEENVWHAEVLGSELYMVDLDGTAKEIDYCQCPYWEEHKYCKHTVAVELYLRSKNLSRIMKKDQPMLEPVKATSEGEIIAKGFSRLKTQNNPQAVQPLIIEYQVETIETNQYHPELSILALYLRIGSLASPKKTYIVKNIYDFLQAYTEKETYTVNKQYQFRLDKRAFQKEDQKILTHLAGSAQTHQLLGTNGLQVKGKLDKRYLLLPVEQARFLLEQMNQTTRLHLQINEQNDQGIQFSDQNKPLSFKVEKFGEDYLLQALNDFDFFFMHYQWGVIQGTFYSLTKYQQTVYQTWKQLIRRLEKPEVVFKKKELPSLFKEIIPLLSEIGDVAIAPAVEEEVADIPVEFIFFFRKAKGKIQARVDFVYGEVIYSTDPKHEVSTEQAFQVLRDTVEEKRVLDLFRMYRYQKNETGYERPLPSGEELYAFFRTELSVFRQFGEVRLGRKLRELYLDAHKHQPKIEVTETGSWLDIRFDVTGIEEQEIDHVLQSLLRNDAFYTLENGQVLSFDSEEFQQTSQVLQQLRESIRTEEGTIHVPKNQGLIIQNQLEKSNATFSESFQTMVQDLIHPERYQAQLPKGLNATMRDYQKQGFRWLKMLGHYQFGGILADEMGLGKTLQTIAFLLSEKEERKSFSALIVAPASLIYNWQAEVRKFAPSLSIQVINGNKKEREELLAKDTDIRVTSYASLRQDLANYQSQKIDYLILDEAQMVKNSSTKTAQALRELAVPQRFALSGTPIENNLEELWSLFATIMPGFFPTKTKFRELAAEEIAQMIRPFILRRDKQTVLKDLPEKTEMNLYSALTEEQKTVYLAYLRQMREEITSMDSEAFKKNRIGILAGLTRLRQICCDPRLFIEDYQGGSGKLEQVKDLLVAAKENKRRVLLFSQFTGMLTILQEELAELGISTFYLRGSTKPQDRLSMVDAFNAGEKDVFLISLKAGGTGLNLTGADTVILYDLWWNPAIEEQAAGRAHRIGQKNVVEVWRMISEGTIEERMDSLQQEKRELFQKVIQGNEEQLTKLTEEDIRMILSVGEIEE

SEQ ID NO: 3717 - protein, 543 aa, Enterococcus faecium
  misc_feature (B) LOCATION 1...543
  hypothetical: YES
AKISVSVGRSNDLDHKEMRRVMQGAFVLTIASFIAKVLSALYRIPLQNLVGDEGFYVYQQVYPIYGIAMTLALSGLPQFISKYVAERKNPFERKQALQNLYPLVFWTGVFLWLFVFAFSSWIAWMMGDIQLKPLIQVVSFTFLLMPGLSFYRGNFQGRFLMEPTAVSQVVEQFVRVFVIVCSAFAFRKLGWTVYQTGTAAMSGAVFGGLCAYGILHYYEQKIHGGALSFRRFPLFKQPSKPLIRRFLVEGGLVSIYSGLLIFFQLIDSFFVKNALEVYGLSEYGAKIAKGVYDRGQPLVQLGLVIATALSATFLPALTRHLTNRIYRQFLQTAKIYLRLTTALALAASLGLALLLPYINYALFKDYAGNAALVLFVFSIAFTAVIQAYQSIAQSKNSFRPSLKGAGWGLLVKGLTTSFLTGLLGTAGASLSTLLGLGVTLWYFVRIETKELNAFWKERHFGRKLMFSLLCMTVVLLLYYGVLNIVFGPVTHRSTAFFVSVIGVGIGASVFIYAVIRLRLFTVREWLMLPFGKKILRLNKKIKK

SEQ ID NO: 3718 - protein, 67 aa, Enterococcus faecium
  misc_feature (B) LOCATION 1...67
  hypothetical: YES
RRISFSVMIFFISEYINQTPFYSKNTEKINGGQVSTDFSIIVYFSGAFTDDKNFIMNLKNDTTKIKK

SEQ ID NO: 3719 - protein, 91 aa, Enterococcus faecium
  misc_feature (B) LOCATION 1...91
  hypothetical: YES
VSVSLTGTSSPSLIALIISIVFFAKIRVSLKIVCVCSPAMIDLTPATVASCPVITGKGLLSLPYPTPFNDEMIPKLIGSYGDKTASNVWSV

SEQ ID NO: 3720 - protein, 340 aa, Enterococcus faecium
  misc_feature (B) LOCATION 1...340
  hypothetical: YES
FISSYFHTNVKFSYKYRKRFTGFLLFKQAIIGKSDRESEAEKMNKNDVLLVAKNKSLYFLPSIRSLDVWSGKDLLQSEFIKSARQQLANYQLIVFLDYGFDMEMARRVRPFTNAKIVLFFWNHFKAEHEAMLKQAQDEPAIDEIYHFDFLEAKELGLKHNSSFYSKHMNFSSSEPKTDLFFGATNNGRKERAESYKQEFIKRDVTTNYFILPHRGNEQPGYLTYEEYLKKTGESRGILELLREGQQGVTLRTFESMYFQKKLVTDNQAIAHYHFYRPENIFLLRERDLDELPEFLHTPFKPILSELLEFYDAENWAKRFITNDSTIYEQYEYDLSSVENK

SEQ ID NO: 3721 - protein, 71 aa, Enterococcus faecium
  misc_feature (B) LOCATION 1...71
  hypothetical: YES
RISSLVIFESSSSKVIGVIRANKLVEAESSQTKGLATTPIKRISPEVNFATSSDLFKAIRLGYNSPKTIDT

SEQ ID NO: 3722 - protein, 120 aa, Enterococcus faecium
  misc_feature (B) LOCATION 1...120
  hypothetical: YES
NDSSSFLLLSFSIILPYLIVDLKLCNRTKELIKLANKGQDYEHLADEIDELRDKRQLLLVEDASLSGENERINELIEFIRKNKFRTLEYDDKLVRKIIQSVTVYEEHFVISFKSGIEMEI

SEQ ID NO: 3723 - protein, 64 aa, Enterococcus faecium
  misc_feature (B) LOCATION 1...64
  hypothetical: YES
NDSSSFLLLSFSIILPYLIVDLKLCNRTLYFNSSTPHYSKQENSPSVPENHSYSHLFCSLPPSV

SEQ ID NO: 3724 - protein, 119 aa, Enterococcus faecium
  misc_feature (B) LOCATION 1...119
  hypothetical: YES
NDSSSFLLLSFSIILPYLIVDLKLCNRTTLRTVPVNSIPGFKSSILNTSVRNKGAGISSRISRPGCVSPAKISANVSSPTDRLSASFSTDNRVNFSTASSVPSSFSESWTEVNISFAIE

SEQ ID NO: 3725 - protein, 103 aa, Enterococcus faecium
  misc_feature (B) LOCATION 1...103
  hypothetical: YES
KISSANGLAYSLNTSLTSSSFPGTPFAEVKSISSCSSFVSKCFPPFLYSYCDYTIAYDFCSGKLGIFIFYSEYSKIKKTSEQHSPVFFILIVVYLVFDVAKIC

SEQ ID NO: 3726 - protein, 298 aa, Enterococcus faecium
  misc_feature (B) LOCATION 1...298
  hypothetical: YES
SKSSVPFTKSMEIAETRRRRMKKKRLFALITSAFFILSACGTAAANQEDNSWSNVEKKKELVVATSGTLFPASYYNDQNELVGYDVDLAKEVAKRLNVKISFKEYNVDGQITSVSKRESDFAANDFGITKEREKKFSLSETFKYSFDSMIVRKKDDSGIHSLEDLKGKKAAGEPNTSYMRLAEKHGAKLVTYDNATNDQYLSDVANGRTDVILNDYYLQKMAVSALPDIPVKILENVYFNENESGFLLKEGNDALKKKIDGVLKEMKEDGTTKKISEKYFQTDVSVKPKETMAESVSE

SEQ ID NO: 3727 - protein, 141 aa, Enterococcus faecium
  misc_feature (B) LOCATION 1...141
  hypothetical: YES
TRSSSTIYKSGYRRDQRLIAFEKEGLYMIKGTFKRNDACQIVSFTLTGHADAGPYGSDIVCAGVSALAISTVNGIASLAGFEPIVEMNEEEGGYLYTEVTSGMTQEQNNIAEILLENLLLGLQSIEAENSEYIQIKTINDK

SEQ ID NO: 3728 - protein, 61 aa, Enterococcus faecium
  misc_feature (B) LOCATION 1...61
  hypothetical: YES
LIPSMPYLHSSLTIKKYTKRGKSSLQRPNGMIILFILPGGRLYIFFCSIAHLSRYRQSHTF

SEQ ID NO: 3729 - protein, 129 aa, Enterococcus faecium
  misc_feature (B) LOCATION 1...129
  hypothetical: YES
GVPSSKKFPSSMNMTRLATSLANPISCVTITIVIPCSANFFMTFKTSPTISGSSAEVGSSKSMMSGFIARARAIATRCFCPPESISGYISFLSSRPTVCSNLIAFFSASSLDSFFRSIGAKMMFSKIER

SEQ ID NO: 3730 - protein, 215 aa, Enterococcus faecium
  misc_feature (B) LOCATION 1...215
  hypothetical: YES
RDGFDRRFKRMMNRSIGKKANDYFLEIIEWIPRLIHLQLLWFLCVLPVFTLGTASRTVLYMIYHYKKNEEKKLGSLFWKKFRENFSLYGKQDSLASVYFLLLLIDYQIFRYWGGGIGYTLMYTTLFLLLLSALLFSYKILLQLEQKEASWITAFFLFFNDFKSALFYLAGTLILLVAFWFAGPIYFALLGFSFLFYFQVLLFIHRTQEKVLKKEE

SEQ ID NO: 3731 - protein, 103 aa, Enterococcus faecium
  misc_feature (B) LOCATION 1...103
  hypothetical: YES
YGPSNQAVFLEQHHLTRLASYLISYRTAVLRYPLPDLNQRLDGTTGYLHRWIGLAHCHRSLKHFSLLKIACSKRRFAIKKRTAQDLNKRAAILRYLRHFHKMV

SEQ ID NO: 3732 - protein, 310 aa, Enterococcus faecium
  misc_feature (B) LOCATION 1...310
  hypothetical: YES
LATSHLCIDTQRTRISHQKARGCGHNPGRKNKLRRNVRVFSHKERVRAIQLFLKYDCSYAATIRELGYPSIGALRKWYKEYLESGELHQEHRKKSKYSEEQKRIAVNHYFEYGQCYARTIRMLGYPNRESLRQRCEELAPGARKLRKSAVKLTQDQKEAVLKKFYKPQTNRKNLAESGGISRVTLYQWKNTVLGKDFPLCMTLKNQEKQKELLLKEVEDLQKQVHQLQLEKALLEGAAELLKKEKGVNLLCLSNQEKTILIDALRNQFTLKELLQQLQFPKSSYFYQKQALEKPDKYYKERQINYHDFQS

SEQ ID NO: 3733 - protein, 304 aa, Enterococcus faecium
  misc_feature (B) LOCATION 1...304
  hypothetical: YES
EETSMNNNNKNNNNKMNNQKPVSAHPDPTTPNQSNGVNDEKNKTAPVSAHPDPVVPNVQQGVEEKKHDAEKHAPHHPGTPESKVPEQHDAIDPSKPVEEQKHPSDHAKAQEKLSSDHTNGQGKLGSDHTNNQGKHDSEQEDSMRGELNYEDKVVQKIIGIAIEQVDGLLSANGGFFSNVAGKLVNTDNVTAGIETEVGKKQVAVDMDVIVEYGKDIEKIFEEMQEVIGKEVKNMTHLEVIEVNANVVDIKTKEEFEKDQETVQDKVTDAAKKTGEFASNQTDKVKSAAGSGAQKVKENTEPRVQ

SEQ ID NO: 3734 - protein, 270 aa, Enterococcus faecium
  misc_feature (B) LOCATION 1...270
  hypothetical: YES
NGTSNDLNMRAKGLNPEISQEQWERSQISRHLLKEYVCKQLGIRPQEISTQVLPRDLHAEYFSAMALIATSIERFATEIRGLQKSETREVEEFFAKGQKGSSAMPHKRNPIGSENMAGLARVVRGHMVTAYENVTLWHERDISHSSAERIILPDTTILLNYMLNRFGNIVKNLTVFPENMKRNMSATFGLIYSQRVMLKLIDKGMTREEAYDLVQPKTAYAWDNQVQFRPLLEEDPTITSVLSKEEIDDAFDYHHHLKNVDVIFKRVGLE

SEQ ID NO: 3735 - protein, 101 aa, Enterococcus faecium
  misc_feature (B) LOCATION 1...101
  hypothetical: YES
NPASGNKVRRVAGKRNEPRPGQQRERARRVHVKVLYTGHSKKAGHFRPFGGRKYPDCQGYNPKSAGSHSGFRPQNQEKGLAEAVPHGAGTAGTRRRTVGGW

SEQ ID NO: 3736 - protein, 84 aa, Enterococcus faecium
  misc_feature (B) LOCATION 1...84
  hypothetical: YES
RPASYRRDVGARCRLVASWGCSRSQGLGCSPIKAARELGSERRETVRSLSVAGVGNLRGAVLSTRGPGWTYRWCTSCSAKGIAG

SEQ ID NO: 3737 - protein, 251 aa, Enterococcus faecium
  misc_feature (B) LOCATION 1...251
  hypothetical: YES
IIGFIRIHRKSRYKMKKESRENMKKKKTSAPPVPLVALADQSITAEKYRTIRSNIQFAAIDRELNTLVITSSGPDEGKSITAANLAVVFANSGKQVLLVDADLRKPTVALSFQLPHNEGLSNLLSERERIADDYITETHIENLWVLPSGPKPPNPSEVLGTKRMEEIIEELILDFDLVIFDMPPVATVTDAQILAAKTDGTLLVVRERKTKKQELLKAKELLQIAKANILGVVYNGTKKESDLTYYYQSFE

SEQ ID NO: 3738 - protein, 227 aa, Enterococcus faecium
  misc_feature (B) LOCATION 1...227
  hypothetical: YES
RGGFLRMSKMTKDMSPEDKKMMRSVFWRSWTMNASRTGATQYHAVGVMYTLLPVINRFYKTKEEQADALVRHTTWFNATMHINNFIMGLVASMEKQNSEDPTFDDSSITAVKASLMGPISGIGDSFFWGILRVIAAGIGISIASTGSPLGAIVFLALYNIPAFLIHYYALYSGYSVGASFIKKMYESGGMKILTKASSMLGLMMMGSMTASNVKFKTILEVSAKGAE

SEQ ID NO: 3739 - protein, 158 aa, Enterococcus faecium
  misc_feature (B) LOCATION 1...158
  hypothetical: YES
IFQSSRKTLTLTRLAGNMLNGIVCPTNVFTMQRLAETRDKLTVVNDQFGRPTWTRTLAEFMVYVIEEKAPFGIYHLSNENSCSWYEFAKEILKDTDVEVAPVTSEEFPQKATRPQYSVMSLKKTEALGFVIPTWQEALAQMLEAAKKMNNSSPRGRFT

SEQ ID NO: 3740 - protein, 116 aa, Enterococcus faecium
  misc_feature (B) LOCATION 1...116
  hypothetical: YES
LTQSTFTAPIISCSILLNSSLRLVICCSSSICSFRYFPDSMMKFRSVIFSQALSSYIFANKRSISFCRFSAFFKALAFFFFSRIRSALPTFCILFNTFSSSCCTALAQYCNRSNTA

SEQ ID NO: 3741 - protein, 292 aa, Enterococcus faecium
  misc_feature (B) LOCATION 1...292
  hypothetical: YES
SDQSKHFKEETIMIKITFPDGAVKEFESGTTTLAIAESISKSLAKKALAGKVNGKLVDLTRPIEEDASIEIITPDHEDALGLVRHSAAHLMAQAMRRLYPNIHFGVGPAIDSGFYYDTDNGQNQVTAEDLPAIEAEMMKIVKENLPIERRVLSKQEALEIFASDPYKVELISELPEEEVITAYQQGEFIDLCRGPHVPSTGRIQVFKLLSVAGAYWRGNSNNQMMQRVYGTAFFDKKALKEYIRLREEAKERDHRKLGKELDLFMVSPEVGSGLPFWLPKAPQSDARSNVIS

SEQ ID NO: 3742 - protein, 98 aa, Enterococcus faecium
  misc_feature (B) LOCATION 1...98
  hypothetical: YES
MAQSISVQDFNKLPLDADSIVLDTRNTLDYTKNHLSHSLSIPAAILPRQLKNLDPKKLYYILSYTGRRSEALADQLTANGFRAVYIIGGMEALQSSVA

SEQ ID NO: 3743 - protein, 341 aa, Enterococcus faecium
  misc_feature (B) LOCATION 1...341
  hypothetical: YES
DCQSIIRIRRDQCMEYHELNPLIRGRELELLSNETFERMIQTNSVEALGEILKSTIYSPYIYDGYEYDFEQNLLKEQSRLFRWLKESAPEPEIVWIYTMRYTFHNLKVLTKAEMTNQNLDHLYIDDGFYSLETLKDAIHTQVSNELPESIMDSIREVRDYFEESTILQGIDVIYDRQFLTEQRRLADKLGYQELLTEVIAFIDLTNITTMARGILQKRTYGFMTTVLSSSGSIEKEVFLNFVDKDMEDYTNFLLETDYADFLRPVIREGNLDLVKLEQLKDDYLSSLYQEAQTQAFGPLPLLAFLNAKEVESKNLRLLVIGKRSHFEPETIRKRVRQVYDA

SEQ ID NO: 3744 - protein, 152 aa, Enterococcus faecium
  misc_feature (B) LOCATION 1...152
  hypothetical: YES
KRQSKRLERIQVTKKSNKIAALDTEYAKKKYAEFQQQQRQLIFRRRRLAAIFVGALVIFAIIGVQIFHDMQRMHQLNELRVEANTEMKEVNADVDQLHQDVSLLKDDEYVAKLARSKFFYSKDGEKVYPILESNTDSSTNETDQSTSSTTAK

SEQ ID NO: 3745 - protein, 168 aa, Enterococcus faecium
  misc_feature (B) LOCATION 1...168
  hypothetical: YES
LKQSWQQRSFSNMGLSKLDNLYRQVILDHSSHPHHRGSLTDSTSKIELNNPTCGDVIELQVDVKDGIIKNIAFDGSGCSISTASASMMTDAVIGKSIEEAEHLTVDFLQLVQGKEVKDPDQLGDAAMLGGVTKFPARIKCATLAWKALGKAMENDGTAAFHHYHKEEE

SEQ ID NO: 3746 - protein, 271 aa, Enterococcus faecium
  misc_feature (B) LOCATION 1...271
  hypothetical: YES
SNKSMDQDVPQEAKVMKNSLVNIEKRQKEILELLQQTEQLSTFELAESLDVSISTIRRDLNLLEEKNEIIRNYGYCSYNYKNQTDFDQSGPERIKQAIAREASKYINDYDTLFINSSSTALKTLDFLQSNHLTVITNNVKINYSPHKDNCSYILTGGEMRFPKEALVGDIALNTISSVNADICIIGCSGVDVVHGVTTKILNESTINEMMVNKTIKCKILVADHRKIGLTSKFKIADISVFDYLITDKFCSEKVLEEIRNTGIKTIQVDSF

SEQ ID NO: 3747 - protein, 118 aa, Enterococcus faecium
  misc_feature (B) LOCATION 1...118
  hypothetical: YES
FDKSYDIITYYKNEQKKLFKYKGTKRWDNRHWYDLDQEKKTSILKLMKRLNIDKSLYFSIYGIGSMDVHGTGTINHIASNIGIESALQIHVLEKLSFVITLDTLKVIKEFYRCNIERV

SEQ ID NO: 3748 - protein, 168 aa, Enterococcus faecium
  misc_feature (B) LOCATION 1...168
  hypothetical: YES
SSKSYSYRRRKSRRLIMTIIHEENIFLQQPLDSQEEAFKFLAKQTFCLGIAHDEKEVYQKLLEREKEGTTGIMSGFAIPHAKSQTINEPSLIIVTLNKGIEWNSLDRQSVDFIFALFIPDSEAGTTHLKLLSLVARSLMRKEVTEQLRAAKSKTEIATILTKEIGEDI

SEQ ID NO: 3749 - protein, 667 aa, Enterococcus faecium
  misc_feature (B) LOCATION 1...667
  hypothetical: YES
DEKSTVMRHNRCVIMIDFLFRREFLHIMNQRQQSLIYQLSENNNYITTKKLAEHFHVSERTIHSDLNTIETWLRDKHLPLMFERKKGTGILLNGLPHEREQLKRALNEETQTEMDKKQLRQLLIFHLLVAKDGFSLEELSEKLYVGKRTIRKELTELQSFFEYHHLQLVSKTKLGTFLKGDEQEKRQLLVKTLRNMQKEDPQSPSLKEFFAKDTLKVIQHTLQDVFYENHLEQPNGLASVEIHIYFMLERMKQYQKVKLSKDENEVVEHTQAQKLSSQILAKLATIYPIEFSPDEINYLALRIANLFTNSQAATRFQKESSALADHLIEQVEQFLGYSLKEDQLLKQNLRSHLSSTYFRLHYGLQISNPLTKNVFSTYTQLFLVLQLILEDYFEKENFYVPQEETAYLTIHFQAAIERHKHQKSRRYQTVLVSEYSKAMATFLEARLNRELPELTIMDLVEYKPELKRQDFPSVDFILATLPFKHISIPVIEISPMITETDLAYLTKYMLEHVPIKKKKTFDLASFTHPFLIFPQLERTDPADILNFMGNVLVEHHYVEPEFIDSVLERDSHSSTRVAPFVTIPHGNPLYVKHSMISIATMKEPVLWHGEQIRIVLLLAIKKNDLKHAEFKKIFSVIHYLEKQPEQMAQLMQSNHPLEILTLLSSYE

SEQ ID NO: 3750 - protein, 765 aa, Enterococcus faecium
  misc_feature (B) LOCATION 1...765
  hypothetical: YES
SMKSTNKRSESKNVRCCFNKANNKKGSEIVMMKTVILAEKPSQAKAYADSFSKATRKDGYFEIQDRLFPGETVITYGFGHLVELDSPDMYDENWKQWSLEHLPIFPTHYHYHVPKDKKKQFKVVKQQLQSADTIIIATDSDREGELIAWTIIQQAGADHGKIFKRLWINSLEKEAIYQGFQQLRDAEETYPKFEEAQARQIADWLIGMNGSPLYSLLLQQKGIPGSFSLGRVQTPTLYMIYQLQEKIRNFQKEPYFEGKAQVIAQNGAFDAKLDPNETQATQEAFEDYLKEKGVQLGKQPGTIHQVETEKKSAASPRLFSLSSLQSKMNQLMKASAKDTLEAIQGLYEGKYLSYPRTDTPYITEGEYAYLLDHLDEYKHFLKAEAIPTPIHTPNSRYVNNKKVQEHYAIIPTKTVMTAAAFEQLSPLQQAIYEQVLKTMVAMFAKKYTYEETTILTQVQQLQLKAIGKVPVDLGWKKLFGKESDGKEKEEEPLLPKVTKGEMVTVDLQVLEKETKPPQPYTEGTLITAMKTAGKTVDSEEAQSILKEVEGIGTEATRANIIEILKQKEYIKVEKNKLVVTNKGILLCQAVEKEPLLTSAEMTAKWESYLLKIGERKGTQTTFLANIQKFVSHLLEVVPGQIQSTDFGSTLQEVKAASEKQEAARHLVICPKCQEQEVILYQKVAACTSEVCDFKLWTTIAKKKLTATQLKEIIQNSRTSQPVKGLKGQKGSFEATIVLKEDFTTGFEFSEKKKTNFKKRTRRTTK

SEQ ID NO: 3751 - protein, 89 aa, Enterococcus faecium
  misc_feature (B) LOCATION 1...89
  hypothetical: YES
HKKSIIKSRKLFDMLVEKGKENIYYVNVAKVREDENEWKEFKSRYSINSTPTFTVYREGSIEKTVFWTKESGMSLAEVEEFLDYVSMQQ

SEQ ID NO: 3752 - protein, 332 aa, Enterococcus faecium
  misc_feature (B) LOCATION 1...332
  hypothetical: YES
TWKSNDMGDYCYCWYAVHRSCPLFDFWQGGCVVAILTLEKVSKSFGTNKLLDDLSFSVEEQTIFGFIGKNGAGKTTTMKLILGLIKKDSGTIRVNGKEVEYGQTTTNQEIGYLADVPVFYDYMTDSEYLIFCGELTGMPKQRIKEKISELLSLVGLSNEKKRIKKFSRGMRQRLGIAQALLNEPKLLICDEPTSALDPVGRKEILDILSSVKEQTTILFSTHILSDVVRICDKVAFLDNGKIVLSGSVDELKKQTNASGFEIVFFSKKEREQFEELLPGGMIRSELRIAYPQKSKEEMLFAMDLLAKYQLPVQSVQMEEPTLEKLFLEVVQS

SEQ ID NO: 3753 - protein, 935 aa, Enterococcus faecium
  misc_feature (B) LOCATION 1...935
  hypothetical: YES
QNESVFYDGGGVNKLLKKEILCYLENQTAFFDLEHMNEVFTAQRLADHFGVKRNTVSHYLNQLNDEQLLVKINSRPVIYFHKEAFEKQFFKLRTNFYFSIDDLKEEQPFFAQPKDLFSFMIGYDASLKESIEQIKTALYYPDGGLPLLITGESGTGKSYLVNLVYQYCLLHDLLEDSAPFITFNCAQYADNPELLTSNLFGHVKGAYTGAEENKKGAFEAADGGILFLDEVHRLTPEGQEKLFTYLDQGVIYRMGEPNLSRRIKTRLFFATTEEITSHFLTTFIRRIPIRIELPALNQRSRNERLELIYSFFLEEQRKMGSPLSVSGPALSLLTSQKLSGNIGELKNIVKVSAAKAYAEQREQPEIHVTIHQLQKELLAQPITKNTAQQGIYITQDQTLEQLMEKQQPEQQRIVKSFEQILIDFKKNNCLLYSCEGKLKQEVIQLFDFLLFETSRQEKHELLVYWTQSIRETFRQMETAYQIKFDGNSVYALSYYLYQRSTIKWLPEEHDIIQLIKELEQQVSQSYPSSYHYVQRILELSKIKLDIEDTSMDRILLTIYLKKAKWSKEKRLPKAMIAAHGYATASSMANVVNRLLQEDLFESFDMPLDVTPQQIASEILDYCENSDVSNGLIILVDMGSLKEIHQFFKKQLSVPLLILNNVTTPLAITVGECLQKNVSLEEIAEETVRQIQPEWRLLYPEENKPKALITTCFTGIGTAVHLSELLEKSLPTACQLKIIPYEYQQLKDKKNSDPLFSIYEVVGMIGTTDPDITNIDYLSLEDLISGEKMSVLAEWLDTTMNASEKEIFNQRIIRNFSLEKVLDSVTILDTEKVMGEIDHFMRELEVQLNRSISNPKKLALYVHVSCLIERLIRQMPIETYQGLEKWKQCQKEGLSAIKSAFSVIEEHYSVMIPNSEIAYIYDILSEDTEFLSIEEF

SEQ ID NO: 3754 - protein, 375 aa, Enterococcus faecium
  misc_feature (B) LOCATION 1...375
  hypothetical: YES
MAFLFVSLNYTNGEDINDDGSRKKVEKVGGDTRPEAEAALRKVLSDIDETGQYFLGTDTRVKQYLDFWMEEYVKLNLKYNTYENYRFTIKNHINGYLGKKKLTDLSPALLQNFINAEFKKGYSKKTMTITHSVLKNALNMAVYPWGLIKQNPMLYVKIPKYEARPTTKKDLKIISLEDFDHMLEITPEGHPFYIPLNIGFYTGMRVGEVCGLTWDDVDFSNGTITVEKQMVKNDGAWVYGTPKTSSSNRTIFIGQTLLAILKKHKKQQLENRMKYGKLYIDSNAVCTKEDGELVTPSVVKWNTRRISNALSLSFNFHSLRHTHATLLLENGAKMKEISERLGHSRISITMDTYSHVTDKMRNETVDIMENLRKNS

SEQ ID NO: 3755 - protein, 252 aa, Enterococcus faecium
  misc_feature (B) LOCATION 1...252
  hypothetical: YES
MAFLFVSLNYTNGELKKRILVTIGLAFLLAGCTNGNESKKESTKETAKATVATTTTTSTESKSTAASTETADTSTSSESSKTTETTQTSTSSSSVEASSSSSESSEQVEQTLWNADKSAQLEAFMTKWGQTMGQQYKSYTNQMSVDLYGLKVPQAILNGEWKMAIGGVPVSAEWSESGTGQADYQITAVYSDAETEPYLKKHVYLFGFQQNQPKVLVTQQNQGNPDNYLYFNETANNELKNGFNQIVYGQAN

SEQ ID NO: 3756 - protein, 75 aa, Enterococcus faecium
  misc_feature (B) LOCATION 1...75
  hypothetical: YES
TIRSVFTVNERFSFARSFAEVLIPIIAAIILSPRITNNTVAVFFISITLHIITFYLIKELYKMKMMRTRQSVVKI

SEQ ID NO: 3757 - protein, 137 aa, Enterococcus faecium
  misc_feature (B) LOCATION 1...137
  hypothetical: YES
SRRSNQKMSSPGVVPLLDSLKEEKIKIALASASKNGPFLLEKMGLTPYFDAIADPAEATNGKPAPDIFLLAAKAVGLKAEECIGIEDAQAGIQAILSSGAQPIGVGRAEDLGEEIPLVPDTTFLTIDYLKEKWHDHG

SEQ ID NO: 3758 - protein, 412 aa, Enterococcus faecium
  misc_feature (B) LOCATION 1...412
  hypothetical: YES
EDRSFLRILTSFFVGRGSKMTNKVRELGVSSIEEMFDLATYAFNGADTPERRERFRTLAENSWNYGFFDEEDRLTSQVMATPFPVNFYGQEYLMAGIGYVASYPEARGQGGINQIMEKILEDCRDRKVSLSYLAPFSYPFYRRYGYEQSFDKISYQLNSRDVPFIKKKSGKIKRMDFEDAKAAIRRIYEQMPENQRAGLKREDWWYTYKFKQKGNYQFALHFDDNEEATGYIVYQLATSSFIIAEWGFLDHDAFCSLVRFVSSHNGAFETFEYSCGYGGNDQNYLLENPFASVMITPYMMARIVDISLFLENYPFKKRQAAFALQIEEDHYAKWNEGIVEVTIENGKNHLSKVEQTKLPIVRGSIQHITQLLLGYRKVEELVFQERIQVTKEYEETLSSILPQQQPILNDYF

SEQ ID NO: 3759 - protein, 329 aa, Enterococcus faecium
  misc_feature (B) LOCATION 1...329
  hypothetical: YES
YSRSRKKNLKNIWRNILMTKLVFMGTPAFSVPILEGLIESGYEIQAVVTQPDRPVGRKRVITPTPVKEAALKHGIRVLQPEKISGSPEMEEIIELVPDVIVTAAFGQFLPEKLLQVPKLGAINVHASLLPKYRGGAPVHYAIMNGEKETGVTIMEMIKKMDAGGIYAQESIPITKQDDVGTMFEKLSLLGRKLLLETLPNILDGQKPVPQDESEATFSPNITREQEAIDWHKTAEEIDNQVRGMRPWPIAFTTYEGIRWKLLSVEVLAETTDKAPGTIIRKDKKNLWIACGKQTVLAINELQPAGKGKQAVHDFLNGSGQQVQIGQQVK

SEQ ID NO: 3760 - protein, 460 aa, Enterococcus faecium
  misc_feature (B) LOCATION 1...460
  hypothetical: YES
NRRSTMNKNISLKESIAVLIVLLALLGVLIIGFQLSPHIPILAAFMCLLFYGRFKKFTWDEIHDGIIKGITPGIIPILIFLLIGVLVASWILSGTIPTIMVYGFKLVSVRFFLPTAFLVCAIVGVTVGSSFTTISTIGIAFLGIGHLLGFNDAMTTGAVVSGAFLGNNCSPLSDTTNLAAGIGGVNLFEHIAGMRYTDFPAFVLSLIFYTILGHNSHSADLASINEMIQNMKASFWISPWTLIPLVILFGGAIKKIPAIPTLLAGSTAALVLSFIHEKSLTVGKAADILMNGYVANTPDPKLDELLSRGGIMSMLGSASLILLALALGGLLIKYLIVDTIVQELKEKMDRPSRLVGFTALSCIGINLIVGEQYLSIILPGETFKRSFDDVGLSKTYLTRTLADSGATVNSLVPWGVSGTFIMGTMKVSALHYLPFAFFSILAPVFTILGGFLLNRRRVKN

SEQ ID NO: 3761 - protein, 268 aa, Enterococcus faecium
  misc_feature (B) LOCATION 1...268
  hypothetical: YES
CFGSCNRSRRYHDSQLFECIRRIRRISSSTACLSANWQTMYTLWNADRENKSGTKGDALLSELSKAKNRKVGFVLGLTGGIATGKSTAAKVFQSHGFPLIDGDVIARETVEPGTLALRKIVSVFGQEVLQPDGQLDRGKLGMIVFPSKEKRQKLDQLLDPFIRKAIKDQIASLSSNHPLVIVDIPLLYEGHYDHYMDAVAVVYTTPETQLQRLMKRNQLTLEQAQQRISSQLPIEEKKQRADILFDNNGTKEKLVGQIENWLFANRFL

SEQ ID NO: 3762 - protein, 178 aa, Enterococcus faecium
  misc_feature (B) LOCATION 1...178
  hypothetical: YES
SIGSFSSVKALANSRPTMNSSNRSVNRGSSGFFFAKGETSTGCPYTNVGCVNVSSTNVSKNSLITCPTPIASVTSTLCFSAKANASSNVISCQKSTPVCSLIASTIWMRLKSLSKSTACPSYVIFAVPSTFSAALRIIPSVRFITSLKSVYAVYASNIVNSGLCVVSIPSLRKTRPIS

SEQ ID NO: 3763 - protein, 173 aa, Enterococcus faecium
  misc_feature (B) LOCATION 1...173
  hypothetical: YES
GAGSPPFNTEPSGSTPIINKELEKTGEPVTLSLDCFPTQTKQELIHLLTEKSKATKKNLVNAWHGLLPERLLVFFLERLEMDSLTGQQASQKQIQDFVQLCKEFKLPVNKTFPIEKSFVTGGWVSLKEIHPKTLESKIIDGLYFAGELLDVNGYTGGFNITAAFATGHVPRRN

SEQ ID NO: 3764 - protein, 438 aa, Enterococcus faecium
  misc_feature (B) LOCATION 1...438
  hypothetical: YES
WDGSVFFYFQKGGNHMLDVKMMRQNIEEVQEKLMTRGVKKETLAEFMELDENRRKLLVKSEELKKYRNDVSAEIAQLKRAKEDASAKIAEMKEVGGNIKALDTEIAEVDEKLKQIATTLPNLPHDSVPVGTDEEDNVEIRRWSEPRTFAFEPKPHWEIAENLDILDFERGAKVAGSRFVYYKGLGARLERAVYNFMLDQHIYEHGYTEMITPYIVNSKAMFGTGQFPKFKEDVFQLENTDLTLIPTAEVPLTNYYNDEILDGADLPIYFTALSPAFRSEAGSAGRDTRGLIRLHQFNKVEMVKFSDVEHSYEELEKMTADAEDILKKLHLPYRVMALSTGDMGFSAAKTYDLEVWIPAQDTYREISSCSNCEDFQARRAMIRYRDNDGKIHYTHTLNGSGLAVGRTVAAILENYQNEDGSVTVPEALVPYMGNLKVIK

SEQ ID NO: 3765 - protein, 124 aa, Enterococcus faecium
  misc_feature (B) LOCATION 1...124
  hypothetical: YES
EFGSSPLALPGMNGHELLREFRAQNDTPILMMTALSDDENQIRAFDAEADDYVTKPFKMRILLKRVEALLRRSGALAKEFRVGRLTLLPEDFRVLCDGTELPLTRKEFEIPFAAGAEQRQNLNP

SEQ ID NO: 3766 - protein, 403 aa, Enterococcus faecium
  misc_feature (B) LOCATION 1...403
  hypothetical: YES
MSGSRTVWSNPETKSNLMSNGKTFDVTEVGVFSPKAVARDFLMVGDVGYITASIKTVQDTRVGDTVTLADNPAAEALPGYRKMNPMVYCGLYPIDTSRYNDLREALEKLQLNDAALQFEPETSQALGFGFRCGFLGLLHMDVVQERLEREFNLELITTAPSVIYHVNKTDGTTATVDNPADFPEPVTIQDVEEPFVKAQIMVPNDFVGAVMELSQRKRGEFITMDYLDDYRVNVVYNIPLSEIVFDFFDKLKSSTKGYASLDYEMSGYQKSKLVKMDILLNGEKVDALSFIVHRDFAYERGKAIVEKLKKLIPRQQFEVPIQAAIGQKIVARSDIKALRKNVLAKCYGGDVSRKRKLLEKQKEGKKRMKQIGSVEVPQEAFMAVLKMDEDEPKEIARVCLKTV

SEQ ID NO: 3767 - protein, 394 aa, Enterococcus faecium
  misc_feature (B) LOCATION 1...394
  hypothetical: YES
GRGSQMISKEKRTSILYSFIALLFSIALYFNANGQSVPNTLSGNEAYNQTVTGVPIKISYDSKRYYIHGYENAVTVKLSSANRVQLNAEANEDTRMFRVTADITKLGEGTHEVPLKIQNLSSAVTAKIEPSTITVTVEKKVIKDFDVETLIPSTFTPSGYELDDTSVSPKKVSITTGDKTLAEIKRVVADVDASMVTDDGINSEVPIQALNAAGEVLSIVSDPVQVTVRADSIKPSKSVRLYGIQQGTPAAGVESYDFSFSKLEAEVSGSSDLLASIGDSIAVPINVSGINHRTTRKIEIPVEEGLSIKPESVSVEITPVLQTSSSSSASTSSRTQENTSTSRSISSADSGTEPSTTTISSSSESGTSSSTTSTEETSETSESTQMSRTNSSEN

SEQ ID NO: 3768 - protein, 69 aa, Enterococcus faecium
  misc_feature (B) LOCATION 1...69
  hypothetical: YES
ELLSSLKAERFFHHLSTKRCSPTNWSQVTIFIKHEKLFFEIVPCDWKLSGSFLFLEADHFCHNLFKNDG

SEQ ID NO: 3769 - protein, 360 aa, Enterococcus faecium
  misc_feature (B) LOCATION 1...360
  hypothetical: YES
TILSIKIFYFFEECVKMVGIRDVARKANVSPATVSRVLNNDQTIHVAQTTRQRIVEAAAALDYDISTRKYIKKRMPSIGVISTIGKASEEQDIYYKHLRVGMEEEARRLHLGMNRIYNLSDNPKQWEDLDQLGAVIVVGTVTKESITALLKQNMQIVVVDNPDIQQEVDMVYADLERMTKTVLELFLENGHKRIAYIGGYKVDMDEFGGKQISINEKRMRAYQHFMIDHHLEKYMSYHLGGWTEKQGEVLATNLLENESPLPTAILVGSDPMAIGVYRALKQKNIQIGEEIVVASFDNIETIANLSPGLTSVQINAKSIGQAAVRMALERIDGIRDEPIILTYPARLIVRESFIPRTKRY

SEQ ID NO: 3770 - protein, 114 aa, Enterococcus faecium
  misc_feature (B) LOCATION 1...114
  hypothetical: YES
SPLSRRKCRGYFRNRTDASDESRRRRNYYTDEAMARRASSALYYGRRNEYRGPTPTISDLFRTSEGLVRSKRDRLSEVWKTHRKERGTKVKNTFVSRSKHVQTAEVKATPSEIS

SEQ ID NO: 3771 - protein, 259 aa, Enterococcus faecium
  misc_feature (B) LOCATION 1...259
  hypothetical: YES
EFLSIMHLADMFIGNSEWIGAIAGTVGHLAVFLLALFLASKVEGKRIEDYGVSVRGKDWGYLAGGLVVGIGVFLLITSPLYLTGAYRLDSGNANIVPLITSFILFIAVGASEELLFRGFFQHQMLRFGPLIAMIGSAALFALLHGLNPNMTFLAVFNIFLAGCFFSALIYSTGSLFTAIGAHITWNWTQGAILGIPVSGTQEQGFFSTLIQSQNTIITGGNFGAEASISTTLFLLVLIVGLLLYAYKTKRMKKYTAVYQ

SEQ ID NO: 3772 - protein, 107 aa, Enterococcus faecium
  misc_feature (B) LOCATION 1...107
  hypothetical: YES
LKLSIIKRFINGKRISFFKITYKKEHKTKSFVLCSSFIILCFLFYQITLFFYKISAPSVDSKCLNAHSCPTGSKLATESLKIWSLYPKLYASTAVCNTQISVHTPVK

SEQ ID NO: 3773 - protein, 349 aa, Enterococcus faecium
  misc_feature (B) LOCATION 1...349
  hypothetical: YES
AIMSVFVTFVFGYYLSKSYDVEVFFGGAVSFASFLILTPFAMKTAGGEDVTGVLSLDRLGAKGMFIGMIAAFLAGEIYCRITKRGWQIKMPDGVPPAVTKSFAALIPAVVTLTIFLVINAVMTGIFNANLHDVVYEVIQKPLTGLGSSLPATLIALFFVQFLWFFGLHGQIIVNSVMDPIWNTLMLDNLEAYQHGKELPHIITKPFMETFTVGIGGSGMTLAVVLLMAFVLKKKQYRDVGRLALAPGIFNVNEPAIFGLPIVLNATILIPWVVAPLIVTTFNYLVMAAGLVPAPTGVSVPWTVPIIASGVLATNSWLGGMLQVIDFVIVAFIWYPFLKVLDKQPDLDIA

SEQ ID NO: 3774 - protein, 242 aa, Enterococcus faecium
  misc_feature (B) LOCATION 1...242
  hypothetical: YES
RDVSSAVHTIRQAIAVLVNEGYLRKEKGSGTYVDDSYKKEKTPLNRTKTIGVITTYLSDYIFPSIIRGIENELRESGYSLLLASTNNDHELEKECLKKMIAYGVDGLIVEPTKSNQYNPNLALYVALREQGIPMVMINAAYEELNASYICLDDVKVGFMAAEYLIKKGHQRLLFITKIDDLQGKYRMKGFISACEQYNVRFLTEDIITFTTETRETIAEKTVQRLKEEQALDGIICYNDQNS

SEQ ID NO: 3775 - protein, 235 aa, Enterococcus faecium
  misc_feature (B) LOCATION 1...235
  hypothetical: YES
WTSSIACRKTTNNWLKRSSLLQMLRISRGSKVYKDGLKRGIDFLLSLVGIIVLSPILLILCIAIKIDSKGPVIFKQKRVGKNKSHFYIYKFRTMKVDTPQETPTHLLSNPDFFITRVGKFLRKTSLDELPQLFNILKGDMAVIGPRPALWNQYDLIEERDKYHANDIRPGLTGLAQISGRDELEIDYKARLDGQYTANVTPWMDLKCFFGTIISVFKSDGVVEGGTGSVKKEDAK

SEQ ID NO: 3776 - protein, 80 aa, Enterococcus faecium
  misc_feature (B) LOCATION 1...80
  hypothetical: YES
LDSSEANHAAVAAISFGSPTRPSGIILSKSSFCSGSSNFAALIGVRIAPGPILLILIPFGAYSIATVSVNNFTPPFEAAY

SEQ ID NO: 3777 - protein, 378 aa, Enterococcus faecium
  misc_feature (B) LOCATION 1...378
  hypothetical: YES
RKPSKTAEEKQKSTRGGGTAAMKKLQSLFLGILIIIAVLLLGVRQLEKTSGMSGAKVLTIYNWGDYIDPSLITKFEKEYGYKVNYETFDSNEAMFTKIQQGGTNYDIAIPSEYMIQKMIKEKLVLPLDHSKIKGLNNIDPRFLDLDFDPDNQYSIPYFWGTLGIVYNDKFFDANQIKHWDDLWKPELKDSLMLIDGAREVMGLSLNSLGYSLNSKNMAQLTEAANKLNHLTPNVKAIVADEIKMYMINEEASVAVTFSGEAADMMWENEHLHYVIPPEGSNLWFDNIVMPKTVKNKEGAYDFINFMLEPENAAQNAEYIGYSTPNEEAKALLPKDISSDEQFYPSDDTISHLEVYKDLGSKYLGIYNDLFLEFKMYRR

SEQ ID NO: 3778 - protein, 80 aa, Enterococcus faecium
  misc_feature (B) LOCATION 1...80
  hypothetical: YES
TYQSIGLIHSKILFYDTYEIKEHRPIFGPMYRLVINDYQPDLISSFYCNLMQTQSRNTAVIAFKIIRKSPSYLSKCDLTA

SEQ ID NO: 3779 - protein, 219 aa, Enterococcus faecium
  misc_feature (B) LOCATION 1...219
  hypothetical: YES
RFKSLYFIKNRRTTMTDLLTKTRKINTLLQQKNTFDMQADLPYDKMAVTLGGILDSNTYIIGSDGVLLGYNERHDVNNERIKTMFVEKQFPESYTDTVAQLMKTEANIPITSDITAFPVESREKYPFGLTTVVPIFGAGERLGTIILSRMEQSFADDDLVLAEYGATVVGMQILYQKSRSIEADVRSATAVQMAINTLSYSELKAVQAIFEALDGDEGR

SEQ ID NO: 3780 - protein, 329 aa, Enterococcus faecium
  misc_feature (B) LOCATION 1...329
  hypothetical: YES
TLKSFKSYRPHLFLSAGFLIPFIQQSRAQELKVPLGKELSGMAPSDMLTHILNNNYNNYTIGLFLFLGLIGAFIFIKKLTADDLFIFFLGVFVLFCSTNLFPWQLFNHTPVKSLQFVWRLNGFSSLFIAYTMSIVIYYIFSTKNNSWKIMVFTFLALILHLSGVSNSIHANKDSLTLIAPEDAVAIAENYNHTDYANKESIYHPDMINNDQYLLGNQEINPTTHFMSNKLTIELDNSNNKNTVLTTPIYRYKGQVASINGKLVQTKLSKFGTTELTIPPGINKVVITYQYTKLAIASRYLSIVTLILFLLYRFTFSKQKQPRREVQHSH

SEQ ID NO: 3781 - protein, 67 aa, Enterococcus faecium
  misc_feature (B) LOCATION 1...67
  hypothetical: YES
ELKSSWPFSHSTKPPKILRQAEPDPRRANLERERSSNPSLRAVLQAPAKAASPLAEEANPAAVGTKF

SEQ ID NO: 3782 - protein, 312 aa, Enterococcus faecium
  misc_feature (B) LOCATION 1...312
  hypothetical: YES
LPESLTRPLQKKKTLVVDAVLSPTPRACRSCVSTVVDGNGKAIIVKNGKKETIVRFEQYNHMPLVMRLKKQRYTCKNCRTHWTAQSYFVQPRHSIANHVRYKIASLLTEKVSLSFIAKSCQVSLTTVIRTLKEFKSYLPKQSKKILPRVLMVDEFRSHASIEDKMSFICADGETGKLIDVLPTRKLPRLTSYFLGCTNPEEVEFLVTDMNAAYFQLTKRVLPNAKVVIDRFHIVKHMNQAFNELRIREMNELRKAGQKSQAEKLKKNWRFLLKNRANINHYEYKTWKSFRAPKYPFPTEAMMINRDPAXLLI

SEQ ID NO: 3783 - protein, 346 aa, Enterococcus faecium
  misc_feature (B) LOCATION 1...346
  hypothetical: YES
CDWSSLRFAYDHNYTQSGVERWRCKLMWKTILRRVLLMIPQVIILSVLIFLLAQAMPGDPFTGLINPNQDPAVIEQMRQAAGLNDPWYVQYFRWIGNALQGDFGQSFLYKRSVADLIGERIINTLYLSILTVVLTYLIAVPLGMLAGRYQNSILDKIVVIYNFFSFAVPLFIFGLIMLFVFGYRLGWFPTSGSQTLGLQGGFITQWIDRLKYILLPSITQAFLATAVTIQYLRSEVIDSKSLDFVRTARSKGVPTNKVFSRHIFRNAALPMASQMGYEITSLIAGSVVIEKIFGYPGVGKLFIDSIGQRDYTVITSLVLILGIATLVGTLLSDIIMSIVDPRIRIQ

SEQ ID NO: 3784 - protein, 82 aa, Enterococcus faecium
  misc_feature (B) LOCATION 1...82
  hypothetical: YES
QKWSASRNKKEFTKIASQIFVIFRLIAEEVTANIADPMIKKATTLEVYVANGKLVCPVFYVTKYPRLNHLHRWLDTNNAIFL

SEQ ID NO: 3785 - protein, 429 aa, Enterococcus faecium
  misc_feature (B) LOCATION 1...429
  hypothetical: YES
RKRSASSDWSAGEIMKKIPKKMKKSVRYMALLTLERVNKGGAYSNLLLNEMIKQSELNQKDVGLFTELIYGTISHQRLLEFYVAPLIAKAKKVDDWVKTLLYLSVYQLEFLDKVPAHAILNEAVEIAKVKGNPGTGKFVNGVLRNYQRQGAPDLQGIADPIERLSVKISLPLWMTKRLVDQIGYEETEKLGLSLYQPSHASARVDTRRLSRDQAITVLQEEEITAEKSQVSPYGIVAKKGHLASSSLFHDGVMTIQDESSMLVAPSMQIEPEHHVLDACAAPGGKTTHIASFLDPSCGGEVVALDVHEHKVKLIEDNAARLGVSSAVYAQKMDAREVSKQFEAEQFDRILVDAPCSGLGLLRRKPDIRYKKQPDELANLPKIQLEILESCAPTLKSSGILTYSTCTILKEENQDVVSAFLERHPDFGSD

SEQ ID NO: 3786 - protein, 79 aa, Enterococcus faecium
  misc_feature (B) LOCATION 1...79
  hypothetical: YES
DIRSSSNPLTRVVIIATTRLTASPAKYQKKVPEMNAGNVVRLPNTKAIAFTWANPITAPPAAAPMQAATNGFFNGIAIP

SEQ ID NO: 3787 - protein, 234 aa, Enterococcus faecium
  misc_feature (B) LOCATION 1...234
  hypothetical: YES
WIRSGTNTGGNTMLLLLTLILFEIPYFLEKILKIQIPNMLEIILLSFIFSSTVLGELSDFYGYFSMWDTFLHAFSGFLAGGVGFSLVYLLNKNTKTMNLTPLLLAVVSFCFSMTVGVMWEFVEFSADKLLQFDMQKDTIIQQINSVELSKDGNTVYHVPDITRTIIESQNADGKTDKTIIQNGYLDVGIMDTMKDLFVNFIGAVVFSVFGYLYSRNDYQKFTFIKNFIPKKIKR

SEQ ID NO: 3788 - protein, 62 aa, Enterococcus faecium
  misc_feature (B) LOCATION 1...62
  hypothetical: YES
HHGSVFMFMYFIGGAAGSLLGTTMWQQYGWLGVTVSGLVFQGCAFFFQTVVFKGKRNLENKK

SEQ ID NO: 3789 - protein, 159 aa, Enterococcus faecium
  misc_feature (B) LOCATION 1...159
  hypothetical: YES
TVTLELLPKGDGLQLFISKNLPDEEISQSEDSTVDSEDVSDFLRQQIIGSDPEEELSGSALEEQERQATFAFEDFEQVIQLATDVELESAWTDLYLFEERYYLVVHFWMENLNQADVENQIARILEFAEKSDRTPETLNEYGQCLMARNAIERTKFYFV

SEQ ID NO: 3790 - protein, 65 aa, Enterococcus faecium
  misc_feature (B) LOCATION 1...65
  hypothetical: YES
TTTLRTFKKFLPQIQNALHYSYSNGPLECLNNHIKVLKRNAYGFRNFYNFKLRIMIRHGKTFLTK

SEQ ID NO: 3791 - protein, 339 aa, Enterococcus faecium
  misc_feature (B) LOCATION 1...339
  hypothetical: YES
IRFLPIFFCKFILFETKRSKRRMFFVEGRIMEIKRLSDQMISESFAKHAQDVYILPASEVFYIYFRYGKKRTFWKKVSSADGQQLISRFKYLGQMDIGEKRKAQLGAFTYSLEKQEVRLRLSSVGDYLQRESLVIRLLYGTFETPHRCFSSRDFATILQKTVRRGLYLFSGPVGSGKTSLMYRLALEEKLQVITIEDPVEIEEPFFLQLQINPKIAQTYDTLLRLALRHRPDLLIIGEIRDESTAHAAVRAALTGHRVFATVHARNLEGTLVRIHELTKKKEELSECLAGVIYQELLEDANHHPSVLWSYQFMEEESVKKSWEESYEEAQENIWQSELF

SEQ ID NO: 3792 - protein, 155 aa, Enterococcus faecium
  misc_feature (B) LOCATION 1...155
  hypothetical: YES
MNTFEGNLVAENIKIGIVVARFNEFITSKLLAGALDNLKRENVGEKDIEVAWVPGAFEIPLIASKMAKSKKYDAIICLGAVIRGSTSHYDYVCSEVSKGIAQISLNTETPVMFGVLTTDTIEQAIERAGSKAGNKGSECAQGAIEMVNLIRALEV

SEQ ID NO: 3793 - protein, 294 aa, Enterococcus faecium
  misc_feature (B) LOCATION 1...294
  hypothetical: YES
HRFFLLFQFLHTIWAKDKFLPHMYQDLGDRLGYSNGIITLALGSIVLLFIFHGSTERLIPLYSIGVFIPFALSQTGMVVKWKKEGKRWLSKSIANITGAFISYAIIAILFVYRLGDIWPFFIIMPIVMFIFYKIHDHYKKVAEQLRLENDAKLHDYDGNTVLVLVGNVTRVNIGALNYARSIGDYVVAMHVSLDEDVEKEKEIEAEFKKHFPDVRFSIVHSSYRSIENPIIRYVDIVSKNAAKQNYTTTVLIPQFVPNRRWQNILHNQTSLRLRLRLSWRENIVVSTYSYHLKK

SEQ ID NO: 3794 - protein, 179 aa, Enterococcus faecium
  misc_feature (B) LOCATION 1...179
  hypothetical: YES
EGTLLNRKEEQSMIGISACLGGLACRYDGQKKEVPELMELVETGEAVMVCPEVIGGLSIPRDPAEIIGGNGFDVWKDQAKVWTTSGEDVTEAYKNGAIKAYQKLQEKHIDLVIVKEKSPSCGTHSIYDGSFSGITKNGAGVATAYFIQQKMTVLSDEEWLKTRGEQNGNRKDQSNERAL

SEQ ID NO: 3795 - protein, 61 aa, Enterococcus faecium
  misc_feature (B) LOCATION 1...61
  hypothetical: YES
QFLFTSVIFIHKLLITFVNERCEISGESQNAGKNQRFRMGDHAGYLDTWADDCPRNHADLS

SEQ ID NO: 3796 - protein, 408 aa, Enterococcus faecium
  misc_feature (B) LOCATION 1...408
  hypothetical: YES
VYFPIFSIMYVMLSSGYILYKGMMRMEFIGILCLILISTTIGSHISRRLGIPAVIGQLLVGVLLGQAGLNWVKPDILVHDFSEIGVILLMFLAGLESDLSLLKKYFRPGMFVALLGIIFPVVFGWLTGKAFQVSGNEAIFFGIILAATSVSISVEVLKELNVVNTKEGSTILGASVVDDILVVLVLSFSLSFLTGEASSNASLPLVLIEQLIYFVFIFLLVKWIAPFLLSFAEKVYANSSIIIVSLVICLGMSYVADLVGLSSVIGAFFAGIAVSQTKVKEEVYHNVEALGYAVFIPVFFVSVGLEVDFSDFSEQLLFISILTLVAILTKLLGGYFGAQIAGFSQHSSLMVGAGMISRGEMALIILQIGQQSQLIEPQYYSPLVIVILLSTLISPLVLKYFTKKVYEV

SEQ ID NO: 3797 - protein, 213 aa, Enterococcus faecium
  misc_feature (B) LOCATION 1...213
  hypothetical: YES
VILFTLRKKGGKRYMNYFISDMHFFHERLLGKNDFAPRLFANVDEMNQQLITSWNAVIKETDHVYHLGDLAMHPQYEKANAEILELVTQLQGTIHLIKGNHDSRAFFRYLEKNDPRLTDGSPKFYFYDVGAIVKFDHQQYYLTHYPMLLGPNDTIRNLHGHIHHYSVPIENDVNVGVDAPERELLKEKLPFGTPLSEQQIKEIYEAKRKYDRS

SEQ ID NO: 3798 - protein, 92 aa, Enterococcus faecium
  misc_feature (B) LOCATION 1...92
  hypothetical: YES
YVFPFLLLIPKETDITYYVLNFFGKANYDKIYLALKKLAEKISHVFKKIQSKKAAVNRMETKMARHQSVSPCFLLYTLDMEQVTIKMIISRY

SEQ ID NO: 3799 - protein, 291 aa, Enterococcus faecium
  misc_feature (B) LOCATION 1...291
  hypothetical: YES
PMFPFFKKKPLKLQNTIILVVCFSTFVSLIVSAILIRNFILSMNRSSVSDKISSIAKIVANDKLIQKKLQTGDPTHAIQGITNEIMIASNLDFIVVMDPEGIRYSHADPSYIGLPFSSHEDVKKVIGGQEFFSEKEGMLGFGFRYFVPIYYDQEIIGAVCVGLTNNTIDNQVKDGQKMIVFSLIIGLSVGIIGAVFLAQKMKKVLLGLEPQEIAEQLSEKTIIENEVDEGILAISSDKTILLINTPAKNIFYQTEQLLDFEVGKKSVIIYMTFCLKRRLSIKRPFGLNPCI

SEQ ID NO: 3800 - protein, 64 aa, Enterococcus faecium
  misc_feature (B) LOCATION 1...64
  hypothetical: YES
FLLPYSSPSIFHILHIISHDTYALIIPQVELEKKINHTKKQDNLLVRLSCFSKKTEYFSLKLVA

SEQ ID NO: 3801 - protein, 206 aa, Enterococcus faecium
  misc_feature (B) LOCATION 1...206
  hypothetical: YES
GILLKKEREKIMTNVKIVTDSSCTMEKNVRDALGIRVMPLSIMIDGTVYPDDDQLDGERFMEMMAKAKNLPKTSQPPIGEFISMYDELGEDGSEVISIHMTKGLSGTVEAARQASNLTKTKVTVIDSDTTDQGLSFQVIRAAELAKEGKTVEKILEEVKKVQDNTKLYIGISTLDNLVKGGRISRTTGLLSSVLNIRVVMNFAHMN

SEQ ID NO: 3802 - protein, 74 aa, Enterococcus faecium
  misc_feature (B) LOCATION 1...74
  hypothetical: YES
WRIPFYMKETQITVRIFLCSNRPFFKYLCSIYLLKSLVLRRLVAFRVLLTTVRSQLFHRQEGACKLIRLSRCHE

SEQ ID NO: 3803 - protein, 74 aa, Enterococcus faecium
  misc_feature (B) LOCATION 1...74
  hypothetical: YES
AGIPNNTLISVQTENPKRVPSFRVFLYNPRMASMPLIVVEAVRKLRYNLLRLFTGRWSCSIKLFRYLMVRCSVP

SEQ ID NO: 3804 - protein, 74 aa, Enterococcus faecium; identical to SEQ ID NO: 3803
  misc_feature (B) LOCATION 1...74
  hypothetical: YES

SEQ ID NO: 3805 - protein, 74 aa, Enterococcus faecium; identical to SEQ ID NO: 3803
  misc_feature (B) LOCATION 1...74
  hypothetical: YES

SEQ ID NO: 3806 - protein, 107 aa, Enterococcus faecium
  misc_feature (B) LOCATION 1...107
  hypothetical: YES
VYLFFLLYILWYYHFISYYKTIVRKDVIMQVYGIDAVLRIVSHLAFIYLAFCSLRSLRIETFFRPMHNTQIRMAIVLFSIFLGYTASNFFYRNYRFMPNLVLSLYIL

SEQ ID NO: 3807 - protein, 104 aa, Enterococcus faecium
  misc_feature (B) LOCATION 1...104
  hypothetical: YES
VYLFFLLYILWYYHFISYYKTIVRKDVIMQVYGIDAVLRIVSHLAFIYLAFWSLRSLRIETFFRPMHNTQIRMAIVLFSIFLGYTASNFFLRSYRFMPNLFVSL

SEQ ID NO: 3808 - protein, 246 aa, Enterococcus faecium
  misc_feature (B) LOCATION 1...246
  hypothetical: YES
ANLFHKGFFDIVVARRKMEGFFMAKIMVVEDEEIIRQLIMEELEKWQFETFGTTDFNQVFSDFEREEPQLVLLDINLPVLDGYYWCQKIREVSKVPIIFISSRNTNMDMIMAMNMGADDFVTKHFQIDVLIAKINALLRRSYNYTELSSEMMSHNGITLNVDNGSMEINGEIIDLSKNEYRLLFILMKHNGKILSREKLLRALWDDERFVDDNTLTVNINRLRRKIEQAGIQGYIETKVGQGYIVP

SEQ ID NO: 3809 - protein, 603 aa, Enterococcus faecium
  misc_feature (B) LOCATION 1...603
  hypothetical: YES
KGLFSFHSKFPKLQCGSTCFFNCGQINNRRNHMIQLLRYAKDYRKQIILGPFFKFLEAVFELVLPLMMASLIDNGLKMNDRGKIIEMGLWMVAMSVIGLICAIICQYYASVASQGFGTELRNQLIKKINTFSHNELNHFGTDTLITRMTNDINQLQLALAMVIRLLIRAPFLSIGSVVMAFVIDWEVGLFFLALLPIFSIILFFIIKKTVPLYQKVQEKLDQLNEHVSQNLSGVRVIRAFAQTKKETEKFDKSTNDLANNYLRVSNISALLSPATTLIMNVGIICLLTVGGIKVNIGSLQQGQVLALINYMNQMLLALIVVSNLVVIFTRAEASGNRVKEVLDTENSILEAEVSTTPDFSSEAIIAFDHVDFRYTPDSGLSLQNITFQLKRNTVLGIIGPTGSGKTTLTQLIPRFYDVSSGTVIMDGMDVRSWQLDHLRQQIALVPQTSVLFTGTIRENLQWGKKDATEKECWEALKIAQAEEFVRQLPNGLDTKVMENGKNFSGGQKQRLTIARALIAKPALLILDDSLSALDYQTDLDLRKALQTYLGSTVIIISQRVRSIQEAHHILVMDQGKIAAQGTHEELLAQSAEYQEIVASQEEE

SEQ ID NO: 3810 - protein, 398 aa, Enterococcus faecium
  misc_feature (B) LOCATION 1...398
  hypothetical: YES
RMVPSGASTGEYEAVELRDGDKARYGGKGVTKAVDNVNNIIAEAIIGYDVRDQMAIDKAMIALDGTPNKGKLGANAILGVSIAVARAAADYLEVPLYHYLGGFNTKVLPTPMMNIINGGSHADNSIDFQEFMIMPVGAPTFKEALRMGAEVFHALASILKARGLATSVGDEGGFAPNLGSNEEGFEVIIEAIEKAGYVPGKDVVLAMDAASSEFYDKEKGVYVLADSGEGEKTTDEMIKFYEELVSKYPIISIEDGLDENDWDGFKKLTDVLGDKVQLVGDDLFVTNTQKLSEGIEKGIANSILIKVNQIGTLTETFEAIEMAKEAGYTAVVSHRSGETEDSTISDIAVATNAGQIKTGSLSRTDRIAKYNQLLRIEDQLGEVAEYKGLKSFYNLKNK

SEQ ID NO: 3811 - protein, 80 aa, Enterococcus faecium
  misc_feature (B) LOCATION 1...80
  hypothetical: YES
RILFIDIGASSQEEAKEWGIRPGDMVTPYMNTNRMNGSKYLLAKAWDNRIGTAVSLRVLEIYLKKHTQMFYSQEAMCKKK

SEQ ID NO: 3812 - protein, 196 aa, Enterococcus faecium
  misc_feature (B) LOCATION 1...196
  hypothetical: YES
KTLLFERRNIMNDLKENMIFDLSKTAFVAIDMQKEIVNNGTLSPHTAASILTNNDLLVRTLKRTAALKVLVNVDISTFPYLSQQTDMGGMTASVPPEFTDLLLKDSLKDTDNMLTITKYNPSAFFGTSLDLQLRRRGIETIILSGVATTNGVYATALDAFQHGYHIVLAEDACSDRDKESHQLFMDKIFPXLCIGQ

SEQ ID NO: 3813 - protein, 126 aa, Enterococcus faecium
  misc_feature (B) LOCATION 1...126
  hypothetical: YES
QVSPLISKSIQILPDKSTKLLAPFRTKCYFVSWTLLIGGNSMIAIGQFVFYIPFFIMISILLYYLKWTKKKFSVLLASLPAVYFTYQIFSFRHWETTSVLITHIIELTLSVIFLIIWIYFLYKNQN

SEQ ID NO: 3814 - protein, 142 aa, Enterococcus faecium
  misc_feature (B) LOCATION 1...142
  hypothetical: YES
SASPSPARGPATRRLFPWLLPGRFLIGRISRYPSCSVWNVIGKVFDRVKNPLIIHPALKLAGDFRCGRAVVDHHIGVISHAAQGFHPVQVLLMGAAVIGQDVDAPLSVALNGGQFQKAPEIPGQVLVWIVPGKMHRPGAYPV

SEQ ID NO: 3815 - protein, 101 aa, Enterococcus faecium
  misc_feature (B) LOCATION 1...101
  hypothetical: YES
CLLFDFFTKSFILSIIDNKNVLEEALTMNVKIFSKNNCMQCKMVKRFLTENQIAFEEVNIDEQPEAVDWLKAQGFQSVPVITSDAETVIGFRPDQLRKLAS

SEQ ID NO: 3816 - protein, 73 aa, Enterococcus faecium
  misc_feature (B) LOCATION 1...73
  hypothetical: YES
FIPPKYCSVHVHFTPKFSSFQKKITEYTKKRFYLYKLYQSSILKLSNKKDVKINVKFRKQRRKSCKQNCFCCQ

SEQ ID NO: 3817 - protein, 642 aa, Enterococcus faecium
  misc_feature (B) LOCATION 1...642
  hypothetical: YES
PPPPPSLSPSFLSPLPNAPPPSPPPPRPLPSLPPPPPPLPATTRPTTNTSVVDALNEDNHGEGGIFSLYTLVRKGGKYLIIPAMIGGAALLPDGVLTPAVTVTTAIEGLRGIPQFFDRFGNNQNVIVIITLVIIFVLFMVQRFGTDIVGKAFGPIMFAWFTFLGVMGLMNFSQDWTVIRALNPYYAIQLLFSADNKLGLFILGNIFLATTGAEALYSDLGHVGKRNIRLSWPYVKICLVINYFGHAAWLLNVYQNPEAQQIKNLNPFFQMMPQSWIVIGVAFATVAAVIASQALITGSFTLVSEAIKLKLLPRLKIMYPGNSIGQMYIPAVNLILWIACSLVVVTFRTSHHMEAAYGLSITVTMLMTTALLYFYLIQNGHSRWLAYLVTFFFGAIEVVFFISSVVKFFRGGFVAVLIGLIILVVMFIWEQGNIIRESSTEDVSLRDYIPQLRELRDDTSLPIYQTNVVFLVPDMAEDKVGRQFIYSILDKRPKRARVYWFVHVEVTDEPYTKEYQVDMMDTDFIVQVNLFLGFRVQQEINVYVRQVIHDLMKQGRLPKQPQRYSLTPGREVGDFQFVLIDEVVSNVTTLGKWQRQIMQAKLAIKKIATSPETWFGLEYSEVKHETVPLIIGNTRKTWLKERL

SEQ ID NO: 3818 - protein, 117 aa, Enterococcus faecium
  misc_feature (B) LOCATION 1...117
  hypothetical: YES
CSLLLSICLKNSCTRNNQLCLKRQLIRRKNENYRFPWYVLGFVIFCXVNSLFSLPVVIDQSAHFISSWFEITALAAIGLRLDFAKFMKEGTRFLSYGLAVGLLQTVMALLFIWLIKV

SEQ ID NO: 3819 - protein, 380 aa, Enterococcus faecium
  misc_feature (B) LOCATION 1...380
  hypothetical: YES
KWLFVKGGFFMEKIAIIGGGIIGMTLASYLDTSKFNVALFDEGTGQATKASAGIISPWLSKRRNKQWYRLAKDGAAFFPKLIKDFQLDQTIYAQSGTLLLRPEKDLAELAVLAEKRKEEAPEIGNIEWLSPEQTSQALPLLKPAVSLRISGGGRLDGKAYLEHLGQRLAQKQMEQIQAKVTLHKKSDSWLIKGPFGEYTADRVILTPGPALKPLLQELGYAADIRPQKGQLLAFQTSYKMSQDWPVAMLDGEADFIPFMDGKILLGATHENDQGWDLAPTSEAYKGLTKSTEQFLTDPDQIKNWPYEFRVGTRAYTSDFSPFFGVLPDDPSLLAASGLGSSGLTTGPYIGYLLANFLNTGHWPTEDYQKDISTYITKNPS

SEQ ID NO: 3820 - protein, 76 aa, Enterococcus faecium
  misc_feature (B) LOCATION 1...76
  hypothetical: YES
ISTPSKLFLLSIIRCCLLIYVLEGKNMKLSIEGTSGEIKELLQAIGGSKEQNIKIDDIYKKSKDFLINGQAVAPSF

SEQ ID NO: 3821 - protein, 785 aa, Enterococcus faecium
  misc_feature (B) LOCATION 1...785
  hypothetical: YES
PSAPGFFIAKKEGNMANKLQTVSQLADQTAKAVTRNAEGWKSYLTTASRLYKYSFDEQLLIYAQRPDATACASMELWNEDMRRWVKAGSKGIALIKKDGIRPRLTYVFDVADTRPVRGAKMPYLWEMKDGHHAAVMDTLARRYGETEKKDIGSALMEQAKHAVEEVYREHLSDLAYDAQDSLLEGLDDFNLEVRFRNLLTASVQYTLLSRCGLNPADYLEDEDFDGIHEFSTPAVLHHLGSAASEVSMNMLLEVKKAIRQAEKEKAQNRQKIPKNPEKPLAKEPVIGYTKVKEQFNTLKRESEERSIQNGRTGIQEDGRLPDSRLGDGRGGRNGGNAAGQVRQAAADLSSGTPQGDIHLDAADRAAGTPPAGDRPAGAGTGRPDRGGIKETERRGRGDESPRPDGMGAGSQPVSRPGGGNRTERDRLQVNQENQQEAAGEQSAVSASEKPAFTQFSLFPTVEQQIETIAQAQKTEQELRPAVSSGKVTDAVIGRALTSGGNEPDSILRIVAFFQKDPTEQSAADFLQKEYGSGGKGLKIAGHEYSLWFSHSGIHIAPGRSAGGGSLVTWKQAAAQIRQLLNSGQFASQDKIDAARDNEFRELSEKLWFLRQNFSEEAKEKGLLPTIDALYGGFPDSTAKIAALLKDPAERAKIAQEVRQFAISHQENPNLLRFRQRPAPSELFTRLTDMDKPVTAFHGVEGFAPARGAFVTEDEITRMFTGGSGVSEGKFRIYAYFMQGHDAKECIEFLKNEYGIGGHGYIGYDEWHDGKGIKLSRADDFSRWQL

SEQ ID NO: 3822 - protein, 72 aa, Enterococcus faecium
  misc_feature (B) LOCATION 1...72
  hypothetical: YES
STAPIDFYQIIAQLAYYFFNFSGILNSELIPKQQPDTKKSDKLVNCLMIVFFMKDSSKIHQVVCNRKQRSYF

SEQ ID NO: 3823 - protein, 70 aa, Enterococcus faecium
  misc_feature (B) LOCATION 1...70
  hypothetical: YES
HTYPDIGNLILFSKVYQALTDISLAEKKMNALQFHRKKLLFINHLKKTVTRPYFYILSGNKLKKALPYNK

SEQ ID NO: 3824 - protein, 289 aa, Enterococcus faecium
  misc_feature (B) LOCATION 1...289
  hypothetical: YES
MALFKKKKYIRINPNRESKPANSPSVPDNMWAKCPNCKHILYTKDIGEEKVCPHCGYAFRIGAWQRLALIIDEKSFEEWDTDLVTKDPLAFPEYTEKIKKMQDKTGLHEAVLTGKATIQGIPFIIGVMDPNFIMGSMGTIVGEKITRLFERATKESLPVVLFTASGGARMQEGIFSLMQMAKISAAVKRHSNEGLFYLTVLTDPTTGGVTASFAMEGDIILAEPQSLIGFAGRRVIEQTIKQELPEDFQKAEFLLSHGFVDQIVPRMELKQKIHTLLELHTQKGWIDRG

SEQ ID NO: 3825 - protein, 237 aa, Enterococcus faecium
  misc_feature (B) LOCATION 1...237
  hypothetical: YES
SRHPCILLFSGXMIGGRIGDMGGFSYMEFIVPGLIMMSAITSSYANVSSSFFSQKFQKNIEEILVAPVPTHVIIWGFVIGGVGRSILVGSLVTIISLFFVPLHVYSWFMVIITLLMTAILFSLAGLLNGIFAQSYDDVSIVPTFVLQPLTYLGGVFYAISMLPPFWQAVSKVNPIVYMISGFRYGFLGTIDVPVATSMIVLVLFIVVLYAVTWYLINKGRRLSSLKAAPXSXKYGGR

SEQ ID NO: 3826 - protein, 118 aa, Enterococcus faecium
  misc_feature (B) LOCATION 1...118
  hypothetical: YES
VHNPDRTFQLNIAAPGKRVENATNPEQLFAAGFSACFNSALELIKQQKNISGASTVSAQVSLYSESETSFVLGVEIEGSIEGLSLEETQELLEAAHKVCPYSKATAGNIEVTLKAVSE

SEQ ID NO: 3827 - protein, 118 aa, Enterococcus faecium; identical to SEQ ID NO: 3826
  misc_feature (B) LOCATION 1...118
  hypothetical: YES

SEQ ID NO: 3828 - protein, 72 aa, Enterococcus faecium
  misc_feature (B) LOCATION 1...72
  hypothetical: YES
VINPETTGAKIKGTAIIGFITIGVEKIIDSLMLKKAGKRARFPNSLYFFDFAKTVIKNTAPNVNPAPVTVMN

SEQ ID NO: 3829 - protein, 61 aa, Enterococcus faecium
  misc_feature (B) LOCATION 1...61
  hypothetical: YES
LPNPNKITPRPAMIIKMIVMTLMIENQNSNSPNALTEIRFASIRNKTTMIPGIIAGKSGHQ

SEQ ID NO: 3830 - protein, 484 aa, Enterococcus faecium
  misc_feature (B) LOCATION 1...484
  hypothetical: YES
KGNPIMYSYQEDAKVQKNRWWILIAISMFTFMSTLDGSIVNIALPTISDDMGIPMNQAEWVVSVYLMIVCSCLLLFGKIGDSRGKIKVFRIGTLIFVLGSLLCGFNHSLGILLFARVVQAIGASMTMATNAGIITEVFPIHERGRALGAIGAFVSLGSIAGPGLGGLILSQFSWAYIFWINVPVGIVTMLIAEKFLPKDITMSGHTIDGGGFAAIAATIISFFGAIFLGQESGFFHPVPLVLFVISVIAFVSFLKVEKKAASPLISFGIFKNKIFTMSLITALLIFSSNFFVNVVIPFYLQNARGLSPSYAGLLMMVFPLMMVVGAPLSGYLTDRVGPEILVLVGLGLLSVTQVMYMFLSVDSPLWLYIVATAIMGAGNALFQSPNNTMVMSSVTIENLGLAGSMNSFARNLGMVSGISLSTTVLYQAMSAKMGQQVTNYIANRPDVFLYGMKITFLGSFVLCFVAFFLTIWRIKKQGGIQKNV

SEQ ID NO: 3831 - protein, 255 aa, Enterococcus faecium
  misc_feature (B) LOCATION 1...255
  hypothetical: YES
QLNPIILKRSVHHIPVLEVVLKELREERIPVVIYYHGWQTSKELVLTQGRKIAQQGIRVILPDAMNHGERKQPVSSIPSYTFWDSIYGNLFEFDTLIKHLEKRGLLHDQLAVGGVSMGGMTTCALLAKHPHIVAGVCLMGSPAPLEYGKEIVRRASEYNYVVPKDYFDLISWVKSYDLSLQPEKLAGRPLFFWHGQADEKIPYIQTERFVEKNRHKSYGKEIVFRSSKTQRHMVQIPLMEEASTFLAKNLIKKYK

SEQ ID NO: 3832 - protein, 123 aa, Enterococcus faecium
  misc_feature (B) LOCATION 1...123
  hypothetical: YES
FHDPRRRSNWNRNGWRSIYGESFEDEFSRELFNLRGALSMANSGPNTNGSQFFIVNNTNVPANMLGQLEGAGFPSEIIEAYKGGGTPWLDFRHTVFGHVLEGMDTVDEIANVQRVHKTDLYMM

SEQ ID NO: 3833 - protein, 88 aa, Enterococcus faecium
  misc_feature (B) LOCATION 1...88
  hypothetical: YES
DPDPSCDDPQDPPEEGITDPRDRAHQGSLNGGDGAVIEGWVFTVLFFHGGYQPHDEVVDMHGGIEPSGMADQGIGLFFFGFVETIDHW

SEQ ID NO: 3834 - protein, 106 aa, Enterococcus faecium
  misc_feature (B) LOCATION 1...106
  hypothetical: YES
TFCPDKEQLYKRMMKKMVNGLKVKTGPQFYLYEEGGISKVSDLLKSYGAKRVLVTHGTVSWEKALPKLVFLNDETIQFFYHRYSGECSYAEARRIATIIKKMKSIS

SEQ ID NO: 3835 - protein, 119 aa, Enterococcus faecium
  misc_feature (B) LOCATION 1...119
  hypothetical: YES
SRCPAMIKNFFKGLLFGAAAGTVGGLLLAPRSGNETRKKLIEELEEATTLTNDLNNSLNHFKSALIETKETAESVIPAFQEAIKKDIEDFKFQAEPRITQINEQVEKLKADLPEYPEQI

SEQ ID NO: 3836 - protein, 160 aa, Enterococcus faecium
  misc_feature (B) LOCATION 1...160
  hypothetical: YES
LLLFAFFTFFIITITVIIIKFAAIVIVWFVVIVSTVLIAALARSLTILAAGISRIILVCCWFFSLIHLTAPLTAILITAVIFIFLLIVRCFFFTLIVRLLIGWFSACLLCSLLFRAWVFERLLQFLLIIASNRTHMVFHIDAKLLCFFHDVFTKFFEFFC

SEQ ID NO: 3837 - protein, 902 aa, Enterococcus faecium
  misc_feature (B) LOCATION 1...902
  hypothetical: YES
IIRPRIRKYFRTFFSLKEENSMTEENNLSTKYNPQEVEAGRYQHWLEQDLFKPSGDKKAKPYSIVIPPPNVTGKLHLGHAWDTTMQDMLIRQKRMQGYDTLWLPGMDHAGIATQAKVEAKLREQGISRYDLGREKFIDQVWEWKEEYASHIREQWAKMGLSLDYSRERFTLDDGLSEAVRKVFVTLYEKGLIYRGEYIINWDPQARTALSDIEVIHKDIEGAFYHMSYELADGSGVVEIATTRPETMLGDTAIAVHPEDERYQALIGKKVILPLVNKQIPIIADEYVDMEFGTGVVKITPAHDPNDFEVGNRHDLPRVNVMDDDGTMNELAGKYAGMERFAARKAIVQDLKEIGRLIKIDTMIHSVGHSERTGVVVEPRLSTQWFVKMAPLAKKAIDNQETDQAVEFFPPRFNQTFLRWMENVHDWVISRQLWWGHQIPAWYHKETGEMYVGMEAPADSENWVQDPDVLDTWFSSALWPFSTMGWPDTESEDYKRYFPTSTLVTGYDIIFFWVSRMIFQSLEFTGERPFENVLIHGLIRDEQGRKMSKSLGNGIDPMEVIEKYGADALRWFLSNGSAPGQDVRFSYEKMDASWNFINKIWNASRFVIMNIEGMTVEYIDLSGEKSVADRWILTRLNETIERVTELFDRFEFGEAGRQLYNFIWDDFCDWYIEMSKEVLYGDDAVSKQTTRSILVHTLDQILRLLHPIMPFVTEEIWEHIPHQGNSLVVAEYPVVRPEFDDETASKGMEVLKELIRAVRNIRSEVNTPLSKPITLLIKTNDAKIDQFLVENTSYIERFCNPEELTISSEITAPDLAMSAVLTGAEIFLPLAGLINIEEEIKRLEKELEKWTSEVKRVQGKLSNERFVSNAPEEVVEAERAKEKDYLEKQTAVKERIESLRTIQ

SEQ ID NO: 3838 - protein, 72 aa, Enterococcus faecium
  misc_feature (B) LOCATION 1...72
  hypothetical: YES
PLRPHGLPGLPARPEAGENAGAGRPLPPFAGTAGGGSTAACYRAGNLRYWQLKCVQPPDQRGNQEPDCLLCD

SEQ ID NO: 3839 - protein, 81 aa, Enterococcus faecium
  misc_feature (B) LOCATION 1...81
  hypothetical: YES
GKLLDEEVKVKIREDFTVGEISSRLFGSFVEHMGSVLYTGIYEPGHETADGDGFRQDVPSLCKGIRIRCHSLSWRKLYIWL

SEQ ID NO: 3840 - protein, 73 aa, Enterococcus faecium
  misc_feature (B) LOCATION 1...73
  hypothetical: YES
IISPWEEGRFMNSLKEDFILAKAGNEEAVEAILKRFSSLIHKQSWRTGKYDQDCYQECMLAIYLAISKFEIKE

SEQ ID NO: 3841 - protein, 290 aa, Enterococcus faecium
  misc_feature (B) LOCATION 1...290
  hypothetical: YES
QSSPLFSSSNNRREFFPEINVLFADAGYRHPKFVHFLNHLTFRPCLLYSRPKGKKELLSKYEFLYDEYFDCYICPQDQMLAFSTVTREGYREYKSNPKECVNCPLLNQCTISKNHQRVITRHVWGDLMDEVEHLRLTDLNKSIYKKRKQTIERIFADAKEKHGMRWTKYRGLEKVATHTMLVFAAMNLKKLATWLWKGKEPLFFCSKIRNEVDKKLFQARVTSLEQLLSTVCDVGDISFSIRNQLRFKRSLPVSGNINVYFTKARFKRLIAITVSSIVMFLWLFRMGVIP

SEQ ID NO: 3842 - protein, 161 aa, Enterococcus faecium
  misc_feature (B) LOCATION 1...161
  hypothetical: YES
MLMLQQYKKIMVAVDGSDEAELAFKKAVNVAIRNNGELVLAHVIDTRSFQTVSSFDGMLAEQATEMAKQTLADYESNAKKAGLNNVTSVVEYGSPKQIIAREIPEDNQVDLIMLGATGLNAVERLFIGSVSEYVIRNAACDVLVVRTDLENQLPAKDHTKA

SEQ ID NO: 3843 - protein, 227 aa, Enterococcus faecium
  misc_feature (B) LOCATION 1...227
  hypothetical: YES
RNMLSKQKTMEALETMYGMFPEAHGELKHNNPFELLIAVILSAQATDVSVNKATPDLFASFPTPDALAEASIDEIILKIKTIGLYRNKAKNIKACAQQLIERFDGQVPTSREELMSLPGVGRKTANVVLGDAFGIPAIAVDTHVERVSKRLRICKLDATVMEVEETLMRKVPQELWVKTHHTLIFFGRYHCTARNPKCEVCPLLSICQDGKNRMRLKEKALKKKPRL

SEQ ID NO: 3844 - protein, 100 aa, Enterococcus faecium
  misc_feature (B) LOCATION 1...100
  hypothetical: YES
IDMLPFFIYWGVILACIAWLALSVYFSVFYLVRKENGNLWAFALFNVIAAIVLAITLAVYRTWGWGITQYSSLIYLILAIYGVVVLLQAILGREPKKAAA

SEQ ID NO: 3845 - protein, 152 aa, Enterococcus faecium
  misc_feature (B) LOCATION 1...152
  hypothetical: YES
ISMLTISKGVSLMKIALIAHDRKKPMMVKLATAYKTILEKHELFATGTTGQRITEATGLPIHRFKSGPLGGDQQIGAMISEDQLDLVIFLRDPLAAQPHEPDVTALIRLSDVYEIPLATNIGTAEVLLRGLEAGFLDFRRIVHEIDKHPLSF

SEQ ID NO: 3846 - protein, 518 aa, Enterococcus faecium
  misc_feature (B) LOCATION 1...518
  hypothetical: YES
QSMLDVIDGRTSLGIEFGSTRIKAVLIDSSFTPIAAGSYEWENKLENGIWTYSLEDIWKGLRVSYRKMAAEVFEIYGENLTTIGSIGFSAMMHGYLAFDSKEQLLVPFRTWRNTITEEAERILTEKFQYNIPQRWSIAHLYQSILNKEEHVKEINFLTTLAGYVHWQLTGEKVLGVGDASGMFPIDPSTKTYHQEMKNIFGQLIEKAHVAIDLDHILPKVLVAGEEAGKLSESGAYLIDPTGNLRPGIPVCPPEGDAGTGMVATNSVAKGTGNISAGTSAFAMIVLEKELENVHPEIDMVTTPSGELVGMVHTNNCSSDINAWVSIFEEFTNSLGMEISRDKLFTVLFNKALEGDTDCGGLLSYGYFSGENITGVNEGRPLFVRTPGSRFDLANFMRIHLASAFGAMRIGMDILKSENVQIDRLVGHGGIFKTPEVGQRILASAMEAPVTVMDTAGEGGAWGIALLAAYMMDRHGKSLENFLAEDVFGQDQGITITPSAEEIAGYQIFMRTVTVRDRH

SEQ ID NO: 3847 - protein, 676 aa, Enterococcus faecium
  misc_feature (B) LOCATION 1...676
  hypothetical: YES
LYMLEAIKTAFSPQNDQKVLDPLKQLGNREIEILKSKGYDLDFLKQVMPQGGLNFDEEYVTYGNGYSRCVTVYHYTKNPTLFWLANLMNNPHTVATLDVSTDEKQKVIDQINRALDELNDRSDNERKATDRNKSAEEYLELAEYARKLTSNGEISKQVKVRVHVYGNTIQEVDERAQELIKNLKGMDYRAVTYLHKTKRDWQSMFTMFDEQAEWFGNIKGQSLPSLNIGGGFPFHHQTLKDPGGTQYGETMTGGPFVWNATYKNSVRLSTNTLLLGMMGAGKSTVLKMIAEAHLAAGDFIWGFEKGKDFIPFLKEYNGIMVRLDGSDGMINPLEIFATRTYDEASSLYDDGSVKDLKINEAASYQTHLDKVVYQVQLVSPQLKGTMKAEFKTYLNRFYEEYGTVPRGFTSSNSRSNTETQVTGKDPEAYPTFKEFLDFLGQLELPGASQEKKNRKEEMESIVESLCETYGMIFDGHSTIRHLDQQQLVFFDIDSITGLDRGVQQCQMYMAMTLIWNQALIQGRRQRRLIKEKQMEEQDFKRFLAMIDECHNAINPDFIETVNYVTNFQREMRKVEAMTVLATQSPQEMVPENMSSDNFSKLKKVFEFSSTKIFMRMDESILRHIEGLVGKSMTNSELESIPQQNQGDAVINFGSKETIRVHFSPNKRQLKLFDGGK

SEQ ID NO: 3848 - protein, 60 aa, Enterococcus faecium
  misc_feature (B) LOCATION 1...60
  hypothetical: YES
PLFPNKRCSPANSESRVTIFIKHEMLFFEIAPCNAELNGRHTTSEWLSFYYFVDPFSSIP

SEQ ID NO: 3849 - protein, 345 aa, Enterococcus faecium
  misc_feature (B) LOCATION 1...345
  hypothetical: YES
RKMFLEIHDLNLFFDEKQILAIDEIQIEKGELVTLLGPSGCGKSTLLRCITGLEQPKSGEIVLDNENIADKPTKDRNIGFVFQQYALFPTMTVFENVAFGLKVKKLSPEVIQEKVFEMLSLVDMTEQADKNVQFLSGGQRQRVALARSLVTEPKVLLLDEPLSALDARIRKQLQRDLRAIQQSLGMTMIFVTHDQEEAMRISDRIFVMEAGRVAQVSTSKELYQNPQSRFVAEFIGNYNRFEWYELNQYTHEFSAKGNRCIYYLRPELIQFEPVPQGVKIPVLWKESFILGNIQRYVFQTLEGKEILVDRLNDREEKISDALYIQLKDILAIPVEIDTQHFAQQS

SEQ ID NO: 3850 - protein, 134 aa, Enterococcus faecium
  misc_feature (B) LOCATION 1...134
  hypothetical: YES
SAFPWLMTIFKKHIKGNRRTQMEKQTITIYDVAREANVSMATVSRVVNGNPNVKPATRKKVLEVIDRLDYRPNAVARGLASKKTTTVGVIIPDVSNMFFASLARGIDDVATMYKYNIILANSDGNDQKRSQCIE

SEQ ID NO: 3851 - protein, 73 aa, Enterococcus faecium
  misc_feature (B) LOCATION 1...73
  hypothetical: YES
NSFPYFTKLCLIADSLSLEHRLPRDYEPANYRRVTRNNFRKSSSRFMNMVICDREFCRKTPIKKKVVTTIFFI

SEQ ID NO: 3852 - protein, 344 aa, Enterococcus faecium
  misc_feature (B) LOCATION 1...344
  hypothetical: YES
RRMFNMKESVFQGRSLLAEKDFTKEELQYLIDFSEHLKDLKKRGIPHHYLEGKNIALLFEKTSTRTRSAFTTAAIDLGAHPEYLGANDIQLGKKESTEDTAKVLGRMFDGIEFRGFSQKMVEELAEFSGVPVWNGLTDEWHPTQMIADFLTIQENFGTVEGITVAYCGDGRNNMANSLLVTGAILGANMRIVAPKELQPEEEIVKMAEGFAEKSGAQLMITDDVDKGVDGADVLYSDVWVSMGEEDKFEERIKLLKPYQINMEMVEKTHNTDRLIFLHCLPAFHDTNTVYGEQMKERFGITEMEVTDEVFRSKYARQFDQAENRMHSIKAIMAATLGNLFIPRV

SEQ ID NO: 3853 - protein, 156 aa, Enterococcus faecium
  misc_feature (B) LOCATION 1...156
  hypothetical: YES
AVFPFIYFGVCRKGGEIMNTSSFEHIVRIQFNALMITVIKCTVKSRNRQFARRSKREVLFYELSDTKNLECVTEDKYSCDYISFEVLNFTIQISNEKLAVALYKLSSKERDVILLRYFQSMSDQEIAELYHVSRSAIYRRRSNGLKKLKTLLKERN

SEQ ID NO: 3854 - protein, 146 aa, Enterococcus faecium
  misc_feature (B) LOCATION 1...146
  hypothetical: YES
TQMFNLRRVTEGGQQMIPRFRAWDKKTETIQEIESISFKEKKLVIDQKSVTWFNSDYIRNSDEVELMQSTGLKDKNGVEIFEGDLVEHDDNLNGDWETFEACEVVYDKDYAQFCFKWDAGNFLTDYRNLNVIGNIYENSELLEEQR

SEQ ID NO: 3855 - protein, 1095 aa, Enterococcus faecium
  misc_feature (B) LOCATION 1...1095
  hypothetical: YES
TKMFKRASYFFVLNLKGEHFMYKKQKKKLCVLTILSLAVQAIVGAIAPTITFADEITHPQTVTVELDLAHQYVVEGTFSDGRPMSEVTVPHYAVYNGVKQDIFCIEPGVPIDNEFTPGYEKNPLPDMPEKAKLVSVLWKKAGTDVDTHIVAQKMIWQEVNGYTLHSIKRLNGSAVNIAAIEAKINQAIADYQKKPSFHNSTAKIVLGQSTTMTDTNNLNLSEFDEVVENTANIDYRVNGNQLIITPNASSKESGVLTLKKSAGTGTPVAYKKVGQQTLMAGAIDKPNTYTVKIDVETEGSLKIKKVDKESGAIVPGTVFHLDFGKNLPAKDVTTDKEGIATLDEIPHGTKVTITEKSVPAPYTIDTTPMTTTIKAGETIYVTSKNAQEKGQIILDKSGVETGSDLWNDNYSLAGNTFAIRKDSPTGEIVQEMTTDENGHAETPKEIANALELGTYYVTETKASHGFVNTFKPVKVELKYANQTVALVTSNVKGQNQEVTGETTLTKEDKDTGDKAQGKAVFEGTEYTLFTAKDGKAVKWSEAFKPEMVKGTKASDETVTLALDEKNQAAVKHLAINEYYWQETKAPEGYTLDETKYPVSIKKVDDNEKNAVITRDVTAKEQIIRFGFDFFKFAGSAAGTAETGFNDLTFKVSPLEGTNEITGAEDEATTAYNEQLGFDGYGKFENLPYGDYLLEEVEAPEGFQKITPLEIRSTFKENKEDFVKSEYVFTITEQDQKQPIKTVTVPYEKLTNKAFSVSLNRLMLYDLPEEEDSLTSLATWKDGNKELTSLDSTELVDKLSYNLHEIKEDWYVVAQAIDVDATKAAQEKDEKAKPVVIAETSATLANKEKTGTWKIQHKLTAEQVLNKTIVLFNYVYENKEAFEAGDKPVAKDVSLNNQAQTVSCTVEHHVSIQTKAHLENGSQTFTHGDVVDMFDDVSITHDVLDGSKEAFETILYALLPDGTNKEIWKSGKIEYEVNDKEFTKTVLAKKVDTGKYPEGTKFTFAEINYDKDGTINGKHNEDLKEKSQTLTPKEVPTILSTPKQPETPTVPSGSQESSLTVKTFPQTGEKNSNVLLFIGFTLIFATAGYYFWNRRN

SEQ ID NO: 3856 - protein, 247 aa, Enterococcus faecium
  misc_feature (B) LOCATION 1...247
  hypothetical: YES
RKMLQIYAHRGSSGTHPENTLPAFAEAVRVGADGIELDVHLSKDGYLIVMHDEEVDRTTNGKGLIREKTLEELKKLNAGGKFSKEFPAAKVPELREVLGLLLQKNYRGMLMIEIKTDQYEYPGIEEKLAETLKSRDWPFQHAYCSFHLDSLEKIALLEPEIQLDLLMSTSDKKIQLAAETPYIEGVHPKNTWLFEHPVQAADFPKAIRAWTINDEEEMAKCQELKIDGIITDFPEKALRWKQSTKSR

SEQ ID NO: 3857 - protein, 446 aa, Enterococcus faecium
  misc_feature (B) LOCATION 1...446
  hypothetical: YES
EGIPFMAKTGMYVGLDIGTTSVKVVVAEYIDSQMNIIGVGNAKSEGINRGIIVDIDKTVQAIQRAVRQAEEKAGIQIKGVSVGLPANMLEVENCQGMIAVNGDSKEITDEDVRNVASAALVRSIPPERQIVSILPQDFTVDGFEGIKDPRGMIGVRLEMYGLLFTGPKTIIHNIRKCVENAGLIVNEMVITPLALTESILSDGEKDFGTIVIDMGGGQTTTAVMHDKQLKFTNLDQEGGEFVTKDISIVLNTSFNNAEALKINYGDAYPERTSPDEEFPVDVIGQSEPVKVDERYLSEIISARMEQIFNKAKDALDQIEALELPGGVVLTGGAASLPGVVDLAQEIFGVNVKLYVPNHMGLRNPVFTNVISIVDYSANLSEVYQLAKIAVTGETSAARQMVVEQETTNTYESYEAPEETIYDEPEPKESGENVKNKIKGFFTNIFD

SEQ ID NO: 3858 - protein, 283 aa, Enterococcus faecium
  misc_feature (B) LOCATION 1...283
  hypothetical: YES
ITIPLLLVFLFGIYGLIVFLFWNGVTVLRRESHSLANLLTLILAIFLTLFLVFDFFLLKYLPQWINALFFCIPLILIYLFIVFYNFLTVSFLYQFNRPRYNQDFIVVLGAGLINGETVSPLLAKRINKAIAFYWAQSRATLNPPILLMSGGQGADEKVPEAMAMKQYAMEQGIPERDILVETNSTTTLENMRYSKEIMDQQMKGPYRAIFSSNNYHIFRAGLYARQAKLKANGIGAKTAFYYLPNAFLREYIAILMMNKKRHMIICGLLFAGSAFLSLITLLF

SEQ ID NO: 3859 - protein, 80 aa, Enterococcus faecium
  misc_feature (B) LOCATION 1...80
  hypothetical: YES
AYPPAPSYKDKFKKQLFIFYECCTCDSEVAREHCLFKKRLGQKRLTPRNKKKFTKIAFQIFVNFFLFPKELLLLPPFIRV

SEQ ID NO: 3860 - protein, 155 aa, Enterococcus faecium
  misc_feature (B) LOCATION 1...155
  hypothetical: YES
MNYPYFKVSATEDVKEKFNKCFEVNKSVFQTKSNMFRYVVSNLPMLTKANQNFRDPEKEELAKNLEEAKLKISELETIIELQKQQLENFNKKEDSTHKDYSEQLNSIEESVYKLLINSGLASKELEEERAEPEQESSRLGEGTMFSSPSLRFTTD

SEQ ID NO: 3861 - protein, 499 aa, Enterococcus faecium
  misc_feature (B) LOCATION 1...499
  hypothetical: YES
KGVLCMDYSSKEYFDKMTAWWRAANYLSVGQLYLKDNPLLRRTLKPEDVKKHPIGHWGTIPGQNFIYVHLNRVINKYDLNMFYIEGPGHGGQVMVSNAYLDGSYTEIYPEVTEDETGMQKLFKRFSFPGGIASHAAPETPGSIHEGGELGYSLSHAVGAVLDNPEVISAVVIGDGEAETGPLAGSWFSNVFINPVIDGAVLPILHLNGAKIANPTILARKSDGELANYFNGLGWEPFFIEGNDSEKLNPVMAEKMDQAIEKIKSIQKEARLKTATDVVMPKWPVLIVRTPKGWTGPKEWDGEPIEGTFRAHQVPIPVDQEHMDHADALLRWLKSYEPEKLFDAQGRILEEIREIAPTGDQRMAKNPITNGGIDPRPLIMPDWKKYTLQFEKPGSVKAEDMTELGKFVREIIEKNPENFRIFGPDETKSNRLNQVFKTTNRQWMEKIEPENDEWLSPSGRVIDSQLSEHQDEGFLEGYVLTGRHGFLQVTNHSCEWLTLC

SEQ ID NO: 3862 - protein, 816 aa, Enterococcus faecium
  misc_feature (B) LOCATION 1...816
  hypothetical: YES
TMYPIKYIENNLVFNQEGECFAYYELIPYNYSFLSPEQKYQVHDNFRQLIAQNREGKIHALQIATESSIRATQERSKKEITGRLTEVAKQRIDLQTEALVSMIGDSQIDYRFFIGFKLIATDEEVNLKNLKKSFFSGFQEFVYGVNHHLMGDFVSLSNEEIRRYTKLEKLMESKLARRFKVRRVTPSDLMYLIEHIYGEKGTPFEEYEFQLPKKKLKSETLVKRYDLLRPSRCLIEEKPRYLCMEHENHESYVAYLTINTIVGEMEFPSSELFYYQQQQFTFPIDTSMNVEIVTNKKALATVRNKKKELKDLDNHAYQSDNETNSNVLDALDSVDELETTLDQSKESMYKLSYVVRVSAESVDELKRRCDEVLDFYDDTNVKLVRPFGDMMGLHEEFLPSSKRYMNDYIQYVTSDFLAGLGFGATQMLGELEGIYFGYNVDTGRNVYLKPALASQGVKGSVTNALAAAFLGSLGGGKSFSNNLLVYYAVLFGGQAVIVDPKGERGGWKETLPEIADEINILNLTSKPKNQGLLDPYVIMEKKKDSESLAIDILTFLTGISSRDGEKFPVLRKAIRTVTQSNQRGLLQVINELRKEGSPVAENIADHIESFTDYDFAHLLFSDGSITQSISLDRQLNIIQVADLVLPDAETTFEEYTTMELLSVSMLIVISTFALDFIHSNREIFKIVDLDEAWSFLQVAQGKTLSNKLVRAGRAMNAGVYFVTQNSDDLLDERLKNNIGLKFAFRSTDIHEIKKTLEFFGLDREDESNQKRLRDLENGQCLMQDLYGRVGVVQVHPVFEELFHAFDTRPPVQERME

SEQ ID NO: 3863 - protein, 60 aa, Enterococcus faecium
  misc_feature (B) LOCATION 1...60
  hypothetical: YES
IFHPRRPPPLRQRRQRSVHEYAVGGQESNPAGGKRKGTEPAENPEKSRKTTCKRTGDRLY

SEQ ID NO: 3864 - protein, 375 aa, Enterococcus faecium
  misc_feature (B) LOCATION 1...375
  hypothetical: YES
SSHPIRRTTPSVCCEIPQKKQSGIVLTLKGVYSMNKIKVAIIFGGCSEEHDVSVKSAIEIAANINTEKFDPHYIGITKNGVWKLCKKPCTEWEADSLPAIFSPDRKTHGLLVMKEREYETRRIDVAFPVLHGKCGEDGAIQGLFELSGIPYVGCDIQSSAACMDKSLAYILTKNAGIAVPEFQMIEKGDKPEARTLTYPVFVKPARSGSSFGVTKVNSTEELNAAIEAAGQYDGKILIEQAISGCEVGCAVMGNEDDLIVGEVDQIRLSHGIFRIHQENEPEKGSENAMIIVPADIPVEERNRVQETAKKVYRVLGCRGLARVDLFLQEDGGIVLNEVNTLPGFTSYSRYPRMAAAAGITLPALIDSLITLAIER

SEQ ID NO: 3865 - protein, 380 aa, Enterococcus faecium
  misc_feature (B) LOCATION 1...380
  hypothetical: YES
NFNPFQRRKKEMNMSQSVFLPNYTIGTDAYEKANGIVKEYGTKVVLIGGKTALSKAENKIKVALTQEIEVVASLWYGGNSTYGNIEQLIQHESVQKADVLFAVGGGRACDTVKVIGEKLAKPVFTFPTIGSNCSPVTAVCVIYNEEGVMDGLFFPSKPPVHTFIDTAIIAEAPDKYLWAGIGDALSKEVESTFSARGDDLGYTDRLGIQIGKMCIDRLLTYGTQALKDSADDRPSYAIEQVVSDIIVTTGLVSVLVNNNYNSAMAHSFYYGTTVLEKMEGYLHGASVSYGVLTLLMMDQQFDLFDKIYVFMKKNQLPVSLTDMNLNVTTDLEAILDKAMATNDIKHVPYEITREKFKQAILDVETYHATQESQQGYKKIS

SEQ ID NO: 3866 - protein, 475 aa, Enterococcus faecium
  misc_feature (B) LOCATION 1...475
  hypothetical: YES
ITNPGPDFHPFFRVDGKKTEKRKLGTLRNVPFGWVMERGYWAVGFLHSLAMFQINGEIALWTLVFLPILGIVIWYYQKFSSRIYRNMREKLSQLNTKLNESISGMRIIQQFRQEARLAKEFEQVNNEYLDTRYAMIKTNSILLSPIINFLYALAIALVLTLFGIDALHSPVEVGLIYAFTTYVQGFFNPMSQMMDFLSIFTDGMVAGSRILKIMDTEEYAPQQNPGADQMITSGKIEFRNVSFSYDGEHNVLNNISFVANPGETVALVGHTGSGKSSIINVLMRFYEFYEGQILIDDHDIRAYPMEELRKKMGLVLQDAFLFYGDIAGNIRMMNPAITDEQIRHAAEFVQANKFIDELPKGYHSKVIEHGASYSSGQRQLITFARTIVTDPKILVLDEATANIDTETEGLIQEGLAKMRQGRTTIAIAHRLSTIRDAELILVLDKGHIVERGNHETLLAQNGLYADMYKLQSSGL

SEQ ID NO: 3867 - protein, 61 aa, Enterococcus faecium
  misc_feature (B) LOCATION 1...61
  hypothetical: YES
KPDPRIDYDQGNKRPTDSGNSRERDQHPTARSNSGVEATRQKTKANKHTFKLDHAESRTQN

SEQ ID NO: 3868 - protein, 292 aa, Enterococcus faecium
  misc_feature (B) LOCATION 1...292
  hypothetical: YES
MICPANKRQVNTVFQDYALFPHMNVFDNVAFGLKIKKMSKSDIEKKVKDALRMVQLPGYEKREISEMSGGQRQRVAIARAIVNEPKVLLLDEPLSALDLKLRTDMQYELRDLQQRLGITFIFVTHDQEEALAMSDEIFVMNKGKIVQSGTPVDIYDEPINHFVADFVGESNIVDGVMIEDNLVEFVGKQFECVDGGMRLNEPVEVVLRPEDLTITTPDKGKLVVTVDTQLFRGVHYEIICYDEQQNEWMVHSTKKAKEGSKVGLAFEPEDIHVMRFNESEEEFDARLDSYEE

SEQ ID NO: 3869 - protein, 81 aa, Enterococcus faecium
  misc_feature (B) LOCATION 1...81
  hypothetical: YES
RTCPSRVDSWSKKSKLVKGGNIMAVPARKTSKAKKRLRRTHQTVVKPEISFDEANGDYRRSHHVSLKGYYNGKKVIKGASK

SEQ ID NO: 3870 - protein, 689 aa, Enterococcus faecium
  misc_feature (B) LOCATION 1...689
  hypothetical: YES
SLCPSVDRKIKCICTPNCFRLSAIFPKLQNEIYQENMSSVLERHVRNRLIFPAITSMIICLLYYTDNWGYRLLLAGIFLWFSLKEGRFIAYLCILCSITVSISYRLQEYSFLEEKTTSAQITVFTDTIRANGNFLTMEGRLSENKQKLQLSYQVNTEAELKTWLNFRGKGIELTAEGEFISPAKKRNLYNFDQEAYFRNHRISGRFQIQKIEQITMQNHWRNWLQRKRGSFISFVQSEFPQKTSVYINSLLWGYKDAGFREPEEIFRESGLLHLFSLSGLHIQFYLGWLYYLFRRIGWPLHVSIIPLSLLTICYVSIAGSSISVLRASLLFLLRLLVKLLNKHYSTMDLFAVVFWLLLLFDPRFLFHAGGQLSFFMSFLFILISFDGDWLKKTASHVLFTMITMPLIVWHFYEWPILGSLFTLLIAPVFKFLFLPGVLFLTLFNRWLPETLLLLIEEGLILFERIIDFSSGSSLIIGRLPLVLSGMYIFGLLICMDRLKEQPVKHLFYVGLFSFIFLTLPFLRFSSTIAFIDVGQGDSIFLQSPFRKETILIDTGGQLHFEREKWAQGMIRPPAERNIVPYLKGQGISVIDKLILTHDDTDHVGELPTLSQHFTIKKIYIGWGAGRNEPLQRHLSEAQKNGTEIIEIKHGDRISGYYDLYVLTPFEKGEGRNADSIGLWLKITLALFIF

SEQ ID NO: 3871 - protein, 97 aa, Enterococcus faecium
  misc_feature (B) LOCATION 1...97
  hypothetical: YES
GQGPCHRRRPYPRKNGFGCAGFQAENAQSQPHLPTVRNAGQSAEILPAENRGNQAVNRSADGRFANRAGPPGQGRCVFHDCHGADLHGAQGGGRSGD

SEQ ID NO: 3872 - protein, 68 aa, Enterococcus faecium
  misc_feature (B) LOCATION 1...68
  hypothetical: YES
FSLPGHTARRGRSATLGFMWEAGGLFTAATRFPTPIREAPIGLPICTGMAEYPETLFSGIFARNGGMI

SEQ ID NO: 3873 - protein, 380 aa, Enterococcus faecium
  misc_feature (B) LOCATION 1...380
  hypothetical: YES
YFALGGFGSAFINVGILTLLSVLVAYRQKVILNGPLFASILTVTGFSFFGKNLYNSISIILGVYLYAVFVNKPFSQYIMIGLFGSALSPVVSYITFGMRFPLLVGILLGNLAGIAIGLLLPPLAAQTLVFHRGFTLYNIGFTSGLIAMAFTAVLRLFSYSIVENTLVSNEYHSPLVWIIFGFFLLTVGFGFYYNSFRLSGIRKIFDSSGKLTTDFIANSGIGATLINMGLVGLMLSSYVLLVGGKLNGPVIGAILSAVGFSAFGCHLKNSFPILVGIFLASLFGTFHEITSTGMLVAAVFGTGLAPISGFYGSFYGVIAGMLHIALVHNVSTLHGGLNLYNSGFSTGFVAGILVPILDNFTAVRKEKKTLGKRIIKKNHR

SEQ ID NO: 3874 - protein, 188 aa, Enterococcus faecium
  misc_feature (B) LOCATION 1...188
  hypothetical: YES
DHLPEDDPENYPGGENERYLEIWNLVFSEFNHKPDNTFEPLPHKNIDTGMGLERMVSIVQDASTNFETDLFMPIIHAVEKLSKQVKYGENPVTDISYKVIADHIRALSFAIGDGALPSNEGRGYVLRRLLRRAVMHGKKLGIEQAFLYRLVPVVGEIMVSYYPEVLQQKEFIEKVIRTEEERFNANNQ

SEQ ID NO: 3875 - protein, 314 aa, Enterococcus faecium
  misc_feature (B) LOCATION 1...314
  hypothetical: YES
RLSLQQQMLRRIKQTGEDERVAFETIGEKLRQARLNKKISLDELQQITKIQKRYLEAIDNDDFDQLPGKFYVRAFIRQYAEAVGEDGDHLVDVFDGKSKLTGSVPERPQPETVSTSRKAMHQEESHPSRFWTSLPVILLGLVALAIVVVVGYMTWQDRQADPIIGDTASSLKVEGSVEESSSSEQSTQTKESSTVESTTKSSEEKKMAIATGEDSGSAIAVNITDATKPVTLEFTAVNRVWLGVLVDNAYVYQGTLAANETQSTVLPETATNATITIGAASNATIKANGESVPVNPGENNQSPKHVNLTLQYAE

SEQ ID NO: 3876 - protein, 106 aa, Enterococcus faecium
  misc_feature (B) LOCATION 1...106
  hypothetical: YES
NSLPSSPVALSRTVAWPSGVKGIGSRGVVSVSSSGAALAEAEGFALPVPAAGFVAVVVAGLVVGVVGGVVALVAGVVGAGVVDVTGAVVAGGCVWPVEGFCLLSSA

SEQ ID NO: 3877 - protein, 381 aa, Enterococcus faecium
  misc_feature (B) LOCATION 1...381
  hypothetical: YES
SLLPRLSKTLLSPINDYRRRISMYDQLQAIEDRYEELGELLSDPEVISDTKRFMQLSKEEANTRETVEVYRRYKEVVQGITDTEELLGEKLDDEMAELAKEELSELKKEKEVLEEKIKILLLPKDPNDDKNIIMEIRGAAGGDEAALFAGDLFNMYQKYAEAQGWKTEVMEANVTGIGGYKEVIMMITGDNVYSKLKYESGAHRVQRVPSTESQGRIHTSTATVVVMPEAEEVEIDIEDKDIRTDIYHASGAGGQHVNKTASAVRLTHLPTGIVVAMQDERSQIKNREKAMKILRARVYDKIQQEAQSEYDANRKSAVGTGDRSERIRTYNFPQNRVTDHRIGLTIQKLDQILAGKLDEIVAGLILFDSPPSTGNQCHGGE

SEQ ID NO: 3878 - protein, 401 aa, Enterococcus faecium
  misc_feature (B) LOCATION 1...401
  hypothetical: YES
MMLPHMIPYAEPFYFFLLAIALVPIVLSLLIWEKRLPVYQSAVTLFFLFVSFGGNYWQQGAALIGYVLWQTILVWGYFVYRQRKNQTGWFFAAVILAIIPLFLTKVTPFFEHGKASLLGFLGISYLTFKSVQMIMEIRDGMIKTYKPFRYIQFLLFFPTISSGPIDRYRRFEKDQLHPPVRDKYVDLLGKGVQNIFVGFLYKFIIGYYFGQVLLPVVGRIALQHGGISWALVGYMYVYSMYLFFDFAGYSLFAVGTSYMMGYQTPINFNKPFLSWNIKEFWNRWHMTLSFWFRDYVYMRLMFFMMKKKFFKSKIVMSNIGYFALFLLMGIWHGLTWYYIVYGLYHACLICLTDAWIRFKKKHKEQLPSNKFTHGLAVFLTFQAVCFSFLIFSGFLDKLFFS

SEQ ID NO: 3879 - protein, 94 aa, Enterococcus faecium
  misc_feature (B) LOCATION 1...94
  hypothetical: YES
LLALSIVPAHPSSAGIVFYFASSIISGILIALIQKWEWIKWNPISMLNLQNQIGNEEIMKQLTHLSTNQMLFGNLAYIVLFLALGYLVFKRKNV

SEQ ID NO: 3880 - protein, 274 aa, Enterococcus faecium
  misc_feature (B) LOCATION 1...274
  hypothetical: YES
MQLPIVGILTKYLSATMVQIRQTQATVQIHLPQVIAQIHQLQATVQILPLPQVIARTHQLQVTVQILPLPQVTARTRQLQATVQILPLPQVIARIHQLQATVQILPLPQVIARTHQLQVTVQILPLPQVTARTRQLQATVQILPLPQVIARTHQLQVTVQILPLPQVIARTRQLQATVRIHLPQQVIARTRQLQVTVQILPLPQVIAQIHLPLQVIARTRQLQVTVQIHPLPQVIAQIHQLQAIVQTRRLPQAIHVMQVSPSQKQVRITGRTLT

SEQ ID NO: 3881 - protein, 329 aa, Enterococcus faecium
  misc_feature (B) LOCATION 1...329
  hypothetical: YES
EYIPMFKGKARAYTNIALIKYWGKKNEELILPMNNSLSLTLDAFYTETEVIFSDSYMVDEFYLDGTLQDEKATKKVSQFLDLFRKEAGLSLKASVISQNFVPTAAGLASSASGLAALAGACNTALKLGLDDLSLSRFARRGSGSACRSIFGGFVEWEKGHDDLSSYAKPVPSDSFEDDLAMVFVLINDQKKEVSSRNGMRRTVETSSFYQGWLDSVEGDLYQLKQAIKTKDFQLLGETMERNGLKMHGTTLAAQPPFTYWSPDSLKAMDAVRQLRKQGIPCYFTMDAGPNVKVLVENSHLSEVQETFTKLFSKEQVITAHAGPGIAIIE

SEQ ID NO: 3882 - protein, 127 aa, Enterococcus faecium
  misc_feature (B) LOCATION 1...127
  hypothetical: YES
MEIPVVFIAIAIAALILLMLLIVFVAKYQTAKPDEALIISGSYLGSKNVHIDESNNKIKIVRGGGAFFLPVFQRSNRISLLSSKLDVSTPEMYTEQGVPVMCDGTSIIKIGSSVKENVSAAAPFLGP

SEQ ID NO: 3883 - protein, 61 aa, Enterococcus faecium
  misc_feature (B) LOCATION 1...61
  hypothetical: YES
ASIPDAAHSMLFLIGMATVFLTNFIRCRTSFRMLFRLSLTMSLLGCDDLRQELTVKVRLPR

SEQ ID NO: 3884 - protein, 61 aa, Enterococcus faecium; identical to SEQ ID NO: 3883
  misc_feature (B) LOCATION 1...61
  hypothetical: YES

SEQ ID NO: 3885 - protein, 81 aa, Enterococcus faecium
  misc_feature (B) LOCATION 1...81
  hypothetical: YES
RNVPKNLQWMIVQLKKDYSSDHAFFITPPAVDETKQKYRNNKLIKEYISVLTEVAKRHDCEVSIFIRNFLNKWIRRIFIMG

SEQ ID NO: 3886 - protein, 211 aa, Enterococcus faecium
  misc_feature (B) LOCATION 1...211
  hypothetical: YES
EEVPIETRDYITTHQKLIESGLSHFEKEGFQQTKIRQLCLTAGVTTGAFYKHFTSKEALFEEIIQPHINALINMYNEEFTKYLLNLENIDIEKSWRENFNELDPFINYIFENKRIFDLVLFQSAGTKYQDIVEKITSFVTKKTVCCLDKLKTIGMINQNLVFNEEEIHFYIYSFYATFYDILKHSYSKEKTMLLTRRLYQFSVPGWIELLS

SEQ ID NO: 3887 - protein, 130 aa, Enterococcus faecium
  misc_feature (B) LOCATION 1...130
  hypothetical: YES
NRSFRRKQMFTNEIKIMLYVDDVEKNATFWRAVGFAEKDRQEMDGTLIIEVGVEDSQTSFLLYDRAFVESHSPGTATSAPSLMFYSKDIFGLYKKMQTQSVTLGDMVQLGEEYVFNFADPDGNYFAVTGK

SEQ ID NO: 3888 - protein, 153 aa, Enterococcus faecium
  misc_feature (B) LOCATION 1...153
  hypothetical: YES
KYPPPIGFLWLDADESGLTAVSFQPISESESANLRILTRTQEQFEEYFAGKRKEFDVPLSIKRGTPFQQNVWKALSTIPYGEIRTYKEVSVAVESPKAVRTIGHANRTNPLPIVIPCHRVIGQNGKLTGYMGNAIDGVEIKRQLLLLEGYLQN

SEQ ID NO: 3889 - protein, 244 aa, Enterococcus faecium
  misc_feature (B) LOCATION 1...244
  hypothetical: YES
KDPPFNNVNLRKAISYSIDREALVKQVLGDGSVVSTGLIPSDMVKSPTTNEDFAKEAGKLVSYDKDKAKEYWEKAKKELGVDSLEFDLMASDDDSSKKVIEYVQNSIQENLDGVTVKPTPVPFSVRLDRSTSGDFDAVLGGWAADYADPSSFTDLFVTGNSYNRGRWSNAEYDEAVKAASSTDAGDEQARWDDFQKAIKIISDDMGVVPVYQKAEGHLVNEKIKGIVHHAAGASWDYKWTYVEE

SEQ ID NO: 3890 - protein, 76 aa, Enterococcus faecium
  misc_feature (B) LOCATION 1...76
  hypothetical: YES
GFAPGLSILFTATMIGTPAALAWLIASTVCGMTPSSAATTKIVISVILAPRARILVKAACPGVSKKVIGLPSISIW

SEQ ID NO: 3891 - protein, 83 aa, Enterococcus faecium
  misc_feature (B) LOCATION 1...83
  hypothetical: YES
NVAPGNFNHSLEKQYFGIFQLGQTSGNCTLISAENPKILVKWKSPSFEYFWVISKFKTPVWGQLGTGFLSKCSNQYRRHSYSI

SEQ ID NO: 3892 - protein, 122 aa, Enterococcus faecium
  misc_feature (B) LOCATION 1...122
  hypothetical: YES
LPAPIPSGRGLSSPRPRRSVSLIPPRSGLPVPAPAGRSPAGGVPAARSAASRCMSPCGVPEERSAAACRTCPAAFPPFRPPRPSPSRESGSRPSSCMPVLPFCMLLSSLSRFNVLNCSLTLV

SEQ ID NO: 3893 - protein, 348 aa, Enterococcus faecium
  misc_feature (B) LOCATION 1...348
  hypothetical: YES
KEAPLMLTIAYLGNGKSTNRYHLPFSRKLTNKINIKKIFSPSEPVWKTFEDIEYTDQLSDLWDDPEIQLVVITTPSQFHYEYGKMALEHGKNVLVEKPFAETSKEAEELFALAKEKGLFIQCYQNRRFDSDFLTVQKVIESGKLGDILEVEMHYDYFRPEVPENTHEFSTANSYLYGHACHTVDQVLSYFGEPDDISYDVRQLLGKGRMNDYFDLDFFYGNMKISIKSSYFRIKERPSFVVYGKKGMFVKQTKDRQEEHLKMFYMPDHEDFGIDLPEHYGVLTYIDEQGSYHEEKVISEVGDYSRVYEGIYETLVNGAEKVIKDEETILQMKILEEGIKSIQESEGKI

SEQ ID NO: 3894 - protein, 264 aa, Enterococcus faecium
  misc_feature (B) LOCATION 1...264
  hypothetical: YES
RNPFIHVLEKKTDQICSVFFSCCSASLPINLYERRDNMPTIHIAGDSTAAEKDENKRPETGWGEKISAYFSPEIQINNQAKNGRSTKSFIQEGRLARLASQFQPNDFLFVQFGHNDQKIQEERGTLPFGSYLKNLQIFFECAKKANVQMVLLTSVTRRDYLENGTLNPDILGDYPKAMRAFAEKHHIPLLDVFSRSQELFQTFSKEETKKFYLHLIPDTCKNYPEGLKDNTHFSPEGADKVARIIVELIKESRLPLANYLQKGV

SEQ ID NO: 3895 - protein, 181 aa, Enterococcus faecium
  misc_feature (B) LOCATION 1...181
  hypothetical: YES
MTQPAIRYRLIKKEKHTGARLGELITPHGTFPTPMFMPVGTLATVKTMSPEELKEMGAGVILSNTYHLWLRPGEDLVEEAGGLHKFMNWDQPILTDSGGFQVFSLSDMRNIEEEGVHFKNHLNGSRMFLSPEKAINIQNKLGSDIMMSFDECPPFDESYDYVKKISRTYVSMGRTRIESSC

SEQ ID NO: 3896 - protein, 228 aa, Enterococcus faecium
  misc_feature (B) LOCATION 1...228
  hypothetical: YES
VFKPLIDSYSAVLKKFKGKDISATINEEVNIDRLKTMYDGYDGDRVIEIRFIDPRRFTVQQRNFIYALIGDIFIDTGMPTDFWKEFFYFRFEGVTGRKISLKDESNTTVSDANVLANIILDFIFEHHIPFKEGYEILPANQEYYFYKCITKRVCCICGKTGADIDHFDKALGRRKRKEVDHAEYTFAALCRIHHTEKHKIGVINFKNKYQIKGIKLNQKTIKKLNIGG

SEQ ID NO: 3897 - protein, 230 aa, Enterococcus faecium
  misc_feature (B) LOCATION 1...230
  hypothetical: YES
VFKPLIDSYSAVLKKFKGKDIGATINEEVNIDRLKTMYDGYDGDRVIEIRFIDPRRFTVQQRNFIYALIGDIFIDTGMPTDFWKEFFYFRFEGVTGRKISLKDESSTTVSDANILANIILDFIFEHDIPFKNGYEILPQNEQYFFYKCLTNRVCCSCGKKNADIHHVDSVGMGNNRKKINNSGRRFMALCRECHTKIHVEGFTTFTTKRKLTAVVLKDSDLKRLGLNIIE

SEQ ID NO: 3898 - protein, 195 aa, Enterococcus faecium
  misc_feature (B) LOCATION 1...195
  hypothetical: YES
SHKPALWYDKQRNKTRRNNRLIVGITGLIGVLTGAVVVYIGMILQMRHLENKEQRRRELELKVKEIETLNQLNKKINEILQKRTTLMEEYVSFDAFDDCYITIDDFAYLQSFSAQNSFYLPNYILDELFKNISHRKVILSPDETMKIGGYAYKGGRVILENFTDSLTEMINEKKAQLKTMTRQPIGFFSKDDVWS

SEQ ID NO: 3899 - protein, 126 aa, Enterococcus faecium
  misc_feature (B) LOCATION 1...126
  hypothetical: YES
NVKPYPKNRFISAYCVIREDGTKECLSYAIAPTESTYVWNELLQDINSRGVQEVLLFITDGLKGMKDTIHQIYPKAKYQHCCIHDSRNIAHKVRVKDPKMKICDDFKAVYQANSKEEAKYLLIRHD

SEQ ID NO: 3900 - protein, 223 aa, Enterococcus faecium
  misc_feature (B) LOCATION 1...223
  hypothetical: YES
NVKPYPKKRFILPLVYEEDGTIEVLSYAIAPTESTYVWNELLQDINSRGVQEVLLFITDGLKGMKDTIHQIYPKAKYQHCCIHVSRNIAHKVRVKDRKEICDDFKAVYQANSKEEANTFLSGMIEKWKKNYPKVTQSLIENQDLLTFYDFPPSIRRTIYSTNLIESFNKQIKRYSRRKEQFQNEESLERFLVSIFDTYNQKFLNRSHKGFQQVTDTLVSMFTE

SEQ ID NO: 3901 - protein, 179 aa, Enterococcus faecium
  misc_feature (B) LOCATION 1...179
  hypothetical: YES
GGKPVRKRGFEVISKYKDQNINLPQRATHHAAGYDFEAAEEVVIPSIWKAGWKKGLETVADGLKKDVSENEKQLKPTLVPTGIKAYMGEDEFLQLANRSSNPLKRFLVLTNGVGVIDSDYYNNEANEGHIMFQFTNFGFKDVVIKKGERIGQGIFLPFLKADQDQTTAQRQGGFGSSSK

SEQ ID NO: 3902 - protein, 631 aa, Enterococcus faecium
  misc_feature (B) LOCATION 1...631
  hypothetical: YES
MEKPFSKNYTYLVRRIATALINKGEVKMDYSQLAKDIVRFVGGEENVSNVYHCATRLRFTLKDNKKADKEKVEQLEGVITVVEAGGMFQVVVGNAVNEVYDVLSKQMKLEDDASSGKRGTEKKGILNSFIDMIAAVFAPTLGVLAGSGLIKGVLALCTSLNLLTTESGTYIILNAAADAFFYFLPIFLAYTAAKKFNTDRFIAMVIAAALVYPTIVSAYSDSITLRFLGMPVILARYTSTVIPAILAVWVLSYIEPKIRKSLHESIRNLLTPFICIIVMVPIILLVVGPIADYASQLIAAGYLAVYNFSPVLSGAVIGGFWQVLVIFGLHWGLVPVMTNNLSFYGRDTLGPACMTAVAAQAGAVLGVFLKTKNKKVKSLSLSAFITALFGITEPAVYGVTLKYKRPFYIACICGAIFGGVAGAAGAGALAVATRSILSFPIYIGEGFVWLVASYFLAMISSCMLTFLFGYKDEIEEESSKDIVLSTPAAGEIIDLSEVNDPTFASGSLGEGFAIIPTDGKIYSSVNGEVSTVFPTKHAIGVVSEEGAEILIHIGIDTVNLNGKYFQSAVSDGKKVRKGDLLMEVDLQELIKEGYDPTTMVIVTNSSRFKNIITSHKKNNQTRKLASLGGSI

SEQ ID NO: 3903 - protein, 92 aa, Enterococcus faecium
  misc_feature (B) LOCATION 1...92
  hypothetical: YES
RHEPLPKTPPTRGPTAIPQPSAASYIMIAFSVLPTKILTIVAKAVETNKAFPTPQPARNPISIPIFPDNPPRPANTTMINNPVINVFSNRSD

SEQ ID NO: 3904 - protein, 379 aa, Enterococcus faecium
  misc_feature (B) LOCATION 1...379
  hypothetical: YES
SLEPLKVLFFNNAINHGVLTPLGIEFSQTVGYSSLFLMEANPGPGLGILLSILCFAEKQEKVNASGALMIHAIGGIHEIYFPFVLLRPYLFLAVMAGGASGTLIFQWLDTGLAAPVSPGSLLVIFANAPYPQLAGVSIGIAISTFVTFICAAILLKLPNKEKENKTVKERGEILEPSIIHSVIFACDSGMGSSAMGAALLKKKLAAEKIDLSVGYSSIYELNNQVNQLVIVQHELAGLAREKVPQSQIYVLDHFLETDILLSRIKEAIQFPKREEKKEIADITEQKTSPANIVFLYKNNRRGSQTMGMTILSQLAKKAKKQFVISKESIEKIKIQEETIYIAQRELAVTEQLEEKIPRLVLVEHWVATNEYEKLVKGEI

SEQ ID NO: 3905 - protein, 232 aa, Enterococcus faecium
  misc_feature (B) LOCATION 1...232
  hypothetical: YES
IMEPEQLRAIVKENNSLETKLTKRNQQYIFDLKKSLEAANLSEEEKVKALHDILPTLVAEQKGGRTARQLFGTVSERTEAIINKPAEVKNSSTPLLMWLDNTLLLLGLLSIMIAITGLFSRGTTPAYGFSTLVLGSAIGGWVFYMMYKYIYQYEYPGADRSKKPGMGKTLLILGGTTLLWVVLFSATTLLTPVINPVLDPVVVIIIGATALAIRYYLKKKYGIIGSLSVPRR

SEQ ID NO: 3906 - protein, 77 aa, Enterococcus faecium
  misc_feature (B) LOCATION 1...77
  hypothetical: YES
MARPVLDAMDMDTLTKGRYVQLLARGYSPKDVFKALSKGTDMEKERLRKEFDYWREHNGIKDLKPARPVIRRKKLKK

SEQ ID NO: 3907 - protein, 72 aa, Enterococcus faecium
  misc_feature (B) LOCATION 1...72
  hypothetical: YES
QKPLNCLERFYRKGVCVIDNAVKTIQKKNNKCGIGNRGKTKIVVKEHFSEKGKTMEELLTDVMLEKAKQTIA

SEQ ID NO: 3908 - protein, 195 aa, Enterococcus faecium
  misc_feature (B) LOCATION 1...195
  hypothetical: YES
FIRPSHTMSKLQKMIYISLLVAQGVIIGLLANMIPYPFSFAPGAILGLANLITIVAIFTMKKRDSFLLLWLRLFLTTLLGGTISTFLYSMSGALLSYFGMLLVKQLGPKRVSIIGISAAGGFMHNVGQLLMASFIAQSWTVMLYLPVLSVLGILSGIAIGIAANYLLRHVQTLQRFQKDYEQGTKQKWSPMFTKK

SEQ ID NO: 3909 - protein, 111 aa, Enterococcus faecium
  misc_feature (B) LOCATION 1...111
  hypothetical: YES
SGRPGYRCDDRNFFGKTGFPILKPGGRYVALNDLPDLDLRQKKEGFYESFVPRKEYLDAEAFAGIIKAYQKGAFHVFISMNLSASLKHVIQAHQVVEGHPPAGKIILSFEK

SEQ ID NO: 3910 - protein, 575 aa, Enterococcus faecium
  misc_feature (B) LOCATION 1...575
  hypothetical: YES
TRRPVQRVDEFMNDYIEKVLSGKLIAPKKIIQACERHISDLERSKSDSFPYVFDEEQATKAIKFIELLPSTDGKAIKMLGFQKFILGSLYGWRTKEGNYRRFNRAFTSMSRKNGKTYIASGMAANALIMEQEPAEARQVLFVSNALKQAKLGYDMLSNSLRNVVKSSKFLRPQLKIMNSKIQHLPSNSFAMALASETSTLDGFAPTTAILDEWHEAKTRKTYNVIKSGMTQQKNGLLCVISTAGLDLNVPMYEEYLLLDRVLKGEEQADRYFIAIWELDDPEEIHDQEKWIKANPIFESEEIKKVMIPTIQDDVNLALKQNNLNSVLVKNFNLWRQASEDSYMIAEDWQATEVEPQDITGKPVYIGVDLSKTDDLTSVSWIVPLDNGELYCDSHSFVATKYGLQDKEKRDGLPYRELEKAGECSITQLESGIVDYDQVFQFIQDLIQENDLECMGICYDPYNANSLISKAEKANYPMLEVRQGTITLNVPTRTFREQVYEGNVIHNKNTILTHAVNNAILKTDNNGIQINKSKNSNKIDPIAALINAYVFAMDYFTTTEGAKADNEFYTSEEFSF

SEQ ID NO: 3911 - protein, 219 aa, Enterococcus faecium
  misc_feature (B) LOCATION 1...219
  hypothetical: YES
SSTFVLAFIRSRITYIIVSVFSVTSKTLSSFWKSRYDEKKGGFYMTKKAVFAGGCFWCMVKPFEEQPGIISVTSGYTGGHVPNPTYEQVTTGTTGHTEAVEIEYDPEVISYDQLVEIYWQQTDPTDALGQFADRGDSYRPVIYYNDEEERNIAERSKQALQDSGRFDKPIVTKIEPRSEFYPAEDYHQDYYKKNKLHYNLYREGSGRAGFFRRHWGVKK

SEQ ID NO: 3912 - protein, 322 aa, Enterococcus faecium
  misc_feature (B) LOCATION 1...322
  hypothetical: YES
RSTFIRKPKNHAKGATKDMATIKVSRTTSCSRAINYAEPRATIKTGINCDVDYAKSEMKQIRMLYGKDDRVQAHLLIQSFRPGEITAEKANQLGAEYAKKIAPDHQIAIYTHTDKDHIHNHIVINSVNLETGKKFQAHGQAFLNKCYDLNDEICLAHNLPITERGKKPEKRTMSEIKLKEKNEPVWKDEIRIAIDQTMKNKKTRTYDQFCNSLKTLGIHCFNRGKNFTYELIHKKKKVRSNRLGKDYEKETILHELDRRERTYNQQRTNELRRARASIRETAEEVRREQRTLTPEQPEIRPARRNHEQHVERGTDHQQELSL

SEQ ID NO: 3913 - protein, 408 aa, Enterococcus faecium
  misc_feature (B) LOCATION 1...408
  hypothetical: YES
GILPTKLSNGKYKTNLRYPKKFREITGITSEKYQKVFPTRQLAIKAENAMKRKIETVLREENANSLELKGKIKFKEFYESKWLPRYELGQTTRSKRAPSYVTISNTKDIFRLHILPMFGEYAMNYLNSNTEIISDELTKKSKEYANIKIIKGYVRSMFDIAEILNYIEFNRTTKIIQCITVPKKIALEERRIREGNQALSSEELIAWIEAVNTDLNNHLLTLHDYTLFMLTLYLGDRKSETYALQWKYIDFEKQTVRLKHALDKYQKKKFTKGRKDTVIQVPEIVMALLSKWKSVQAEQLLRLKINQTPDQYLFTYTKPSGEVNCPVHADYLNYRINSIKRRHPELAHLSPHKLRHTYATIARQGGANMNQISNALTHSDISTTKIYVNTPDVVDKTVFEAFQKGLKN

SEQ ID NO: 3914 - protein, 349 aa, Enterococcus faecium
  misc_feature (B) LOCATION 1...349
  hypothetical: YES
IALPRRHRSPGLFSFRQEALKMPETLNLNYYYGNEADQYSFYRIPKTLLTDRRYKGVSLEAKVLYGLLLDRMGLSARNGWLDNNGRVFLYFTQEEAMTMLGCGKDKVTKLFRELEGIGLMERKKQGQGHPARIYVKNFILEPEPTAPVQTAENQQSRPLPSAAVKTAEKPQSAPRKTSGQECGISAPNNTDINKTEKSDTDLSILPPTPSAVSSPAGKRAPRRMGLDEMESYRELIMENIDYDILLERYPYEKDLLDGYVELMLEVCCSTRESVRICGQEVPTEVIKSRFLKLNSEHIGYVMDSLKSNTAKIGNIKAYTLAALYNAPVTMGQYYTSLVSHDMAHGLLSG

SEQ ID NO: 3915 - protein, 448 aa, Enterococcus faecium
  misc_feature (B) LOCATION 1...448
  hypothetical: YES
TETFQKIGGTSMKKRMLAIAAILALTAGGLAGCGSKEKSSGSSDPGEIKIWVQFSDETPEGKAWAEIVNNFNDEYEGEYKAVTEYIPRSGSGGGYEDKVNAAITTNTLPDVITLDGPNTAAYAHSGVIAPLDDYLKDADMDDVLDSIIQQGTYDGKMYAFGFSESSVGVYYNKSLFKDAGITEDQLPTLEDPWTWTEFQAICQKLTDKYKTPAIDMQMASGDEMLTYAYTPFIWSNGGDVVNADGTKAEDYFNGKKSVEALEFIQELVEKVYTTISPIEKGFETGKYAMMLSGSWTMADLEGNYQEIDYGILPYPVSDATGELVSPTGSWQLAMTEKTEKKDASAAFIKFATSTESSRIMSLGNSVLPIRNSTVDLIKDEVSEGMQVLIKQNQISGHARPVVVAYPQVSRAFQQAVQDISYFEENPDVQKVADSRAAEMQQAIDTSLK

SEQ ID NO: 3916 - protein, 231 aa, Enterococcus faecium
  misc_feature (B) LOCATION 1...231
  hypothetical: YES
SSLPEISNKHKLEELLNELQQIPEEIWGFYQFRRDLFWKKIPLSKQKILIQQSIDCGIETACSIKKKYPFADVGEICEQMAVPIVSCESEQINERITFATYAEDEGIRLMTEPLEKLKCSGLASISKETAQALIIGHELFHHIEASVKGIYTQSEKIVLWRLPFYTHQSNIRALSEIAAMSFSKEMNQSDFSPYVLEAVLLWPYNEIRSQGILEEIKKIEKRCTEYDLDYK

SEQ ID NO: 3917 - protein, 63 aa, Enterococcus faecium
  misc_feature (B) LOCATION 1...63
  hypothetical: YES
LGLPIGSVAKIAGNVSTPVYFLVSIEELPNDEADFSGYLTIGLSDPQSKQAAIPLHKYIGLLC

SEQ ID NO: 3918 - protein, 88 aa, Enterococcus faecium
  misc_feature (B) LOCATION 1...88
  hypothetical: YES
RGLPFQSFESRSFHYFPEFSLYMIQLNPRYSDVPSYSFPLTNIDLNYNEFDNRKKEERFLLNKSFRINKKKYGIYYSVSTRPRGVEPL

SEQ ID NO: 3919 - protein, 638 aa, Enterococcus faecium
  misc_feature (B) LOCATION 1...638
  hypothetical: YES
SLMPKNKNETLCVEDLRHAEYYEMQNTFDDLYAKSKNGDIFTHLMDIILSRENILLAYRNIKANAGSKTAGTDGTIIKDIGKLPAETVVKKVRYIVAGSPHGYRPKPVRRKEIPKPNGKTRPLGIPCMWDRLIQQCIKQVLEPICEAKFSENSYGFRPNRSVENAIKATYNRLQISQLHYVIEFDIKGFFDNVNHSKLIKQIWAMGIRDKHLIFILKRILKAPIKMTNGTITYPEKGTPQGGIISPLLANIVLNELDHWVESQWQENPVTKNYVVHINKSGSPCKSNAYKEMKKTKLKEMYMVRYADDFRVFCRYKESAEKAKIAITQWIEQRLKLEVSQEKTRIVNVRKRYSDFLGFKIKMIPRRKKLVVKSHISDKQFKNQKDKLVSQAKKIASPSKGKTELEETRLYNSMVLGMQNYYQIATNVNLDCMKLNRAVMAIFTNRLGTNKRGRLRKTGRQLTTKEATRYGKSKMLRYVAGEGEPIFPVGYIQHRKPMAKVYLANCYTLEGRKFIHTNLSVDKLLMYQLMKLSLENRTIEYADNRISLFSAQHGKCAITLEEFQQANEIHCHHIVPTGAGGNDDYKNLILVKEAVHRLIHAKTEETIQKYIALLKLNKVQLIRLNKYRVLAGNQELNLI

SEQ ID NO: 3920 - protein, 113 aa, Enterococcus faecium
  misc_feature (B) LOCATION 1...113
  hypothetical: YES
VIMPAFYEVKMMYRNPKNIKQEIKLFFFYLVDLGIVAGSVMASVYFAKLMPISPMMKFALYLLAFVVGVWMCVRTPNHPKERNILMLYYLFKMDRNRYHEVEFKRNSRGKIEL

SEQ ID NO: 3921 - protein, 148 aa, Enterococcus faecium
  misc_feature (B) LOCATION 1...148
  hypothetical: YES
RNMPIGKVLILCERLVRQTFAIVDFTEVDEENARFELFARYASILRTLIKQLELRLQIAYDLPYERLMADIVKEIIQEQLLNTIKYDLVEYEKEKQYDIILTSQLKELPSQKSAKVFVFTXNEYNXDFPYXKQFLKECYXEXIEFKDE

SEQ ID NO: 3922 - protein, 74 aa, Enterococcus faecium
  misc_feature (B) LOCATION 1...74
  hypothetical: YES
NRMPAGCGKGGRMDNRKLTVCYGHGNYKQAPTQIVLQGKWLEQAGFSVGDKITVKCQQGQLTITKNETGNDSEK

SEQ ID NO: 3923 - protein, 123 aa, Enterococcus faecium
  misc_feature (B) LOCATION 1...123
  hypothetical: YES
TIMPEDSLKFLGRHIRAERVRCNLTQQELADQSGLAVKTVQDIEKGRKNPSYETLSRLIERLGISPNVLFQASNSIEDEELQRFMGKFQSCNRDNQQILLNTLDFLTEQLLDLQRKPESNSSE

SEQ ID NO: 3924 - protein, 64 aa, Enterococcus faecium
  misc_feature (B) LOCATION 1...64
  hypothetical: YES
SRMPLTGKKMLKLAKKNGWKVVRITGSHHIVAKEGFPPVPIPVHSNQDLKKGTEQKLLKDLGLK

SEQ ID NO: 3925 - protein, 308 aa, Enterococcus faecium
  misc_feature (B) LOCATION 1...308
  hypothetical: YES
RDAFYNSVTELIGKTPIVKLNKIVPEDSADVFVKLEFFNPGGSVKDRIALSMIEKAEHDGLLKPGDTIIEPTSGNTGIGLSMVGVAKGYKVIIVMPETMSIERRLLMKGYGAELILTPGADGISGSIREAERLAKENGYFLPLQFENEANPLVHEKTTGPEIHQAFGVNGLDAFVAGIGTGGTITGAGRELKRVYPKIELIGVEPAESAILEGKEAGPHKIQGIGTGFVPKTLDTSVYDKVLSISGDEAMETAREVGRKERILVGISSGAAIAAALKVAKELGKGKKVLAVVPDNGERYLSTALYQEI

SEQ ID NO: 3926 - protein, 64 aa, Enterococcus faecium
  misc_feature (B) LOCATION 1...64
  hypothetical: YES
AIPPMIAPRRPPTALPNIPAVPPAKKLVSIPGKIIAKPNMGKVNMAIIVPIVVVMKPKMTAFGL

SEQ ID NO: 3927 - protein, 70 aa, Enterococcus faecium
  misc_feature (B) LOCATION 1...70
  hypothetical: YES
RGAPGIADSQGTACTGPGHAAENRLAGHGGRSAKQSPAGAGKAGQPAGKNHAVRRQRGREFQARGRDCAG

SEQ ID NO: 3928 - protein, 73 aa, Enterococcus faecium
  misc_feature (B) LOCATION 1...73
  hypothetical: YES
LTAFTIVAKLSSVKIISAALCATSVPVIPMAHPTLLAFNAGASFTPSPVIATTAPVRCQDLTIRILSSGVTRA

SEQ ID NO: 3929 - protein, 258 aa, Enterococcus faecium
  misc_feature (B) LOCATION 1...258
  hypothetical: YES
WHQPTKKFCSRYWFENDASTCSRTKGTSPYFPRKPAISVNDHFTKGGTPMITVVIIDDDPFVTKSLQTILESTKEIRVLGIGHCAKDALVLYETHRPDVLLTDIRMPKQTGIDAAKEILAKFPKAILLLLTTFKDEEYIREAFSIGVKGYLIKQNLQAIIPSVKSAYNGQAVFGNEIIETFTQMMKNKPTIDSHAYASFSERELAIIKEVAAGKNNKEIADALYLSDGTVRNYISQLLEKLDLRDRTQLAIYFYQHLQ

SEQ ID NO: 3930 - protein, 696 aa, Enterococcus faecium
  misc_feature (B) LOCATION 1...696
  hypothetical: YES
SKQPNPRSCNQWRKILVYGDYDADGITSATVMKETLELLGAEVEVFLPNRFEHGYGPNQSVYQEKIEEGIQLIITVDNGVARNDAVAYAQQAGVDVIITDHHELPENLPDAYAIVHPRHPAGHYPFPDLAGVGVAFKVASALLEEPPAEFLDLVAIGTIADLVSLTDENRILVSLGIDAIHHSERIGLQALFEESGVKMRDADETTIGFSIAPRLNAIGRMGDPRPAVSLLATFDEEEASVQAKKLNEINEERKAIVEQITQEALAMVNKENHIHLLVNRGWHEGVLGIVAGKIMNETGKPTLVLTLKEDGSAKGSGRSIEALNLFEMLDQMRDLFTYFGGHHAAVGLTMPSENVTILQEKMNQYIVDHQIDLMRGPELRIDEVLLPNEVTVERIDELKLLAPFGTDNPLPQFLFRQVQAENIKRIGANQQHLKFVLSDASSQLDAVAFGFGTQEEELLNNQVDVVGKLSINEWNGCKKPQLMVSDFSVVGLQVFDWRAKRFREQSRTSEGSLYLAFDSSTLKFVPEIIQEAAIVFEGLDSVKAIIEKRKPNSLVVMDCPDDLADLKEVFRSYSFNRVYLMGISPDEAYLNGVGTREQYAKLFKLIHSQERIDIRHKIKAIAQYLRIPEKLLIFMIQVFFELKFVTIENGVLQKVASPESHPLTESRLYQRRLNKIKVEEFLLLSDIPTIKKWLTT

SEQ ID NO: 3931 - protein, 73 aa, Enterococcus faecium
  misc_feature (B) LOCATION 1...73
  hypothetical: YES
TSKPTSTAPIPVHNISFVGLPPFFFKISGWIPQPTAGINAINKPIFIHPYPFPPWKEGYKVIPPSANSVIPVT

SEQ ID NO: 3932 - protein, 97 aa, Enterococcus faecium
  misc_feature (B) LOCATION 1...97
  hypothetical: YES
RNKPFLVCLTVTKKLIRRLKKMNLKEQMMNQYQKKDSEKIKDAIAEAMKIGRNEVLYGKDVITDDIRKEFQDGGFTVEDYEDKHTIDAKIELVRFSW

SEQ ID NO: 3933 - protein, 94 aa, Enterococcus faecium
  misc_feature (B) LOCATION 1...94
  hypothetical: YES
QLEPLIVIKGAKKIIRNKTILHLDRFTADAGDLVTVVGESGAGKSTLLNILGLNDQFSSGQFYLFDQETKQLTGREKRLIKRNTNILFFFKILG

SEQ ID NO: 3934 - protein, 186 aa, Enterococcus faecium
  misc_feature (B) LOCATION 1...186
  hypothetical: YES
NEEPSMESFEKNWYVLHTYSGYENKVKANIESRAQSMKMADFIFRVVVPEEKETEVKNGKEKEIVHKTFPGYVLVEMIMTDASWYVVRNTPGVTGFVGSHGAGSKPAPLLPEEVNHILRSIGMSLRQNDLEVEVGEVVKIIEGAFAGLEGQVTEVDGEKEKLKVNIDMFGRETSTELDFDQVDKID

SEQ ID NO: 3935 - protein, 221 aa, Enterococcus faecium
  misc_feature (B) LOCATION 1...221
  hypothetical: YES
RLWPIKNVLDISAPVMIGPSSSHTAGAARIGKIIRSIFGEQPDSVDIYLYESFAKTYRGHGTDIALVGGLLGMEPDDERLADSLKLAYEAGMEVLFVPKSEKAEHPNSVKMLLKKGTRKLSVTGISIGGGNIQISELNGFKISLSMGTPTLIVVHQDVPGMIAKVTSILSETNTNIGTMTVTRESKGENAIMIIEVDDPQVEETVKRLKQLPNIDSVNYFD

SEQ ID NO: 3936 - protein, 257 aa, Enterococcus faecium
  misc_feature (B) LOCATION 1...257
  hypothetical: YES
KIWPPRRKKIPPNQVRFENVQSGYPPDNLLMTDFNLDVQPGEMFAIVGPTGAGKTTLINLLERFYDVSGGSIRYDGVDTRDLSRDELRAQFSMVLQDTWLFTGSIYDNIKYGNDDATDEQIIEAAKAAHVDDFVRKLPEGYNTVLNEDASNISQGQRQLITIARAFLANPDVLILDEATSSVDTRTEILIQKAMNRLLENRTSFVVAHRLSTIRDADNIIVMNHGSIVETGNHDTLMEKDGFYADLYNSQFSEEEAS

SEQ ID NO: 3937 - protein, 363 aa, Enterococcus faecium
  misc_feature (B) LOCATION 1...363
  hypothetical: YES
GPWPNTEIYRKIDTIILHMPDYIKDFVQDREDKDQSPRTTLEYLKNYKLFYEWLLSESIVPDTSITSIRQLTAYDLNLYKSHLKRRTKENVKKETTKTKLKDNNNLGLSTSTINRNITALKVLFKYLSKSSNNPLGKPYLENNPMDQVATITDKTTLAARANAIEKKLFLDEDTQNYLDYIANEYKKTLSKRALIYYQRDVERDLAINALILGSGLRLSEVVNINLEDLSLEKNNVVVTRKGNKRDAVNIAAFAMEYLANYLAIRKERYKVTENEKALFLAIYQGEAKRISGIAIERMVAKYSKGFRVQVSPHKLRHTLATRLYQQTNSLVLTAQQLGHTSTNTTTLYTHIDNAATIDALNAL

SEQ ID NO: 3938 - protein, 135 aa, Enterococcus faecium
  misc_feature (B) LOCATION 1...135
  hypothetical: YES
QLRPLNHSKKNGGSEMNEDYSKIELNDGTILNLEPKLNIKKLLMINRDFNTDEFAKMTVGKGSMDISVIQGAKAVYIAYRQANMTDYISFDEFIDKWDFDMATASYIYQLMMFKQARDAYQKEFEKANKEKKLQK

SEQ ID NO: 3939 - protein, 66 aa, Enterococcus faecium
  misc_feature (B) LOCATION 1...66
  hypothetical: YES
EIAFLILSNTLRPTSTALTIEAKLSSVNTIAAASFATSVPVPIAIPMSACFNAGASFTPSPVIAEI

SEQ ID NO: 3940 - protein, 183 aa, Enterococcus faecium
  misc_feature (B) LOCATION 1...183
  hypothetical: YES
QRRPKTQGAGAVFITMWAQDRNGLIGKNGLLPWRLPNDMRFFREHTMDRILVMGRKTYEGMGDLSLPYRHIIVLTTQPNFRTKENAEVMHSIDELLAYSQTISEDIYVSGGSRIFQELLPYTGRIWRTLIDSTFEGDTYIGDIDFSDFALIEEYEGITDQANLYAHRFQKWERVRNKVVSKEE

SEQ ID NO: 3941 - protein, 130 aa, Enterococcus faecium
  misc_feature (B) LOCATION 1...130
  hypothetical: YES
FKRPFRKTFPTPKRISPGQTDGETVLAQGAGVQNIEITGKNIKSFERVARKYGVDFALKKDPAQGKYFVFFKARDADALNAAFYEYAGKSLNRSAQKKPSLLGQLSHFKEIAKNLTRDTAKNREKGGVEL

SEQ ID NO: 3942 - protein, 68 aa, Enterococcus faecium
  misc_feature (B) LOCATION 1...68
  hypothetical: YES
MTAFGKSFKNLLTYEEGITNAMIYPYSNGKIEAKNTHIKTMKRVSYGFKSFENMRIRIFLINQLINVR

SEQ ID NO: 3943 - protein, 63 aa, Enterococcus faecium
  misc_feature (B) LOCATION 1...63
  hypothetical: YES
MQAFEHRLYQEVVSLPFNSESQGAISKNSFSCLLNIVTCDRGVGRRTPFIRKKDCDNVSTPKS

SEQ ID NO: 3944 - protein, 1196 aa, Enterococcus faecium
  misc_feature (B) LOCATION 1...1196
  hypothetical: YES
GKALYLKRIEIAGFKSFADKTVIDFENSVTAVVGPNGSGKSNITEAIRWVLGEQSAKSLRGGKMPDIIFAGSDTRKQLNIAEVTVILDNSDHYLPLEYNEISVTRRYRRTGESEFFINKQSCRLKDIQELFLDSGLGKESFSIISQGKVEAIFSSKPEDRRGIFEETAGVLKYKQRKKKAEQKLFETEDNLSRVQDIIHELEEQLTPLAAQSEAAKEFLRLKETLTQTDVSLMVAEIKTAKKDWDNKQAQLAKFNLELGKLSESIQEQESILAKQRKENAQADRLIEKNQQVLLDLSEKLKQTEGQKDVLQERTKHTQKSSQEYQTSLAEAQKKVKHFEKLQESLMKAAAEKETEIQKAEANLIKTQQELEKYQKSTKELLAELRDQYVDLMQEQAAVGNELKYLERQYIQETAKSKQTLAKQSEVEASVDRLMLQKEELTQKQAQLKSSLTETKEKLEMIQQNGKKFQEALAKEQPKMYQLMNQVQQLRARKKSLQEIQENYFGFYQGVRLVLQHKQQLSGIVGAVAELIDVPADFTLAIEAALGGAAQHVIVENEKDARQAITYLKQQRRGRATFLPLTTIKPRQLPAHILTQAAAVEGFIGIASEQVSYPDQIQTVVQNLLGTILLAKDLTSANAIAQTIRYQYRVVSLEGDVMNAGGSMTGGANKRGNQGSLFVQNQELKQLTSEFEEADKQLQAQEKKVQELQQETARLAEEQEVLRTRGEQLRFEEQEATNQLQNIINELERFEKEKQISTFETRELQQFIEDYEKQTNELKDKQTDLESQRQKIDEEIKSLSQESDQMEARRAQVQSQKAQEQADLAVLKEQFNHLQIQLRGARVQKAEATERQEAIEKQLATLTADFSDHEVTEESLEKQINELSAQRETLKAELAKAKEQRDRRQKEIDKLEAVLAERNREQKARLSEQSKLEVQKDRAEMILDNHLTYLQSEYQLTFEKASQDYQETTDIEDSRTKVSSLKEQIEKLGPVNLNSIEQYEQVSERHTFLATQRDDLLAAKNQLFETMDEMDDEVRTRFKEVFEAIRQEFKIVFPNMFGGGKAELVLTEPTDLLKTGIEIEVQPPGKKLQSLSLLSGGERALTAIALLFSIIRVCPVPFCILDEVEAALDEANVKRFGRYLSDFQDDTQFIVVTHRKGTMVAADVLYGVTMQESGVSKIVSVRMEDINEEAKINETKV

SEQ ID NO: 3945 - protein, 159 aa, Enterococcus faecium
  misc_feature (B) LOCATION 1...159
  hypothetical: YES
SVQFRTILFVRSRDETINWEREALDKKKYQYSVLFQDFGLMEYETIDFNLDIGLKFSNLNVSDKRTAKYEALKKVNINKKLSTPIYTLSGGEKQRIACARVLLKNSKIILADEPTGSLDKRNKDKVVEILSQQASQGTLVIVVTHDPYLTKIGNKKIML

SEQ ID NO: 3946 - protein, 170 aa, Enterococcus faecium
  misc_feature (B) LOCATION 1...170
  hypothetical: YES
IDQFESRSDATILAFSIAKDAGKTTILNPAPARETIPTELLEKTDIIIPNETETEIITGIRVTDHNSLVAAAEKLHELGIGTVIITLGSAGAFYHTEKEHGIVPAFKVDAVDTTAAGDTFIGALSSTLQPDLSNLKEAILYGNLASSVAVQSYGAQPSIPYREALEQSAV

SEQ ID NO: 3947 - protein, 70 aa, Enterococcus faecium
  misc_feature (B) LOCATION 1...70
  hypothetical: YES
LTAFYYDPEEMPDMENEEAIVRAIASLNQILQNEKVLRVSVEIDSEWEDGIKSFDISVKYLPSGDINGAK

SEQ ID NO: 3948 - protein, 226 aa, Enterococcus faecium
  misc_feature (B) LOCATION 1...226
  hypothetical: YES
TVQFSERSISPYQRFSFCFKLSVTSRHCPFFSIFTCTSAKPFPASSVMRNSAAALPVAQPEGGVILMERLDAGIGAGALPVHPARSVLQIGQSALTAPSSQRFSQTQTGTGVGASTIQSARFNRQAGQSALTAPGSQWAAQIQTSLAGGSGSLPVQPVTSCVQMGQSVSGASAAHRVSQVQTGSGSAPMQAAASCTQMGQSALRVSAVQRISQKQAIPIWPLHNEL

SEQ ID NO: 3949 - protein, 62 aa, Enterococcus faecium
  misc_feature (B) LOCATION 1...62
  hypothetical: YES
APQFLDTDLCAVHAEKRNLCRKHGAGQAVHTLLPQQKAGTDTQKGLDRCSQYARTYCITGTV

SEQ ID NO: 3950 - protein, 288 aa, Enterococcus faecium
  misc_feature (B) LOCATION 1...288
  hypothetical: YES
MKKLRVIATIPMIFSFALLLSACGKEEAGAKSNEAHNISFIDSAEQKDSRCWLVVETSSKNKTPIDKNEYVKAVIQTKDGKAKVFKTDMEQLTLEKVSKMSDEEIIEQALNADKQKFNDKKKSDIDSYNATLDSVKTELENEEKQEFQNDQKIADFQDSIPKIQADIEEIDGVQYSEPEWKMVSATIKMDNENKSPSMETVKLSYKYLDSPIWNLNSFGEVSSEGELSYESTSMDLKLSIPVATTKVLDNFYSGYSNDELDQLLLTKVASKDNKVQLDSKGKNVSIVE

SEQ ID NO: 3951 - protein, 84 aa, Enterococcus faecium
  misc_feature (B) LOCATION 1...84
  hypothetical: YES
LVFTYASKLCGKIGVVALLSKYIIRNPSFLKFFSIITVVQGAFQEQVKFSLVSIFKYTKKDKDKTIIRLALAGLLTFLLYTKSG

SEQ ID NO: 3952 - protein, 444 aa, Enterococcus faecium
  misc_feature (B) LOCATION 1...444
  hypothetical: YES
LAFTFLVTLLFRKSFIIQRRKKMKAKNLLFSVILLGNLAVANTTVLAEESTETVATQTSSSSETGIENDTESTLQSATVSENTISTEEPTTETTEQTQTEDSTSAEAQNNPENAEEITNQLTDGQTLTHTHQADLSEFENYTGYAFYARSSANSQQAFIDSIASTAQSLASANDLYASVMIAQAIVESGWGNSTLASAPNYNLFGIKGSYNGQSVTMPTSEYVNGQWITVNAAFRKYPSYKESLQDNVTVLKTTSFQPGVYYYSGAWKSNTNSYKDATAWLTGRYATAPNYGSTLNNVIETYNLTQYDTAPTSTSPMYRLYNRHTGEHLYTLNAGEKNYLPTVGWEYEGIAWQAPNSGQPVYRLYNPYSGDHHYTMAQSEINSLTKIGWRYEGLSFYSGGSKPIYRLFNPNEKTGTHHYTLSAKERDWLTPMGWRYEGIGFYGY

SEQ ID NO: 3953 - protein, 69 aa, Enterococcus faecium
  misc_feature (B) LOCATION 1...69
  hypothetical: YES
VRKFKGNFQELNYITKEMNFMTFTKKNMQYRVAFDTTSNRFMAIDAQNENNVAFGITIEQAVRALNESR

SEQ ID NO: 3954 - protein, 629 aa, Enterococcus faecium
  misc_feature (B) LOCATION 1...629
  hypothetical: YES
KTFTLTLQVLERNTFMAFFNNIYNKKESFYLRIKWSTIIILSLLFLTGIAYFFYFIFSPADSNQMKEIKDSWVFYTKDDPDFKFDSKYTRTIPTVDKDETFIMETTLEKPLDEANLLIKGNHQWITVYLGEKILYQRKDYQEESNPGLSLAVIDLPANYIGKKLTLTVSSPYQNYAGLPPKVYLGTTGPLISFIYSQSVPQVLTMIIAVFIAIGTFFYTIYLMYKQKRLEYSLILLSCFALALGFEAVSEDILSGILFEPFVHSFLSHLFIILTSAFIICYYWSRMFYYKKWYGIFCTFQLLIFIGVLLYATFTPAELPELMPIANIASVISTLVTSLACIGEAYKNNRFYVACTPWIVLVAIIHCLIYIQTALGIYQTTINWSTILYIIILIVIISYNLIDHILNTDKDRRQVDFLKIKNDLLEQHYEQLRQHIQEVNTLRLEFVQEMENLQDLMHTDQTKAKNYVEKILEEAKNFEMLCSFCNHQVTNLILARYQKLAAKRNIQITFQADLPEELPINDDDLAQLLIHALEHSFRETHAIENPLYRKIYLSIHEQEEHFVICCEHSAHYDTNLFSRGITEELDDQERFDLMMMKDVADRYTGTLTQEKDTFIDRITVQLSRNYPNPV

SEQ ID NO: 3955 - protein, 493 aa, Enterococcus faecium
  misc_feature (B) LOCATION 1...493
  hypothetical: YES
DMKLDYLIEEEDREKLLLARYLEFEKKNYVVLPKLYETLGLSKFKTRNYIIELNKEFTEFKTKPEIQISEEAEIHVERLNLTDIKNLRRIYFQRSKIARLLTEIVDSKVTIEKFAENHFLSISRAYVKRRELVSFLEQHQIKLKKNILVGEEINIRNVLFGVYFGVFNGFSMPFRESVMNEAKSIVQYFEYLFNLKLSATKRIKFNLLTTISLLRAYGNQPIGKRFFSDEYFKSSEGMKIIKDLSHISFLHIPKEQIIDEISYIMLFLITEEEFELDGAFGLAEAHFHDIHMISQKMSVELIDQLPFSIEISEEERLYIRKELRMGMMHVNRKNWIFDFEMTSFTSKKQLQFFFETYPIFSTAIQKVIQENKRYFLGKDERFMIRLFYDYLFLLVGICPVSYFEAPIHVCIDFSQGSAYTDYIISQVKGFKNYNIVIESRITSRTNIYLSDCLLEKFNKEQIIWKNPPTPDDWEYFGNTIIREKNRHLTEKIS

SEQ ID NO: 3956 - protein, 182 aa, Enterococcus faecium
  misc_feature (B) LOCATION 1...182
  hypothetical: YES
KMKLSEKELKDQLTEIVNDILAEAHLKKGDLFVLGCSTSEVVGGHIGKNSSAEVGQWIIRTLKELLDPKEIALAVQGCEHLNRALVVERTVAEAKNFEIVSVVPALHAGGACSVAAFDQFNDPVEVEHVVGQAGIDIGDTSIGMHIKHVQVPVRPRLKTLGQAHVTALRSRPKYIGGPRANY

SEQ ID NO: 3957 - protein, 218 aa, Enterococcus faecium
  misc_feature (B) LOCATION 1...218
  hypothetical: YES
RSKFGQRVQFGGRSYGGSYFGSRSYGRDSYGYYGPGTGPSSYEQTGFLALAVLSVGGVSAFSIVKNKRQKKRLKAEILSRMSGTAKEKKAQFLEIQKIFMKIQSAWEEETPEKARSCYTDKLFAEHQKVLQKNKADGVRNHTKKITIQEVGNYRQIHENSFAIRIDFRCCDYSVDRKDGRLISGSKTQRQYFSQIWYFDFSEKEKRWQADFIQPIMLD

SEQ ID NO: 3958 - protein, 110 aa, Enterococcus faecium
  misc_feature (B) LOCATION 1...110
  hypothetical: YES
SKKFHKAADHFFLGNILSIALRIGIAIKDGHKLLIASIPLLTLAIGLIPASKGANKYISAAEAIPMTNMILIVLLKISRQAALSPSFVATATFFAIAFGNPTVPSIRNNP

SEQ ID NO: 3959 - protein, 1221 aa, Enterococcus faecium
  misc_feature (B) LOCATION 1...1221
  hypothetical: YES
FFITFLSKGSVIMKKLKLISIALFSLITMSTARQSIVSAEGTSTKAVVEESGDKKVAIDDKVKNEAEKATVVQGADGLMYVVVDENDPEKLLEAESPLKNQQENTGAVEVGVDEKRQEKADKANEKVKNFDDIDYNDISSLQSALNDPKFPFLSEDELNEKLQKTKNTFESEALMKKTRGYFSQRILELSNNLNDVPKRAKVSRHALVSNRASQVSETRINPPNGYPWVIYLIRSNGYSYTENYAIRRTIDGKEAFCLQAGVQATNTYTGSTSGYLSNSQREMISSILSAYKELGGWANNDAGKQRWIATQMLVWENSNEKPKSITVTPNWKNGATKWKNDLVARANAIRVRTKWDSTSKTVDEGDKATFKVTNTYGDHNLHVKSVSGGGKATISNGTLTVDTTGATGNKITVDMIKGSHPSDAHPTTVWSNGSYQKLVTGSFYISTSVTVNVKRKGTVEVLKVDSETKKPLSGATFRFSYSGKTKDVTTDSNGKAKLTERLKAGTVVKVKEIKAPNGYQLDSSEFSITVKENQNVTTTRTNKKSTGSVEIEKIGDLDGLGLPNVVFTIYNSDNKVVKDNLKTDSNGKIKVDELQFGKYYAVEKQGVTGYDPDGKKYNFEISQDTPFTKPAKVKVTNIYEVSISEKVSDMNESQVLKNNWSADPNDYLQYDITTGNLKKSGERNVQSFIIEGFYDNKNVDVSKSEVYVGSTNVTNSFDINNDTNNGKVIAKAKTSVLTNNDFYNKSYNLRITMKIKKSTLENTEKQKNLTIVKNSKVTVGSKISKSASSNDVETVLYSRKVTINHIDEKDKHLLKQDIDYKYDGETYEYKPRTDLFDKDGNNYKSDVIHKGKIDGKDIVLNTPYHIPVLSVNVDRIQIDTARAVKNGYLPTKIELSKKEEYEKELEKIVFKVKITDIDNNKVVYDENFKYKEFNSHMSLDLPTEYLTKNKKINYSVDILLVDNPDKNKFETETKDLRTIGYTSSEKVLTNKDMTNNQVNYSAVVRTVKERENNNPVKEFNESINYKFTDSTKTKTGYGISVDLEPTYRNEIGKQIDMKVYSYPMNELIDSKIDEIYQSGGKETEVKMDRLKNDGKVESGISTQNLSFQFPHMNIERKTGNIYADSQRNDESIKYELIDGGRKLYVPIWCDLGNYSIAIKSSNFGGNYISLDMNQNIDVYAYMYATIDSETKKDDELLLEPVYPESTLPDGWSKNEIDWLNK

SEQ ID NO: 3960 - protein, 178 aa, Enterococcus faecium
  misc_feature (B) LOCATION 1...178
  hypothetical: YES
RKKLKTMPDYKKITFISSITLIIFLILILLVVLVPRIFGLTPYIIEDKEMSPYYAQGNLIYVRPKNTNEILVGDIITYYENSGKKISTRRVIAVENNHEDFYTKADTKTYIEPGVVKKRNIIGSPIFQIPYIGLVLSKTAFAWIQGLFFTIAFCLTGITAWNTFVELKKKRRRTQKFL

SEQ ID NO: 3961 - protein, 521 aa, Enterococcus faecium
  misc_feature (B) LOCATION 1...521
  hypothetical: YES
AIITEDNDEMKTIGIYLISLALLGLAAGVTNTIFSAKVAQGVSADIREEAFRKIQTFSFGNIEQFSAGNLVVRLTNDITQIQNLVMISLQSLFRIPFLFIGAFILAMITMPQLWWIIVALIVTVFLITALSFTRMGKHFMIIQKLIDRVNSIAKENLLGIRVVKSFVQEENQLKSFSKVSEDLTKHNIIVGTLFSVMIPSFMLAANLAVVGAIFFVSDLVKDDPTLIGGIASFMNYLMQIMMAIIIGGMMMMMTSRAAVSLKRIAEILDAEPDLTYLDVPEQELTGSVTFDHVSFRYPGEDTDTLKDISFSIKPGEMVGIVGATGAGKSTLAQLIPRLFDPTEGKVEVGGVDLRQVNEKSLRQTVSFVLQKAILFSGTIAQNLRQGKKNATEKEMEHASSIAQAKEFIEKLSDRYEAPIEERSSNFSGGQKQRLSITRGVIGNPKILILDDSTSALDARSEKLVREALDRDLKGTTTIVIAQKIASVVKADRILVLDEGRLVGEGTHEELVAGKPCLSGNL

SEQ ID NO: 3962 - protein, 448 aa, Enterococcus faecium
  misc_feature (B) LOCATION 1...448
  hypothetical: YES
AFITLNEEKALEQAKALDEKGIDESNVLAGIPIGIKDNIVTKDILTTAASKILYNFEPIYDATVMDKIYQADMIPVGKLNMDEFAMGGSTETSYFKKTKNAWDPTKVPGGSSGGSAAAVAAGQIPVSLGSDTGGSIRQPAAFNGIVGMKPTYGRVSRFGLIAFASSLDQIGPMTRTVKDNALALTAISGYDEKDGTSSGVSVPDFAEGLTGDIKGMKIALPKEYLGEGVAPGVKEAVLKAAETFRSLGAVVEEVSLPHSKYGVAVYYIIASSEASSNLQRFDGIRYGYRSENVKSLDDVYVNSRSEGFGEEVKRRIMLGTFSLSAGYYDAYFKKAGQVRTLIKRDFEKVFADYDLIIGPSSPTVAFGIGENINDPITMYMSDILTIPVNLAGLPGMSVPAGLSEGLPVGLQIIGNYFDEKTMYQAAYAFEQATEFHKQQPAILGGKDE

SEQ ID NO: 3963 - protein, 64 aa, Enterococcus faecium
  misc_feature (B) LOCATION 1...64
  hypothetical: YES
GFITLPGTVGRLRIQRERPALPMLINSCCSLPTEPIVARHAAKIIRTSPEFKRINTYLPSLPST

SEQ ID NO: 3964 - protein, 243 aa, Enterococcus faecium
  misc_feature (B) LOCATION 1...243
  hypothetical: YES
IDITSEEIYQRLPEEIPGTSLPDGESITEIFEQIKKDGYEKVLAVTISSGLSGTYNVVRLIAQQQEELEAYVLDTKNIGIGAGFSAIQAAKWLEEGVEWDQLISNLNELVERTKVFFNVATLEYLQKGGRIGLVASIVGTALKLNPIISCNEEGIYYTVGKARGRKKSLDKTVAYVKEKIGNAKVFNLAVAHGDAKEEAIEMEARLKREFPQANQIYFGQISPALVVHTGPGLLGVGVQVLEG

SEQ ID NO: 3965 - protein, 107 aa, Enterococcus faecium
  misc_feature (B) LOCATION 1...107
  hypothetical: YES
PVITTRFICLLSFSYPCMTNPPSTLMTCPVIYGFCAKKTAVCAISSTCPKRCIGICFSACSLTLSAKTSVISVVMNPGAMALHVMPLVAASRATDFVNPTTPALLAA

SEQ ID NO: 3966 - protein, 271 aa, Enterococcus faecium
  misc_feature (B) LOCATION 1...271
  hypothetical: YES
GGKFPMILHKYNGCGNDFILLDYAEDTDYSQLAASLCTKEKYDIDGLIAVKIDPLEMIYYNKDGSRAPMCGNGIRCFARYVNDQNMMNEQEFNVETLAGTRKITVLDPSPFYCSVDMGVPDDSPEKIKANQTYPIKNQEIEINGEKVTITSLFLGTIHTVVFVENAREEVWRKRGELICHHPLFKEKTNVNFVEVVNEQELIVRTYERGVGWTLACGTGCCASYVVAKETGKISADQVVVHLEQGDLMISGEDAIQMAGPAVHEWTRILEE

SEQ ID NO: 3967 - protein, 285 aa, Enterococcus faecium
  misc_feature (B) LOCATION 1...285
  hypothetical: YES
YLITGIFCGMIENICSRRMFMLTVTRISKGKGPFYRVDLSEGEALQVSEDVLVRYRLLKGRELDEETIQEIKKSSGADFGFHLAMNYLSYQLRSEKEIRTYLKEKEILQEDRNKIVARLKELDLVDDLVYGESYVRTNMRLSDKGPKKLAQQMQQKGLKPEIIEQALSQYTFEDQVQNAHQTAEKAFGKNHGKSQKELLRKIQQTLMTKGFSQEVIQQAIADLPQEADQEIEYDYLVKQGDKLWRRNLRFEPKKRNLKVKQSLYQKGFDLDMIQRFITEKEEESE

SEQ ID NO: 3968 - protein, 458 aa, Enterococcus faecium
  misc_feature (B) LOCATION 1...458
  hypothetical: YES
MEITKKTSKNNRKEVLSLKMVNVVGAGLAGSEAAWQIAQAGVPVRLYEMRPVKSTEAHHTSNFAELVCSNSLRGNSLANAVGLLKEEMRRLNSVVITSADETAVPAGGALAVDRDSFSETITRKVKEHPLVTVINEEITEIPEGITVVATGPLTSHPLAESIKAFNGSDGFYFYDAAAPIVDKATIDMDKVYLKSRYDKGEAAYLNCPMTEEEFKAFHEALINAEVAELKSFEKEKYFEGCMPIEVMAQRGFKTMLFGPMKPVGLEDPKTGKRPYAVIQLRQDNAAASLYNIVGFQTHLKWGEQKRVFRMIPGLENAEFVRYGVMHRNSFMNSPELLKPTYQSTKREDLFFAGQMTGVEGYVESAASGLLAGINAARLAKEMEPVEFPQETAIGSMAYYITHAEGKHFQPMNANYGLFPELPERIRDKKARYEAIAQRALKANEAIKTELEKTAIPNE

SEQ ID NO: 3969 - protein, 115 aa, Enterococcus faecium
  misc_feature (B) LOCATION 1...115
  hypothetical: YES
NNVTTILRNVRELSISIGRYPLNIARCSLLRLRERRDILYFSIVARRDSSRENLFFYFALFCXXVFEHNILFPLLKTTKGVPLFVAQIFIYNTTPLSYEVVRTRNIFAAGSLGRX

SEQ ID NO: 3970 - protein, 729 aa, Enterococcus faecium
  misc_feature (B) LOCATION 1...729
  hypothetical: YES
TDVTKVRGRTNLDTKGGKRMNIALVGNPNSGKTSLFNLLTGSNQYVGNWPGVTVEKKEGSLKKNPNIHIQDLPGIYSLSPYTPEEVIARDYLVQEQPELIINIIDATNLERNLYLTTQLLDLDIPMIIGLNMMDVIKKEGKKINLEKLSYGLGVPVLPISVLKKQGIEKLIEKIQESAKKRPSIPVPCTYDPRLEAALHEIEDVLGEQSGKKRWYAMKYFERDQKVREDYEIAVSQQKEIEQLIQLTEKLLDDDSETILVNERYEFITQLCTLCVVSNDSFQLSMSDKIDQIATNRWLALPIFAFVMWLIYYLAIQTVGTMGTDWINDTLFGTWLPEHVGRLLAEWQVAGWMQELILNGIIAGVGAVLGFLPQLIILFLCLSFLEDCGYMARIAFVMDRLFRKFGLSGKSFIPMLIATGCGVPGVMASRTIENEQDRRLTIMVTTFMPCSAKLPIIALVAGAFFPHQSWVAPSAYFLGMTAIIFSGISLKKTRLFAGDTAPFIMELPAYHFPQWSAVLRQTYDRSKSFVKKAGTIIFVSSIVIWFSSSYNFYAQPVSEDQSILAFFGRILAVVFQPLGWGNWQGTVAAITGLVAKENIIGTFGILFGHAEVSENGREIWQVLQHTYTPAAAYSLLAFNLLCAPCFAAIGAIHREMNAKKWTWIAIGYQCGLAYLVSFVIYQLGHLLEGGQVALGTYLAILLMIGLVYVLFRQPKSKNQFYTILSLEGEE

SEQ ID NO: 3971 - protein, 247 aa, Enterococcus faecium
  misc_feature (B) LOCATION 1...247
  hypothetical: YES
KRVTFLYEAVFLYNITGGDIVDTLEQIKGGVVVSCQALENEPLHSSFIMGRMALAAKEGGAVGIRSNTTEDINEIKRIVDLPVIGIIKRDYDGSEVFITATEKEVEELLETQAEIIALDATSRKRPTEKTTAELVQMIHEHGRLAMADISTFEEALQAQEDGFDLLSTTLAGYTEYSRKTQTPDFDLLNQIIEQVDIPVIMEGHTDSPEQVEKAYELGAFSVVVGSIITRPQLITKRYVEAASKANN

SEQ ID NO: 3972 - protein, 215 aa, Enterococcus faecium
  misc_feature (B) LOCATION 1...215
  hypothetical: YES
LYSTEGTSFFVWIFSFTQNILYSLLFVVPWHCLDLKESPLVTMLQVIHCQGGAAIVNLMILVASLSSANSAVYSTSRILYQTAKEKSLPHWFCALSKKGVPLHGILITGMLFFAGLCLHFFVADSRLFFQLLAGMTTSCFLFVWSSILCAHVQFIKEKKRNTTQRYKDLALLVFFTSIAFSLLFESTTRFIPFLLVIWFVFLNFVYKRISNRNIS

SEQ ID NO: 3973 - protein, 60 aa, Enterococcus faecium
  misc_feature (B) LOCATION 1...60
  hypothetical: YES
LYSTEGTSFFVWIFSFTQNILYSLNILRSSGFCPFLTANAYFPPDSFLIGVSNSCPCLIA

SEQ ID NO: 3974 - protein, 101 aa, Enterococcus faecium
  misc_feature (B) LOCATION 1...101
  hypothetical: YES
LYSTEGTSFFVWIFSFTQNILYSLLFVVPWHCLDLKESPLVTMLQVIHCQGGAAIVNLMILVASLSSANSAVYSTSRILYQTAKEKSLPHWFCALSKKGVP

SEQ ID NO: 3975 - protein, 60 aa, Enterococcus faecium
  misc_feature (B) LOCATION 1...60
  hypothetical: YES
VHEFGDPWLPKRSIILFREFAIGMGPKIYGHQAKDGTTYTLRLLPIGGYVRMARNGDDET

SEQ ID NO: 3976 - protein, 81 aa, Enterococcus faecium
  misc_feature (B) LOCATION 1...81
  hypothetical: YES
PWTTIFVITLAIVKFKKSYMIVALTFLMRRFIVGCKNMANYSIKFGKRKIKNPFIHGKWMKRTSKLKENGIICIEPSMQMV

SEQ ID NO: 3977 - protein, 158 aa, Enterococcus faecium
  misc_feature (B) LOCATION 1...158
  hypothetical: YES
ERTTKRRRFYMSWTDENEPITNSEPTSYEELELAFAKLQKKYEENNELLRLNNRKLDRLEETMNNTLKEEQTTNKNYRSKTLKDIENEIKKQRAFLVPYTQERIQTTIDLQVKKLHQELLDQRNKEQKKVLIQRSLDFLAPLCCLVLTLFAFWLVWGG

SEQ ID NO: 3978 - protein, 136 aa, Enterococcus faecium
  misc_feature (B) LOCATION 1...136
  hypothetical: YES
PPATFNFADKTLWEKISKTTGHPIMPDYKQKAGYSFCSDKFQLGKFTKLAGEEVSTVRIKECPLQIETLVQRISTRQDFAIVEREIVAIFVEEGILHDPTHINVDKWQPLIYKFREYTTANQSLTLNFRFQEFKES

SEQ ID NO: 3979 - protein, 171 aa, Enterococcus faecium
  misc_feature (B) LOCATION 1...171
  hypothetical: YES
CKATRKCCEGKKNNPKAMKDYRKLKKYWRTILKKETKINYTSLRQFPLFQRKYVTESDVLDYLLSIDKHLRESYEVYQELLAALETKDFTAFFELIDTLPVSLDKGFKKAILSLNKYKKGIINALKYPYSNGKLEGKNNLIKVIKRIAFGFRTFRHLRMRVLIQQNLCEII

SEQ ID NO: 3980 - protein, 109 aa, Enterococcus faecium
  misc_feature (B) LOCATION 1...109
  hypothetical: YES
GRATRTYSFAWDFCIDTLDRIDSGDVCCSRYSYFSSWSHCGLSFGPLTGAIINILGNALGNITAIFLMHRLKFFGNAGPNDSLGASIPTNETSKXRCNVRXYDTVYPFF

SEQ ID NO: 3981 - protein, 546 aa, Enterococcus faecium
  misc_feature (B) LOCATION 1...546
  hypothetical: YES
ILATILTRMIDVRIRNDDFDYVKQQGIFMIVITVIGIILNILLGYFGSRITTNIVADIRDDLFEKIQSYSHQEYENLGVSSLITRTTNDAYQIMLFLQNILRIGFMAPMMFIVSLYMVMRTSVTLSLYVVGALPLLLLAVVAIAKVSEPLSKKQQKNLDKINSILRENLSGLRVIRAFVNEKFEEKRFAVVNENYASSSKSLFRLMAVAQPGFYFLFNIVMVLIIWSGAVQIDAGELRVGDLIAFIEYIFHALFSFMLFASVFMMYPRAAVSAGRIQEALDAKPSIVEDPNGISDTKTKGYIEFQNVTFAYPGHSQEPVIRNVSFTASPGETVAFIGSTGSGKSTLIQLIPRFYDVSEGKILIDGVDVRDYRLSKLRDKIGFIPQKALLFTGTIADNLRYGKEDATQEEMERAAEIAQASEFISRKPDGFNEHLSEGGSNFSGGQKQRLAIARAIIRRPEIYIFDDSFSALDYQTDAKLRARLKKETTESTVLIVAQRVGTIMHADKIIVLNEGEVVGMGTHRELLEKCPIYYDIAASQLSKEELA

SEQ ID NO: 3982 - protein, 81 aa, Enterococcus faecium
  misc_feature (B) LOCATION 1...81
  hypothetical: YES
PWATIFVITLAIVKFKKSYMIVALTFLIRRFIVGCKNMANYSIKFGKRKIKNPFIHGKWMKRTSKLKENGIICIEPSMQMV

SEQ ID NO: 3983 - protein, 81 aa, Enterococcus faecium
  misc_feature (B) LOCATION 1...81
  hypothetical: YES
PWATIFVITLAIVKFEKSYMIVALTFLIRRFIVGCKNMANYSIKFGKRKIKNPFIHGKWMKRTSKLKENGIICIEPSMQMV

SEQ ID NO: 3984 - protein, 81 aa, Enterococcus faecium; identical to SEQ ID NO: 3982
  misc_feature (B) LOCATION 1...81
  hypothetical: YES

SEQ ID NO: 3985 - protein, 81 aa, Enterococcus faecium; identical to SEQ ID NO: 3982
  misc_feature (B) LOCATION 1...81
  hypothetical: YES

SEQ ID NO: 3986 - protein, 81 aa, Enterococcus faecium
  misc_feature (B) LOCATION 1...81
  hypothetical: YES
PWATIFVITLAIVKFKKSYMIVALTFLMRRFIVGCKNMANYSIKFGKRKIKNPFIHGKWMKRTSKLKENGIICIEPSMQMV

SEQ ID NO: 3987 - protein, 81 aa, Enterococcus faecium; identical to SEQ ID NO: 3982
  misc_feature (B) LOCATION 1...81
  hypothetical: YES

SEQ ID NO: 3988 - protein, 81 aa, Enterococcus faecium; identical to SEQ ID NO: 3982
  misc_feature (B) LOCATION 1...81
  hypothetical: YES

SEQ ID NO: 3989 - protein, 81 aa, Enterococcus faecium; identical to SEQ ID NO: 3982
  misc_feature (B) LOCATION 1...81
  hypothetical: YES

SEQ ID NO: 3990 - protein, 81 aa, Enterococcus faecium; identical to SEQ ID NO: 3982
  misc_feature (B) LOCATION 1...81
  hypothetical: YES

SEQ ID NO: 3991 - protein, 66 aa, Enterococcus faecium
  misc_feature (B) LOCATION 1...66
  hypothetical: YES
FIYTKSHFFKHLFFDTFLFLLNIDTNILNLRVHTKWIHLLFVSYEDNQNLQLPYLFRFENYRSNLT

SEQ ID NO: 3992 - protein, 317 aa, Enterococcus faecium
  misc_feature (B) LOCATION 1...317
  hypothetical: YES
MTYTHLTPNELVMIEAYFHQETPVAIVAKQLKRGRQTIYNVYNFLKCGGTALEYFEQYKENKRRCGRTEIIFPAEEKEYIEKRSTEGWTPDVIIGRAERTFSCSVSTLYRRFKTGEFNVLHLPMQGKRKPNGYKEKRGKQAFKRNISERKKNYVVFEEEFGHLEGDTIVGIHHKSAVITLVERLSKAIIALKPEGRKAVDIENSINEWLQSVPKNLFKSITFDCGKEFSNWKSISNTNDIDIYFADPGTPSQRGLNEHSNGLLRKDGLPKEMEFNQVNQGFISSVASKRNHIPRKSLNYQTPLEVFLSYVNGKFCLA

SEQ ID NO: 3993 - protein, 317 aa, Enterococcus faecium
  misc_feature (B) LOCATION 1...317
  hypothetical: YES
MTYTHLTPNELVMIEAYFHQETPVAIVAKQLKRGRQTIYNVYNFLKCGGTALEYFEQYKENKRRCGRTEIIFPAEEKEYIEKRSTEGWTPDVIIGRAERTFSCSVSTLYRRFKTGEFNVLHLPMQGKRKPNGYKEKRGKQAFKRNISERKKNYVVFEEEFGHLEGDTIVGIHHKSAVITLVERLSKAIIALKPEGRKAVDIENSINEWLQSVPKNLFKSITFDCGKEFFNWKSISNTNDIDIYFADPGTPSQRGLNEHSNGLLRKDGLPKEMEFNQVNQGFISSVASKRNHIPRKSLNYQTPLEVFLSYVNGKFCLA

SEQ ID NO: 3994 - protein, 317 aa, Enterococcus faecium
  misc_feature (B) LOCATION 1...317
  hypothetical: YES
MTYTHLTPNELVMIEAYFHQETPVAIVAKQLKRGRQTIYNVYNFLKCGGTALEYFEQYKENKRRCGRTEIIFPAEEKEYIEKRSTEGWTPDVIIGRAERTFSCSVSTLYRRFKTGEFNVLHLPMQGKRKPNGYKEKRGKQAFKRNISERKKDYVVFEEEFGHLEGDTIVGIHHKSAVITLVERLSKAIIALKPEGRKAVDIENSINEWLQSVPKNLFKSITFDCGKEFSNWKSISNTNDIDIYFADPGTPSQRGLNEHSNGLLRKDGLPKEMEFNQVNQGFISSVASKRNHIPRKSLNYQTPLEVFLSYVNGKFCLA

SEQ ID NO: 3995 - protein, 255 aa, Enterococcus faecium
  misc_feature (B) LOCATION 1...255
  hypothetical: YES
MTYTHLTPNELVMIEAYFHQETPVAIVAKQLKRGRQTIYNVYNFLKCGGTALEYFEQYKENKRRCGRTEIIFPAEEKEYIEKRSTEGWTPDVIIGRAERTFSCSVSTLYRRFKTGEFNVLHLPMQGKRKPNGYKEKRGKQAFKRNISERKKDYVVFEEEFGHLEGDTIVGIHHKSAVITLVERLSKAIIALKPEGRKAVDIENSINEWLQSVPKNLFKSITFDCGKEFSNWKSISNTNDIDIYFADPGTPKVRLS

SEQ ID NO: 3996 - protein, 317 aa, Enterococcus faecium; identical to SEQ ID NO: 3994
  misc_feature (B) LOCATION 1...317
  hypothetical: YES

SEQ ID NO: 3997 - protein, 317 aa, Enterococcus faecium; identical to SEQ ID NO: 3994
  misc_feature (B) LOCATION 1...317
  hypothetical: YES

SEQ ID NO: 3998 - protein, 317 aa, Enterococcus faecium; identical to SEQ ID NO: 3994
  misc_feature (B) LOCATION 1...317
  hypothetical: YES

SEQ ID NO: 3999 - protein, 317 aa, Enterococcus faecium; identical to SEQ ID NO: 3992
  misc_feature (B) LOCATION 1...317
  hypothetical: YES

SEQ ID NO: 4000 - protein, 133 aa, Enterococcus faecium
  misc_feature (B) LOCATION 1...133
  hypothetical: YES
MTYTHLTPNELVMIEAYFHQETPVAIVAKQLKRGRQTIYNVYNFLKCGGTALEYFEQYKENKRRCGRTEIIFPAEEKEYIAKRSTEGWTPDVIIGRAERTFSCSVSTLYRRFKTGEFNVLHLPMQGKRKPNGY

SEQ ID NO: 4001 - protein, 417 aa, Enterococcus faecium
  misc_feature (B) LOCATION 1...417
  hypothetical: YES
ENYTKFQRRKRMGMKGKLKREINLFGALATVMGTVIGAGVFFKTAAVTASTQSTSLTLLAWLLGGFLTICAGLTVAELATAIPETGGAVKYIEAAYGKLPSFLLGWAQSLIYFPANIAALSIIFATQLTNLLQLSTDYLLLIAVITAVSVTGLNLLGTKVGASVQSVTLIVKLIPIAVIVIWGLLTPGQGTVQLFPIEAGKDVTFVEGLSSALLATLFAYDGWLGVGAMAREMKRPEKDLPKAIILGLSFVTVVYLLINFVFLKTLPIDHLAGNLNAASEASDVIFGGIGGKLVTIGILISVYGALNGYTLTGIRVPYAMALEDDLPFSKQLTNLSKKFTVPYVPAVFQLAVACIMMSLGSFDFLTHMLIFVMWLFTLLICIGVSILTKKAPELPRPYQVPLYPIAPIIAILGAIFI

SEQ ID NO: 4002 - protein, 258 aa, Enterococcus faecium
  misc_feature (B) LOCATION 1...258
  hypothetical: YES
GNYTKERNEKMNTPQIFNFEQNEVRTFLENDIPYFVANDVAKTLGYKNPSDATNKHCKKAVKTWGSDSLGRRQSFKVIPESDVYRLIIKSNLPSAEKFEAWVMEEVLPTIRKTGSYSNVPQSFAQALRLAADLEEKNQLLEQQIAEYEPKISYLDTILSSTDTVATSQIAADYGMSAIALNKLLNELGVQHKVSGQWILYRKHMNQGYTKSHTSEIPKADGGTKVVMNTKWTQKGRVFIYNLLIAEGYYPQMDLEEIG

SEQ ID NO: 4003 - protein, 66 aa, Enterococcus faecium
  misc_feature (B) LOCATION 1...66
  hypothetical: YES
NKYTKVKTMLTNEQRAHDLAIATLPFVRDIVKSQIIEGKDAKFDAYFEYIKLYNQFLSAVSEDFKN

SEQ ID NO: 4004 - protein, 356 aa, Enterococcus faecium
  misc_feature (B) LOCATION 1...356
  hypothetical: YES
EMYTIMEIINYLFGGISMKQKIAVLGPGSWGTALAQTLAENGHDVRIWGNVPEQIDEINKYHTNQHFLPDLTIPESIIGYKELAEAVDNADAILFVVPTKAIRSVAQELIGKMNTKPIIIHASKGLEQDTHKRISEVLAEEIPEEKRQAIVVLSGPSHAEEVAVHDITTITAASIDQKAAAYVQKLFMNDYFRIYTNNDVIGVETGAALKNIIAIGAGAIHGLGFGDDAKAAIMTRGLAEISRLGVAMGANPLTFIGLSGVGDLIVTCTSVHSRNWRAGNLLGQGHKLEEVLENMGMVVEGVATTKAAVELAQQLGVEMPITQTIYNVLYNGEDIKKAAKEIMLRDGKMENEFSLR

SEQ ID NO: 4005 - protein, 290 aa, Enterococcus faecium
  misc_feature (B) LOCATION 1...290
  hypothetical: YES
KMYTTLKEVTKTAEELNFTVGAFNTHNLEMLPAMLGAAKEMGSPIIIQTSVDTAKYIGMHVLVNVMTAIAEEEMVDAVLHLDHARDFDDIKEAIDSGYTSVMYDGSHLPFKENILKTKAVVEYAHAHGVSVEGELGTIGGTEEGIHVAENDKVYTRPEDAVKFVEATGVDALAIAIGTNHGQFKSKTEVNIPLLKEIDAVVDVPLVIHGGTGVKEEDYPELINNGIRKFNVGTELLVNWTKVAKETFSETEINKSLRHNVIPANEAVKEIVKHKIGLFMNLESPINLGNK

SEQ ID NO: 4006 - protein, 420 aa, Enterococcus faecium
  misc_feature (B) LOCATION 1...420
  hypothetical: YES
PLHTIFLISAYKNERNMLMNKKMMKFSLLSVSLILTSAGAVTSAIPSMSATYATRSLSAVELLTTAPSFMVTIFVLISSFIARKIGQKQTVIIGLVIASICGILPLFSQSYSIVLASRAGLGIGFGLINSLAVSMIAAFYHGDERASMIGFQSAFQGFGAALMTFVAGQLVQFGWQYTFLVYAISLPILVLFVLFVPTPETTELQSHGTAPTRQVIKTNPKMISYGIFLLLVIVVYNAVSIKLATVLTTYSLGNETNAANILTIMQLASMAAGVCFGWLQTKAHRYMLTLSLLLMGIGFVLIATVINLYVIGFGAILTGISFSLFIPYLFNQVSIQAPKYAESFNTSILLVGANLGTFIAPYGLLFLSFASLGSKTLAVFVNGSILLLISALISLLVVHRTNRKTVIRVDEEIKEQLTTK

SEQ ID NO: 4007 - protein, 188 aa, Enterococcus faecium
  misc_feature (B) LOCATION 1...188
  hypothetical: YES
EVEFLKEIIHNSWQEVLSSEFSKDYYLHLREFLKKEYASQKIHPDMYHIYEALELTPYEEVKVVILGQDPYHGENQAHGLSFSVQPGVKIPPSLRNIYKELYDDLGIAPVQHGNLVSWAKQGVLLLNTVLTVREGQAYSHRGKGWERLTDTIIEKLNEREKPIVFILWGKPAQEKIKMIDKSRHIIIT

SEQ ID NO: 4008 - protein, 304 aa, Enterococcus faecium
  misc_feature (B) LOCATION 1...304
  hypothetical: YES
PPNTMEYLVEFLLQESSQGNQSRRWPEMIRIGLTSFKEHDKLTGKKNNTLYEYAGFLPLVELDTAYYGIPRKSSVENWISEVPESFRFVVKVYQGISGQGDWKPYYQTEEEMIAHFLDVMSPMVDAGKMFCFLVQFPSSFKCTKENVQYLRKLRKWFEGYPVSIELRDYSWYSDEFLERTRNFMSRAAFSLAIIDEPQLLNTTIPFDPFVTNPNFALFRFHGRNAQGWQANDKEWRKKRTLYRYSEKELQELAHEVKVVDSKTKEVGVIFNNNSGGDAAENALALQKILNIKPDGLNPTQMDLF

SEQ ID NO: 4009 - protein, 236 aa, Enterococcus faecium
  misc_feature (B) LOCATION 1...236
  hypothetical: YES
GGNTMIYTVTLNPSIDYIVRVDGLKLGDLNRMKEDFKLPGGKGINVSRILKRIDSQSTALGFLGGFTGEFISKWLEKEQIQSLFTTVKEDTRINIKLKSDTETEINGLGPSISDEEIDELKQALGTVGQGDIVVLSGSAPASLRKGFYQELIDIIREKGADFVIDTTGDDLKNALVKKPLLIKPNNHELAELYNTTFQSVEEIIPYGKKLLAEGAQNVLISMAGDGALLFTGTRNL

SEQ ID NO: 4010 - protein, 484 aa, Enterococcus faecium
  misc_feature (B) LOCATION 1...484
  hypothetical: YES
LLNTNREIYLEVRVMRTRRLGQTLFSQPFLGEISMNLTIQEIAQAVGSECSALTKITNVEFDSRKITEGSLFVPLAGTRDGHEFIQQAITNGASASFWSLPVEQAPKNFPVIPVADPLKAMQQLATYYLEKVGAEVVAITGSNGKTTTKDLTASVLSEKYKTYKTQGNYNNNIGLPYTILHMPQDTEKIVLEMGMDHANEITELSLMAQPKAAAITMIGEAHIENLGSREGIAKAKLEITDGLVSERLLVVPADEPLLTPLTATLVQTVTTFGIGNGDVHAEVTAKGKAQTDFVVEGETFTIPLPGSYNVTNALIAYTIGRFFGLSIPEIRQGLAHVSITQNRTEWLTAGNGAAILSDVYNANPTAMGLVLDTFKNLPTKGRRIAVLADMLELGKESLNMHAQMSEHIDPEKFAMIFLYGEQMHALKEELNQKYPQLPVFYLEKEKNKLIDAIKQNLEATDSIMLKGSNSMGLFEVVEQLQQMK

SEQ ID NO: 4011 - protein, 177 aa, Enterococcus faecium
  misc_feature (B) LOCATION 1...177
  hypothetical: YES
RLNTSEEQMNNNDRLLRLRYAIDLKDTDLIKAFELGGVPLTKEEAQAVLTKVQDKNKDNAENNVYEKTINNQVFDAFLNGLILLARGPQKDKPIVDTPQKSKEIKYINNVLLKKLKIALSMTTDDILDVFAEAEIYPSKGEIGAFLRKEGQRNFKPCGDKYMRNFLKGLGIYNRRKV

SEQ ID NO: 4012 - protein, 171 aa, Enterococcus faecium
  misc_feature (B) LOCATION 1...171
  hypothetical: YES
LVNTNLDAVEKEKWMRLALAEAKKAEMLHEVPIGAVVVLDGKVIGRGYNLRETTQDATTHAEMLAIKEACEKVGSWRLEDAALFVTLEPCPMCSGAMILSRVAEVYFGAYDPKGGTAGTLMNLLEDERFNHQAYVEGGILEDECGMILTDFFRKLRQRKKKLKKDWSTNEK

SEQ ID NO: 4013 - protein, 275 aa, Enterococcus faecium
  misc_feature (B) LOCATION 1...275
  hypothetical: YES
MKNTAVTFKESKLRNEKLTMLTAYDYSTAKIIDEAGINGILVGDSLGMVCLGHEDTLSVTMEDMIHHTRAVTRGAKNTLVVADMPFMSYQTSVYDSVVNAGRLIKEGRAQVVKLEGGIEVCDKIEAIVKASIPVMAHIGLTPQSVNAFGGFKVQGKDKEAAKELIRAAKAVEKAGAFAVVLECVPTKLAELISKEISIPTIGIGAGAGCDGQILVYQDMLGMYSDFTPKFVKKYANLSEEMNKAFTKYIEEVKDGVFPGPEHGFKISDDVLEKLY

SEQ ID NO: 4014 - protein, 183 aa, Enterococcus faecium
  misc_feature (B) LOCATION 1...183
  hypothetical: YES
IRNTIKSRKKKEGTSMSNTADAIVVIDLQKGVCFDSSPIHELETVTALVNKRIKTYETIGKPVIFVQHEDAQLVPQTKPWELLSELSIPEHSYFVRKTHANSFYKTNLSVLLTELDCHSIELCGAQAEYCIDTTVKFAHGLGYQLMMCRGATTTYDNPFMKAKETIAFYEKIWDKRFLTFLEQ

SEQ ID NO: 4015 - protein, 192 aa, Enterococcus faecium
  misc_feature (B) LOCATION 1...192
  hypothetical: YES
MSDTTRTKQLIKNVLIDLCQTQSFRKISVQKIANEAKINRQTFYYHFTDKYDLLRWVYCEDALHYLDPQCLSLDNWEEQALKMLKAIAEKKEFYANTVLSDPEILQKEFSQLIQKSFIKIFEQMDEERQLSARDKLFYARFFSYGCSGVLVNWITNEYEETPMEIAMQLFRLAKDTELYSYRLYAKEELEEQ

SEQ ID NO: 4016 - protein, 93 aa, Enterococcus faecium
  misc_feature (B) LOCATION 1...93
  hypothetical: YES
WFDTVNVAGKTFRYTENGPEGLVTGKKALHIQSNGGVYNGQDFASQYVKGILNFVGIDQVDQLFIEGIDYDPDRADELMQNALDKAAALGKSF

SEQ ID NO: 4017 - protein, 121 aa, Enterococcus faecium
  misc_feature (B) LOCATION 1...121
  hypothetical: YES
KSDTVIVPPFIVAISLLVSPEQAARVKTANALVAAKIIDFFFIKICTPVISYYFYILTIPYPISFKNVVVVVSNKIQNFITFLGNTQTFLTYIVKSVEKIIIIIFVQDTLADQLLVFLLVH

SEQ ID NO: 4018 - protein, 78 aa, Enterococcus faecium
  misc_feature (B) LOCATION 1...78
  hypothetical: YES
YSCTRCFCLSNGGTQEAKECRRSEMSVQAVSLKRSQMLLFLRTSCDGEGNNSTEVPDVTLPRKASSEKTAARTANRHR

SEQ ID NO: 4019 - protein, 453 aa, Enterococcus faecium
  misc_feature (B) LOCATION 1...453
  hypothetical: YES
NRCTYHSCIAANYGIQTVAIYSEADAEALHTQLADEAICIGPAKAVDSYLNVQEVLSAAIVTKAEAIHPGFGFLSENSRFASMCEECNITFIGPKSATIDAMGNKINARQLMQEANVPVIPGSTGVLSTVEEALEIADRIGYPVMLKAAAGGGGKGIRKVQSKEELPQHFSSAQQEAAAAFGNDDMYLEKIIYPARHIEVQILGDRFGHVIHLGERDCSLQRNNQKVLEESPSVVISQTKREALGDAAVRAAKAVNYENAGTIEFLMDEEGDFYFMEMNTRIQVEHPVTEMVTGIDLVKKQVEIAAGEPLNVCQEDIVFQGHAIECRINAENPAFHFAPSPGKIQNLLLPAGGMGLRVNSAVYPGYTIPPYYDSMIAKIIVHGNTRFEALMKMQRALSEFITEGIITNAEFQMDLISHPAVIAGDYSTAFLQERIFTELDTRNGDRRRIDGSV

SEQ ID NO: 4020 - protein, 325 aa, Enterococcus faecium
  misc_feature (B) LOCATION 1...325
  hypothetical: YES
TMCTSITYVTSDHYFGRNFDYEISYNEVVTVTPRNYKLNFRKVNDLDTHYAMIGIAAGIADYPLYYDATNEKGLSMAGLNFSGYADYKEIQEGKDNVSPFEFIPWILGQCSTVGEAKKLLKNINLANINYSDELPLSPLHWLLADKEKSIVIESMKDGLHIYDNPVGVLTNNPSFDYQLFNLNNYRVLSSETPKNNFSNQISLNAYSRGMGGIGLPGDLSSVSRFVKATFTKLNSVSGDSESESISQFFHILGSVEQQKGLCDVGDGKYEYTIYSSCCNVDKGIYYYRTYEDSQITAIDMNKEDLDSHKLISYPIIEKQQIKYIN

SEQ ID NO: 4021 - protein, 957 aa, Enterococcus faecium
  misc_feature (B) LOCATION 1...957
  hypothetical: YES
SLSTIVYRKGAIPLAKRIDRIYMYVKEKTAHLTKAEYDQGVTTQEIAEVLGIQRTNSSKDLNQLVREGKLIKTDGRPVRYIYQTLVTHVKPVTKHVVSYKETPVSEEKNTLQIDTKDIFAKIIGANGSMKNSVEQAKAAILYPPRGLNCLITGPTGSGKTYFAHAMYHFAKAHHVIDEETELIVFNCADYANNPELLMSHLFGYAKGAFTGADEEKMGIIDQADGGMLFLDEIHRLPPEGQEMIFYFMDHGTYSRLGETTKSHEANVRIVGATTEDPGSSLLETFVRRIPINIKLPAFEKRPANEKVDLVKIMIAHEANRTQRKISLTEDVAKALIGSVTYGNIGQLKSNIQLVCARGFLNHMQSPEISITIDDLTEGIRSGLIQLASNRSAMAELSKILEPKITVAPNDTIMKIQSDSYELPYNLYDIIGDKAALLKSDGLDQEAINHFISTDINIHLKSFYKDHGFSFNADSKLAEFVDPKIIEVTNQIYVMVKRSLPYEFQQNFIYAMSLHISSFLKKINLGEERHTNDNIREMAFDFPDEYAVAKEVRSYIETYFQVEIPESEDYYLTVLLVSLRANQASGRIGVVVAAHGNSTASSMVQVVQQLLDAENVRAVDMPLDMDPKTALDRIERNVQEVDEGSGVILLVDMGSLASFNSQIQRDTGIPVRTVDMVTTSLVLETVRKVSVLGTDLDMLHESLKNFRGYAEISSVESVQEAKPIHKKKAVLAICASGEGTAQRIKELIERAVNKRQETELEVLALSIVEVKEELPVIQKEYQIIATTGITDLNIQAPFIPLERFIDQNIEVILDQLLMESELEETEFISLDEESAKNTCVEFISDNFIFINGSKLIDPMWQFSTQISQTTGIGDEEYGFKINLVMHTAGMIERIIRNEPLTVEENELTNTTNDPLYSQLAASVVLLEDQIKVKVPIEEMYYLLRLVHNQLDKKEYTVP

SEQ ID NO: 4022 - protein, 466 aa, Enterococcus faecium
  misc_feature (B) LOCATION 1...466
  hypothetical: YES
EGFTMSESLSKDLNLNALFIGDKAENGQIYKALLNELVDEHLGWRQNYMPQDMPIITPEEKSSASFEHTVNKTKDVLSEISARMRTHSVPWHNAGRYWGHMNSETLMPSLLAYNFAMLWNGNNVAYESSPATSQMEEEVGMEFAKLMSYKDGWGHIVADGSLANLEGLWYARNIKSLPLAMKEVTPELVAGKSDWELMNLSTEEIMNLLDSVPEKIDEIKAHSARSGKHLEKLGKWLVPQTKHYSWLKAADIIGIGLDQVIPVPVDHNYRMDINELEKIVRGLAAEKTPILGVVGVVGSTEEGAIDGIDKIVALRRVLEKDGIYFYLHVDAAYGGYGRAIFLDEDNNFIPFEDLKDVHYKYNVFTENKDYILEEVHSAYKAIEEAESVTIDPHKMGYVPYSAGGIVIKDIRMRDVISYFATYVFEKGADIPALLGAYMLGRFKSRGNSSQRLGSTPCLTFECHRIW

SEQ ID NO: 4023 - protein, 80 aa, Enterococcus faecium
  misc_feature (B) LOCATION 1...80
  hypothetical: YES
QQFTSRVQKKRLTEYRKYPYIDIYFHDENSGFGYGHNHNLIASDSRYGIICTPDILVDEETVTSIGLVIERTSGMCDVST

SEQ ID NO: 4024 - protein, 97 aa, Enterococcus faecium
  misc_feature (B) LOCATION 1...97
  hypothetical: YES
MRFTNLFSLVSEFFCLYILLCKKSYQSYASMFLDYFLFFICQDNAIKSQHCEYKNKKKRVIILKTFTRRGRRNSNAFTKCCYSKYNKKRKKGIWDFR

SEQ ID NO: 4025 - protein, 254 aa, Enterococcus faecium
  misc_feature (B) LOCATION 1...254
  hypothetical: YES
EYWLFKEESYIGFISLPFFSLDQKCYNKSLLQRRNCMKYKTSFQVAGSFFLVLFFILGWIVKFHLSWLSGFDQWFTGIVRASYPDLNSYQLFMTKFGNPLTVIILFACAALWMWYKKKRAETFWFVSGFIVIAGIINPVIKLFFMRERPSLAHLVVETSYSFPSGHAAGSMILYGSLLFLLPAFVQKRTLRTLLQLLMMFIIVSVGISRIYLGVHFPTDIIGGYLLSLSWLCLTYPVYREKRKQIDNSYRKKDF

SEQ ID NO: 4026 - protein, 141 aa, Enterococcus faecium
  misc_feature (B) LOCATION 1...141
  hypothetical: YES
KILTLSKLNYEKRVWRASFKDYLTESEIADRLLAACPNLRQGYQLYQDILYAVKKRDQSLFEDCLTRDISGLPETYTTTLRTFKKFLPQIQNALHYSYSNGPLECLNNHIKVLKRNAYGFRNFYNFKLRIMIRHGKTFLTK

SEQ ID NO: 4027 - protein, 67 aa, Enterococcus faecium
  misc_feature (B) LOCATION 1...67
  hypothetical: YES
IHLTFYSEYTREGGNNMKISIEAKPQEIAELLQAIGSSKEHTKRKHPESKIEYDPQTGEGKLIPQNK

SEQ ID NO: 4028 - protein, 471 aa, Enterococcus faecium
  misc_feature (B) LOCATION 1...471
  hypothetical: YES
KSWFIVLFTIFRKKEGLFMEVFQTIINYVLNLGSAIFVPLIILILGLLAGMKLKKAFMSALTLGIAFSGMSMVIGYMSNAVSPASEALAKNTGISLPALDLGWTGAASITWSWSYAFIFFAVTIGVNFVLLLFNWTKTLNVDMWNVWGKALTAYLVYYVSGSLAAGFLTAMVQVILELKLGDMFQKHIQDLTGIPLVTVTHFMTSAAVLLLPFNMIMDKIPALNKRADTNALKKKIGIFSENSVMGFIIGLGLGFAAAYGVSGSLNLAIQTATALSLFPMISKMFMQSLSPLADAMSEFMKKRFKDREVYIGLDWPILAGRSEIWVTAILLVPVFIGYAIILPGNQVLPLAGIINYSIAVGGLLLTGGNLARMLILGIITMPIYLYGATYLAPILSDLAEKSGAVEGIKKGQLITWSSIEGPEFRVLFAEAFNRNILAIVGCVIFLGLFVLLYKYMIKAKVPSERYAELQK

SEQ ID NO: 4029 - protein, 144 aa, Enterococcus faecium
  misc_feature (B) LOCATION 1...144
  hypothetical: YES
NFITSKKIDMSCKGGTLMEVINSIWLFFQDQILGMKWLNGLIGNGLSLLGLDINSRLGGSIQFFLYDVIKITILLCLLIFFISYIQSYFPPERSKKILGRFHGIGANIISALLGTVTPFCSCSSILLFIGFTSAGLPLGVLFPF

SEQ ID NO: 4030 - protein, 421 aa, Enterococcus faecium
  misc_feature (B) LOCATION 1...421
  hypothetical: YES
SAITKKRVAAHQNAGPALSLSFVLAAIVVILSGLSFAEFASRVPVIGGPYAYLYVVFGEFAAWLTGWLLIGEFLLAVSSVASGWSGYMQGFLKSLGAELPQALTGGYNPENGTYIDLIAVLVVIFVTYIVSLEAKKALRLNNAMVYVKFGIIALFIIVGIFFVKPDNWQPFMPFGFSGVLDGAALVFFAFLGFDAVAMAAEEVKNPQKDVPRGIIGSILIATVLYIIVTLILTGIVPYTELGVNDPVAFAMRYVGHGTVGAVIAVGAILTLLTVTISMMYSLARLLFAVSKDGLLPKFMTEIDQKHRTPKKATYAAGVAAVFFAGFFPLNVLAELTNIMALAYLMLVSLGLLKLRKMFGKPKAGEFKVPFVPLLPIVSILTCIVLMLRLQTVTWIVFGIVMVIGLIIYFGYGYGHSKMNEK

SEQ ID NO: 4031 - protein, 154 aa, Enterococcus faecium
  misc_feature (B) LOCATION 1...154
  hypothetical: YES
TGITVLAFGSYFFLLGKAARGWPSRQTFIRNTSSILTMLEMIRTIDDPSVAYAFVDEGCYGEKGLDSVRSGMKKEAILFYLDSVGADTPLQFSGNYFSNKEQWLKQVDKLKEKNVNYIFSARKKQAQFFYLTKTDLRGKTFNWQNANQIIALFR

SEQ ID NO: 4032 - protein, 237 aa, Enterococcus faecium
  misc_feature (B) LOCATION 1...237
  hypothetical: YES
GAITMEIIRVKNAEEGGKKAFEIIKEGMNKGAKVLGLATGSTPVTLYKEMTSSDLDFSEMTSVNLDEYVGLGGSDEQSYRHFMDVQLFDKKPFKETFVPDGKAEDLEAACKKYDQIIDAHPIDIQILGIGQNGHIGFNEPGASFDGTTSVVDLTESTINANKRFFDKAEDVPTKAVSMGIGSIMKSKEIVLMAFGESKADAIKGMIEGPVTNHLPASVLQNHDNVVVIIDEEAASKL

SEQ ID NO: 4033 - protein, 339 aa, Enterococcus faecium
  misc_feature (B) LOCATION 1...339
  hypothetical: YES
GKITKRWLVLLSRKFRRTEERTNEMAKRKVVVALGGNAILSTDASAKAQQEALMETAKYLVKFIEQGDELIISHGNGPQVGNLLIQQQAADSEKTPAMPLDTCVAMTEGSIGYWLQNAMGEVLKEKGIDKDVVSLVTQVIVDENDPSFKNPSKPVGPFYTEEEAKEQMNADSTVTFKEDAGRGWRKVVASPKPISIKEARVIETLVEQGVITVSVGGGGIPVVETATGLEGREAVIDKDFASEKLAEIIDADLLIVLTGVDNVYVNYQKPDQKKLETVTVSEMKQYIDEKQFAPGSMLPKVEAAIAFVEAKPNAKAIITSLENIENLLASEEGTIIVAD

SEQ ID NO: 4034 - protein, 197 aa, Enterococcus faecium
  misc_feature (B) LOCATION 1...197
  hypothetical: YES
KGITMKIIGYARTTINDVDLTTQVDQLSDFGCQEIFHETYEVEQNDSTAVHLESVIADMQQGDALVICQLHRLGKSTRQLTELTQLFKDRGLHLISLDEGIDTREMGKIYFQLMENLANMECALIKERTLVGLDEARKKGKIGGRPKIDAKTIKKIRRLYYEKKETIQFISSKCGVSVGTCYKYINLPEKEIEQLCI

SEQ ID NO: 4035 - protein, 166 aa, Enterococcus faecium
  misc_feature (B) LOCATION 1...166
  hypothetical: YES
KMITQIRVDDRLIHGQVAVVWTKELNAPLLVVANDEAANNEVMQMTLKMAVPNGMKLLIRKVDDAINVFNDPRGKDKRMFVIVNSVSDANKIAQNVEDLETVNVANDGRFDKSDPKSKTMIFPSVQLNPEELAAAKELAQLTRVNSYNQVLPSNPQLSLKDAVAKV

SEQ ID NO: 4036 - protein, 61 aa, Enterococcus faecium
  misc_feature (B) LOCATION 1...61
  hypothetical: YES
VFVTQSHIKSAGNTGSLMDGQMRFFYRILSAIMQKIHKNMRCSLNMTISVQIQITQISQNS

SEQ ID NO: 4037 - protein, 79 aa, Enterococcus faecium
  misc_feature (B) LOCATION 1...79
  hypothetical: YES
QIVTLELHYSTSDILSLSIYHREEKQMFLAIKEIRYSKLQYGLIVGIMFLIAYVVFMLSGLANGLSEEFKKAIDDWDAX

SEQ ID NO: 4038 - protein, 95 aa, Enterococcus faecium
  misc_feature (B) LOCATION 1...95
  hypothetical: YES
RYVTKGVMDSLPVELQALCWNLIDQNVQKQFPLDYLQIFEFSTEKGNQKLVHRQEEPEERKEYLISPKLRLKSVSQKIWAIDSGEYQTMLLPEEY

SEQ ID NO: 4039 - protein, 159 aa, Enterococcus faecium
  misc_feature (B) LOCATION 1...159
  hypothetical: YES
QKWLGLPLNVCWKMINWLLASVKLSDIVGVSPRQLRYWEQKGFIRSIEADANCPRKYRLPTVIKVELIKKYLDDGFTLSKAAKKAEIRQKKMHHVRKVFSKAIKDIELIDERYTILQIGNFKEENAKMYIIHDNETDELTYKLLPVDEKADYEQLLKEL

SEQ ID NO: 4040 - protein, 103 aa, Enterococcus faecium
  misc_feature (B) LOCATION 1...103
  hypothetical: YES
PFSTRITTNQDIRRVGVNCSDLVYATGLQLNLFEDPEKQINEAKVDFVVDTIRKKYGFQSIIHAHSLLQGGRAIARSSLVGGHAGGMSGLEGGKDETDSKKIH

SEQ ID NO: 4041 - protein, 333 aa, Enterococcus faecium
  misc_feature (B) LOCATION 1...333
  hypothetical: YES
MKWFKRIVIAVPVIIVVILVTVFLINQITPKPISLLVRKQFDTSEKEQVYARPDDFQQKIEQIDIKKEISYPSKYKNNNMDIYTPKVEKKKLPILFWMHGGAYVGGDKNDCRDYLEYLCSDTQQIIVNIDYERSPEAKHPTPVIQLNEAIQAAKKEIKDQADWSNISIGGNSAGAQISGEYLLALQNEEIKKADHLDPTLENKQITKFISLSGLLDPSALTQVSDKISSFLYEKCGWAYFDNKDFEQSEKVKSLALVRHADRWTQNTFLTDGNTNTFTKQMEEVTSVFEKAGVKVTKVDYAEKNAVLNHEYQFDFSNKQAQETYQKLVMFFKE

SEQ ID NO: 4042 - protein, 66 aa, Enterococcus faecium
  misc_feature (B) LOCATION 1...66
  hypothetical: YES
ENSTFTMVIFIQCVHDRGVRCRAGRGRKGGGGGGKGGEGAGRGGRGGGSVXERGEEGGGEGGGRGG

SEQ ID NO: 4043 - protein, 145 aa, Enterococcus faecium
  misc_feature (B) LOCATION 1...145
  hypothetical: YES
MEWFCKFLLFLEVIHVYGFVFLTNKKAGSTMDHLYIKYIHQFSVLVLGTLIIAGIVAFIIQGRDILTVHQEFFSYAFGIPLIAIRSDNKKWKKRYYILLLFLCFYLPPKIFTLLGIQCLSFSFISYIIVLIFLSFIVWMFYLVKK

SEQ ID NO: 4044 - protein, 60 aa, Enterococcus faecium
  misc_feature (B) LOCATION 1...60
  hypothetical: YES
FFTTLLLSGNTGGTKKSGLQTAESFPRRKPASFHRKLPRDDLSKKGTQSGKISRDDSCFC

SEQ ID NO: 4045 - protein, 420 aa, Enterococcus faecium
  misc_feature (B) LOCATION 1...420
  hypothetical: YES
IETTFFRCAVRRIAMTEYAIRLKDITKSYNMYAKPSDRFREALNPFKKSYHDVFYALKNVNVEIKKGEMIGFVGENGSGKSTMLKIITGVLTPTSGTMEIEGKISALLELGSGFNPEYSGYENIYLNGMVLGFSREEVDEMVDDIIEFADIGDHIYQPVKTYSSGMFVRLAFAVAINVNPDILIVDEALAVGDLEFQLKCMEKFTEIKNSGKTILFVSHDISSIRRFCDRSYWLKNGKVVEYGDTMEVTTNYENFLKKKSVKTVDRNKNQVERFAAPDIVDVTKAELLDKDKNPVDMLEQGEKLYVKVTYEVKDDTIKNPVLGIALRTVDNFYVCGLNTLLDGIKIPWKKGENIFYLEYEKLGLLAGEYYFDVAVFEENATVPLVYKTKYMNLFVSGSYIGEGIVVLDHKWEEGTHSNEI

SEQ ID NO: 4046 - protein, 426 aa, Enterococcus faecium
  misc_feature (B) LOCATION 1...426
  hypothetical: YES
KNYTEVSKMNIIDELTWRDAINQQTNEERLRELVEEKSISLYCGVDPTGDSMHIGHLIPFMMMKRFQLAGHHPYILIGGGTGTIGDPSGRKTERVLQTMEQVQHNVDALSNQMRKLFGKDANITFVNNYDWLSKISLLEFLRDYGKNFNINTMLAKDIVASRLEVGISFTEFTYQILQSIDFLHLHKTYDVQLQIGGADQWGNITAGLDLIRKLEGPEAEAFGLTIPLMLKADGTKFGKTAGGAVWLDPKKTSPFEFYQFWLNQDDRDVVKYLKFFTFLSQEEIEDLAKKVETEPEKREAQRRLAEEVTRFVHSEEDLKEAQKITQALFSGNIKELNAEEIAQGFGKMPNVEISSTPENIVELLVSTKIEPSKRQAREDVSNGAISINGDRVTDLNFVINPSDEFDGKFVVIRKGKKNYFLAKVID

SEQ ID NO: 4047 - protein, 273 aa, Enterococcus faecium
  misc_feature (B) LOCATION 1...273
  hypothetical: YES
SDRFEKTLMTGLFIIVVFAGLGGLSGNIGMLIGLRAGWGVGNALFVSTALATIVSILVGNTEKAIMMYEAALGCGMAVGPLVGGVLGSGSWRYPFFGVAFLMFCGFIALAVLLPETEKPKRKVGLWEGVKALSNHKLRSVGLIALLYNFGFFTLLAYAPFLLIGYSELEVGFVFFGWGVLLAIASIFVAPALERKFTTYRTILAAFVLFIICLLLFGDGTYIPVLVPFSIVLAGFFPGIINNNVDGRLLWKYQVCNETLLRPAIVLSAFSVEL

SEQ ID NO: 4048 - protein, 137 aa, Enterococcus faecium
  misc_feature (B) LOCATION 1...137
  hypothetical: YES
LSNTFLAKGGVHSMNEETVSPMKKLTKLVTHTSYQLFDSFVNDTEEHAKNVRLQGKFILELQKAATEHSLVILQVRANRLSSKYETISGWVATKTVEKDRVMIRLQNEEQQIRMVPVEQIEKITILSPAGEQERLSK

SEQ ID NO: 4049 - protein, 109 aa, Enterococcus faecium
  misc_feature (B) LOCATION 1...109
  hypothetical: YES
LDNTHNGGIKMRILVSCANGSGTSLMMMRSVEKAMKELNVPITKIHHCAISEGKSSAGQYDVVFTPVNFLNMFTQAEKKGVTVIGIKNVMSVKEISEKFAETKWYQKNK

SEQ ID NO: 4050 - protein, 299 aa, Enterococcus faecium
  misc_feature (B) LOCATION 1...299
  hypothetical: YES
LRNTKLTNWSKRGIKMVLTEQKRKSLEKISDKNGVISALAFDQRGALKRLMAQYQDTEPTVAQMEELKVLVADELTKYASSMLLDPEYGLPATKALDKEAGLLLAYEKTGYDTSSTKRLPDCLDVWSAKRIKEQGADAVKFLLYYDVDSSDELNQQKQAYIERVGSECVAEDIPFFLEILAYDEEISDAGSVEYAKVKPRKVIEAMKVFSDPRFNIDVLKVEVPVNVKYVEGFADGEVVYSKAEAADFFKAQEEATNLPYIYLSAGVSAKLFQETLQFAHDSGAKFNGVLCGRATWAGS

SEQ ID NO: 4051 - protein, 170 aa, Enterococcus faecium
  misc_feature (B) LOCATION 1...170
  hypothetical: YES
IIRLICHERFLLSCLYLSIVKGEKEENNSTCSVKYSTMEWMRFFDNRINYDILITKRKRILSVGGRKVKKMEESFPKAVKVENIANILKVTFENGEVKYVKSHWTEEITDALQFGKKGRGKRKNLLALSRNMWIGTEVTIEADGTVFINGKDRYTPEELWYKGKKSIPEL

SEQ ID NO: 4052 - protein, 182 aa, Enterococcus faecium
  misc_feature (B) LOCATION 1...182
  hypothetical: YES
IQRFYFSNKIFSFLYKYPYTCLYRLCFLIKGDTNMPWNMKDFPASMKNLDKLTRKKAIDIANALLDEGYPDSRAIPIAIDQAKKWDEDASESEKRTFEKEKNPSKTDEHDTNPRAGKLLDSDVIVEYEEKQWIVKSKGAKKASNHFDTKKEAIEKGKQVAQNKQSTLIIYKKDGTKEKEISY

SEQ ID NO: 4053 - protein, 72 aa, Enterococcus faecium
  misc_feature (B) LOCATION 1...72
  hypothetical: YES
TICTFLVKKEVATRLLSQPLINGVLLPTLRSQVKIFIKHEKLFFEIAPCDSELNGRLTTSDINGVQSTDPRY

SEQ ID NO: 4054 - protein, 116 aa, Enterococcus faecium
  misc_feature (B) LOCATION 1...116
  hypothetical: YES
CLRFSISHVLYFAFPGRKNKAVTIYLQLYCLFVLFFFQTKSAPTIVWVARSRGLPRSTGWVSPAASSLWHFQGYLSIAEALACFPAVTPKSTLAYGFAKHEHYRHHSLCEHGLSSA

SEQ ID NO: 4055 - protein, 184 aa, Enterococcus faecium
  misc_feature (B) LOCATION 1...184
  hypothetical: YES
VKRLGDQWMLNILSSGSAALENRSSLNSELRELDYFFEAHPMIKEKIDSFVTIDDLQVGKPDPEGYLLCLKRLRVEQAVVVEDSPVGAQAAPHMTVDVQALDADFFAFSGHKMCGPTGIGVLYGKRQLLEQMEPVEFGGEMIDFVNLYDSSWKELPWKFEAGTPNIAGAIDYLNEIGMREYSSL

SEQ ID NO: 4056 - protein, 171 aa, Enterococcus faecium
  misc_feature (B) LOCATION 1...171
  hypothetical: YES
GGSTMEQMRVYIANLGKYNEGELVGAWFTPPVDFDEVKERIGLNDEYEEYAIHDYELPFEIDEYTSIEEINRLCGLAEELEGTPIGEVASEIQHAFFNSFEEMVEHVDDIIYYPDCDDMSDVAYFLIVEAGDFGEVPEHLKTYIDFDACGRDLEIGGNYLVTSRGVFEYPY

SEQ ID NO: 4057 - protein, 282 aa, Enterococcus faecium
  misc_feature (B) LOCATION 1...282
  hypothetical: YES
YPGTVTATEDSIVVDGEATRVYAEPDASKIPWAKENGVDIVLECTGFYTSEEKAKAHLDAGVKRVVISAPAGAMKTIVYNVNDDTLDENDKIISAGSCTTNCLAPMAYFLNNEFGIEVGTMTTVHAYTSTQMLLDGPVKGGNLRAARSAADNTIPHSTGAAKAIGLVIPELQGKLQGHAQRVPVVDGSLTELVSVLKTKVTADQVNEAIKKHTVDNPSFGYDDRQIVSSDVIGTTQGSIFDPTQTEVTTAGDFQLVKTVAWYDNEYGFTCQMIRLLEKFANL

SEQ ID NO: 4058 - protein, 148 aa, Enterococcus faecium
  misc_feature (B) LOCATION 1...148
  hypothetical: YES
FTRFYNEIAINPTYTKKAIQMEIRFDDASAAEIKQHLAPENKLILTFEDGIGPYSQHAMIHMQVQFTLGIIGSDMSTESYDQSIPSNLGEILVKGYSLADLDEHMNIRFDASRHILSLTGDSGLIDGNLGLIDFTESNNEGIKKNPAR

SEQ ID NO: 4059 - protein, 65 aa, Enterococcus faecium
  misc_feature (B) LOCATION 1...65
  hypothetical: YES
NVLTRLSQLPKHIFESWVLSFLKYKKISNQSTLLSYYVIHSNKREYKIFCVNEKIHTKKEVPSVE

SEQ ID NO: 4060 - protein, 232 aa, Enterococcus faecium
  misc_feature (B) LOCATION 1...232
  hypothetical: YES
QTLTISQKSNRTDLVTNVDRNIQNFLIEKIHSFDPEAKILAEEEGCNQLSDLDGRVFIIDPIDGTLNFVIEGENFCIMLAVYESGVGKLGFIYDVMRNELFWGGKGIRVYKNDEPLPRPANKSLSEGLLGVNSYLFGHNKYGIREIAESSMGTRMYGCAGLELVAILKGNHIAYISNLSPWDYAAGNVLLEEFGMVTSGLFGTPLTFEKREYYLAGTSCAYAEIADLLKKEG

SEQ ID NO: 4061 - protein, 288 aa, Enterococcus faecium
  misc_feature (B) LOCATION 1...288
  hypothetical: YES
TMRFKDMKRGNLMKKISNEIQILAETLTLPKVVIEQMIVQAKNILDEVFEQYSHELMDPNKAKATAKKIDKVYEEEPFAALAIYLYAASQSWKKIYQPLKIPRTIYLATMNAFTRFIHEHFQVTGSYRFDRGFWIWHYTSGLIFRIGELEYEMTYFPKGYTDLRLEGKQCLSLHIPSDADLSQNKIRDSYESAIRFFELYFPDYHYQVMYTDTWLLSPNLTKWLKKESKICLFAADYRLLSVDEQDDSGVPWIFGRVDAQIHDYPESTSLQPHKQKSNCLQASTLALA

SEQ ID NO: 4062 - protein, 67 aa, Enterococcus faecium
  misc_feature (B) LOCATION 1...67
  hypothetical: YES
TILTLLAFAICIIIVFYTQILIFKINYSMRMYIFYIITNQICKVLKLMFNSDVLKLYKFFKKSNNKY

SEQ ID NO: 4063 - protein, 88 aa, Enterococcus faecium
  misc_feature (B) LOCATION 1...88
  hypothetical: YES
YNITEIRKGGPPMTHSQLVAIIKRLEAMVESADNELQVRRFEKEGVEKCTVTYDKATDTFELTETDTHQQYEFDNIDIVAMEIYDLIQ

SEQ ID NO: 4064 - protein, 100 aa, Enterococcus faecium
  misc_feature (B) LOCATION 1...100
  hypothetical: YES
QNITIPTTMKGHEHFTLVDDQGNETLYEILLTVDGQEEFGRNYVLLYPAGVSEDEDVELQAYAYIENEDGTEGELEQIETDAEWDMIEEVFNTFMAEEEE

SEQ ID NO: 4065 - protein, 214 aa, Enterococcus faecium
  misc_feature (B) LOCATION 1...214
  hypothetical: YES
KRRFFMKIALIGATGHAGSFILDEALSRDLDVTAIVRHPEKLPSDVPFIQKDLFELTTTDLASFDVVVDAFNAPKGKEEMHQTSLSHLIEMLEGTDTRLIVVGGASSLFLDTEKTTRMIDQVPKNAPFYPTAFNMYEGLLKLKQSKNLHWTYISPASLFDPHGKRTGTYLLSDDYLQRNAAGDSTISMADYAIALVDEILDEKHEKQHISVVSR

SEQ ID NO: 4066 - protein, 257 aa, Enterococcus faecium
  misc_feature (B) LOCATION 1...257
  hypothetical: YES
KVITNKRSTEMIEFINVSKSYGKKQALKDLSLSIRQGEIFGFLGHNGAGKSTTIKSLVSIIEPSSGTILVDGMKLTENRLSIKQKIGYVPDSPDIFLQLTAGEYWDLISAAYELDTQKKEKRLAELTALFDMYSHQNETIASFSHGMRQKTILIGTLLPDPDIWVLDEPLQGLDPQAAFDLKEMMKAHAAKGKTVIFSTHVLDTAQQLCDKLAILKKGELIYQGAVSELLNGSPDETLEKIYLKMAGRQATGDGPYV

SEQ ID NO: 4067 - protein, 210 aa, Enterococcus faecium
  misc_feature (B) LOCATION 1...210
  hypothetical: YES
GKITLFSVDKPVDVVHNCWGNLFNKNSQNKHIDEKIDYNKQSEHEDQRRENMNIKIISVGKLKEKYLIQGINEYVKRLNAYAKIELIEVPDEKAPENLSEAQMRQVKEKEGERILAKIKEQEYVYALAIEGKNPTSESFAKQIDQLGIQGKSHLVFVIGGSLGLSEAVMKRSNAQISFGKMTYPHQLMRLILVEQIYRAFRINAGAPYHK

SEQ ID NO: 4068 - protein, 383 aa, Enterococcus faecium
  misc_feature (B) LOCATION 1...383
  hypothetical: YES
IKITSQQFPNVSLLLVFENCCFLLTRKENVCSSCVEEVIVMWANQNPVFVYEKEPSRDILCIDCKSFYASVECVEKDLDPLTTKLVVMSYPSDSTETRGSGLILASSPAAKKAYGITNISRARDLPFPYPSDLYIVAPRMAYYMEKNREINSIYKKYADEANHHVYSVDESFLDVTNSMALFGKTNAYDMAKLIHKDVFEQTGIYTTIGIGDNPLLAKLALDNGSKDGKQMFAEWRYEDVPEKLWKISDITDFWGIGKRTAKRLKQMGIHSVYDLAHADYYHLKSKLGVIGTQLYAHAWGIDRSFLGQEYTPKSKSIGNTQILDRDYTRREEIEIVIKEMADQVGTRLRRSAAKTQVVSLWVGYSLGYLDPNGKTGFHHRMKI

SEQ ID NO: 4069 - protein, 92 aa, Enterococcus faecium
  misc_feature (B) LOCATION 1...92
  hypothetical: YES
FFVTGFSCHWLSTQWSNSLRTMFASSGDIIPPCGVPFSGYVIVPLVILIGAFNILFKMNIKCLSRIPIAHICFISLEWFTLSKKPLISNSIT

SEQ ID NO: 4070 - protein, 560 aa, Enterococcus faecium
  misc_feature (B) LOCATION 1...560
  hypothetical: YES
VSVTEISASQFQEMVQAGANRLQVNAEYVNSLNVFPVPDGDTGTNMNLSMTSGAKAVVDSTSEKVGELAAMLSKGLLMGARGNSGVILSQLFRGFSKQIPDVVSLNASDLAAAFTHGVETAYKAVMKPVEGTILTVAREAAKAGEKKAKSTDDVVEVMTAVVKGAKRALAKTPDLLPVLKEVGVVDSGGQGLLFVYEGFLSALNGEFQADETYEPSPAEMDDMVNAEHHRSVQGQMATEDIHFGYCTEIMVKIGEGPTVDSTFDYEEFRNYLDGIGDSLLVVNDDEIIKVHVHTENPGEVLNYGQKFGSLVKIKVDNMRLQHETILEHDEEVNEFAKKEIPRIPYGIVAIAAGKGVQELFESLGANYVISGGQTMNPSTEDIVKAIQEVNADKVIVLPNNKNIFMAADQAAEVADIPVAVVPSRTISQGLTAMLSFNDQASLEENKETMTEMLSSVVSGQVTHAIRDTSIDGVEIKEGDFLGMIDGKILISNPDITATALSTLEQMINEDTEIVTILAGDEGTVEQANEFAEKLTEKHPDLEIEIHQGDQPVYPYLFSAE

SEQ ID NO: 4071 - protein, 440 aa, Enterococcus faecium
  misc_feature (B) LOCATION 1...440
  hypothetical: YES
SKVTPDAPFGPGPRDALKHMLAYGERDGFKVKNVDNYAGHIDLGEGDETLGIFGHMDVVPAGDGWDTDPYEPVIKDGKIFARGSSDDKGPSMAAYYAMKIIKELDLKLSKKVRFVVGSDEESGWGDMAYYFEHEEEPDFGFSPDAEFPIINGEKGNVSLALRFKGDNAGDYVLKSFVSGLRENMVPGTATAALQVPSADAAIAMEEAFYQFIEANPVSGTIEADNTYVKIELVGKGAHGASPQSGINAGSFLALFLDNYEFLGSAKQFIHVAAAYVHEDFYGEKLGVAYEDEKMGKLTMNAGLFAFEENGTEEANFINMNFRFPKGVTVDGLQSDIEQTVGQEGATVTRGARVMEPHYVPMDDPLVATLLQVYEDHTGEKGYEQIIGGGTYGRLLKRGVAYGAMFPGYTDTMHQANEFMSLDDLFRATAIYADAIYRLAK

SEQ ID NO: 4072 - protein, 256 aa, Enterococcus faecium
  misc_feature (B) LOCATION 1...256
  hypothetical: YES
RRVTNMRNRKWLFVCAAALFSFTAYTQLTFADRQESTDSTEQTIQTSDSSTIQSSDETVDSSTVDSSEEPKIAEDDQIVKQTIHVQKIISSEQLDNQGHEKQEGVNGAKFSVYDVSDILQKMDVKDLTTDQIESQLKDRVKKLSSDQLKLVSNGETKTIDQQTGVFEFSVEVQANQKQAYYIVNESSPENISNSEDILLLTPVSDKNGEFLKDVWIYPKSEASQPKEEVKKIVSTGVKKNFFENCWDFVTHLFSRD

SEQ ID NO: 4073 - protein, 141 aa, Enterococcus faecium
  misc_feature (B) LOCATION 1...141
  hypothetical: YES
CISTHKIYKYFKCHYKYNNLLYSTEKGGVLMKQKQYAKVIREKRKALGWTQKELAKKIFSTQQAVARWENSVTEPNLDSLTALSRALGTPVSHFLDNVDIDYEEEFLALYRSLSTEDAIRTIDYMKLLKRQENERNQLLKD

SEQ ID NO: 4074 - protein, 159 aa, Enterococcus faecium
  misc_feature (B) LOCATION 1...159
  hypothetical: YES
FSSTALTMATSVGLPLITRSSSSCSTVTSVHSAAIFNISIALFVIESSIFVTSSSLLHTRRTRISFCVSVPVLSEQITLAVPSVSTAGNCRMIACFLAIFCTPYASVNVTITVKVSGTAATAKEIEVMNISRSGSPCSSPITNTKAAAAKAIILIRLPS

SEQ ID NO: 4075 - protein, 434 aa, Enterococcus faecium
  misc_feature (B) LOCATION 1...434
  hypothetical: YES
NHSTSNCIEGLSMKKKLFAIFGPVVLAVGLLFVFFTSSYQVDISNPETIRRASSSMSVNVLKGDAIKNYALSEKQYIPFFGSSELSRISPFHPSVLAEKYQRNYRPFLLGAPGTQSLSQYMMMRSAGDAMKNKKVVFIISPQWFVKNGVKTDYFNTYYSELQTYDWLFSMKKVTPADRYLARRLLTFSKVKENDTLTAILQTIKKGKLPLPESLNQLRSQWNMLKREDEVFSNIGLKDRQQKIDHESKRLPKQYQETELSILANQIGERETTNNPFGLKNDFYTHRIRAHEPELKQSQKNWDYRFSPEFSDFQLVLDQLAKNHNEVLFIIPPVNEKWSDYTGLSQEMLQGFAKKIKFQLNSQGFNRIADFVNQAGTNYFMEDTIHLGWKGWLAADQQIRPFLEENHITASKYHLDDAFFSKSWQHQIPDKLQLK

SEQ ID NO: 4076 - protein, 71 aa, Enterococcus faecium
  misc_feature (B) LOCATION 1...71
  hypothetical: YES
TVGFVNHQLKMALSYGNKKWSLDEAEIPTYEDTWHLRVEVKEEAENIGGCTLFGKGFGNYDQDIKIKMFYS

SEQ ID NO: 4077 - protein, 62 aa, Enterococcus faecium
  misc_feature (B) LOCATION 1...62
  hypothetical: YES
FSSTIPASAEDIAIPDSLIIYLDETESEVATDVHVVEDKNDSLKINSSDTLLRVSPIFSAVI

SEQ ID NO: 4078 - protein, 144 aa, Enterococcus faecium
  misc_feature (B) LOCATION 1...144
  hypothetical: YES
TSSTKKNIYRMAFKSRKKEAEAFQDWIFDIIKELRQSTGLEGFQVFRMLDKEHQKEAMTKLSHAITEPKPVDYIKANVIANKAVSTIYGHSKMVKKKDMTPEMLVDREPILDETVELMTVKEKYGLQFSVSEKIYNRSAELQTT

SEQ ID NO: 4079 - protein, 141 aa, Enterococcus faecium
  misc_feature (B) LOCATION 1...141
  hypothetical: YES
FRSTMIDRSWSRKRGSFLQQEPEIQKEVRKLTKLLRENETIIRYKELEEKIQQNQYLAELREKIKQAQKDAVHFAHYDKPAAEKEAIKQADQFMQEFDQHPLVVAYRKQLLEADDLLHHLTTMIQEEINGQIEEEKHASKN

SEQ ID NO: 4080 - protein, 75 aa, Enterococcus faecium
  misc_feature (B) LOCATION 1...75
  hypothetical: YES
PKSTKRILINIQNKTTAYGLCFDSNNVVIIMIKQMANNTMNNDRKNNEQIYMHFSFLEAASRIFCFKINGSSCRD

SEQ ID NO: 4081 - protein, 495 aa, Enterococcus faecium
  misc_feature (B) LOCATION 1...495
  hypothetical: YES
KCPTGKQSSRKKGFTFDDVLLIPAESHVLPNEVDMSVQLAKNIKLNIPIISASMDTVTDSKMAIAMARQGGLGVIHKNMTISQQADEVRKVKRSESGVIIDPFFLTPQHLVADAEELMSKYRISGVPIVETLENRKLVGIITNRDMRFVTDYHMPIADVMTKDNLVTAPVGTSLKDAEKILQKHKIEKLPIVDNEGRLSGLITIKDIEKVIEFPNAAKDEHGRLLVAAAVGVTSDTFERANALLEAGADAIIIDTAHGHSAGVIRKIQEIRSTFADATLIAGNVATAEATKALYDAGVDVVKVGIGPGSICTTRVVAGVGVPQLTAIYDAASVARQYGKAIIADGGIKYSGDIVKALAAGGHAVMLGSMLAGTDESPGEFEIFQGRRFKTYRGMGSLGAMEKGSKDRYFQGSVNEANKLVPEGIEGRVAYKGSVADIIFQMIGGLRSGMGYVGAANLQQLRDEAQFIQMSGSGLKESHPHDVQITKEAPNYSVES

SEQ ID NO: 4082 - protein, 85 aa, Enterococcus faecium
  misc_feature (B) LOCATION 1...85
  hypothetical: YES
SSPTSKSIEPKFPELNQTLEELAAKYQTTPTGLASAWILRHPANMQVIAGTMNVGRIKEIAQASEINMSREDWYELYRAAGNILP

SEQ ID NO: 4083 - protein, 256 aa, Enterococcus faecium
  misc_feature (B) LOCATION 1...256
  hypothetical: YES
MGPTWADYRRYVHSVQTFGSVNGPGLRFVVFMQGCRMRCQFCHNPDTWNIGGGKEYTADELLDKAERFTPYWGDKGGITVSGGEPLLQIDFLIELFKKAKERKMHTTLDTCGKPFTYEEPFFSRFQELMKYTDLLLFDIKHIDNEEHKKLTHWDNENILEMAQYLSKINKPVWIRHVLVPERSDYDEYLIRLDNFIQTLSNVDRVEIFPYHTMGKYKWETLGLKYPLEGIEPPTKERVENAKRLLHTEEYTKYLTR

SEQ ID NO: 4084 - protein, 98 aa, Enterococcus faecium
  misc_feature (B) LOCATION 1...98
  hypothetical: YES
QITTTINHSRTTKKPGIIATKARLTFGGTLAGILIVIFLSTNHRKISVDTSATIIPTKRPEVPKYFVGNPIEPSASNKGVSKTYPLKDNNPADNESTP

SEQ ID NO: 4085 - protein, 500 aa, Enterococcus faecium
  misc_feature (B) LOCATION 1...500
  hypothetical: YES
VKTTKEESLMTDQPYDLRKVIEELKTLPGQYHETDIEIDPEAELSGVYRYIGAGGTVKRPTQEGPAMTFNNIKGFPGTRVNIGTMASRKRVGEILHHDYRTLGRFLKDAVENPIKPVKVDKADAPAQEVVHLATDADFDIRNIWPAPTNTPEDAGPYITMGVVLGSDPEKTMSDVTIHRMVLEDKDTIGMYIMPGGRHIGHFQKQFEALNKPMPITINIGLDPAIAIGTTFEPPTTPLGYNELWCAGALRNEPIQIVDGIAVDEVGIARAEFIIEAEIMPNETMQEDINTNSGKAMPEFPGYTGDANPAVQVVKVKAVTHRKDNPIMQTTIGPSEEHVSMAGIPTEASILALVDKAIPGKVVNVYNPPAGGGKLMTIMQIRKENEADEGIQRQAAILALSAFKELKTVILVDEDVDIFDMNDVVWTFNTRFQGDKDIIVIPGMRNHPLDPSELPEYNPGSIRFRGISAKTIFDGTVPFDMKEHFVRAKFQEVEDWEKYLK

SEQ ID NO: 4086 - protein, 241 aa, Enterococcus faecium
  misc_feature (B) LOCATION 1...241
  hypothetical: YES
NFATEPKLLSINAWNDDGNTLTKFVAFTKYSIIRDKQLVIISVNPEFKGLFNQLKNWTRFNLEQFTNLDSTYSKTMFRLLKQYRTQGWTEFSKEKFFDLLDIPKSYWNSPSNIDKFILRPIKEELTPLFKGLTIRKKYGKGRGKPVIGYRFTWKAEINHADDFSKGKQEDLRIKLFNIDHNGELTREEKWRAKDRILNLPLGTHEADFKQQQQTEEKQAEKRELSNKLKQDLLGNLQNLFD

SEQ ID NO: 4087 - protein, 210 aa, Enterococcus faecium
  misc_feature (B) LOCATION 1...210
  hypothetical: YES
RKATGPPAWKEYYHPVRFTRMLTVAPSWENYQTEDPLEKIITLDPGMAFGTGTHPTTSLTLTALETVLRGGETLLDVGTGSGVLSIAAKYLGAKDVYAFDLDEVAVRSAKENMDMNEIAKDVHVSANDLLTGIEIESDVIVANILADIILLMIPDAWRLLKQTGTLIVSGIIEEKKQMVLDAMLEQGFIVDQIFQQKDWYAIILKKPEVE

SEQ ID NO: 4088 - protein, 386 aa, Enterococcus faecium
  misc_feature (B) LOCATION 1...386
  hypothetical: YES
SLATYLKICPAPQTRMNCVTLLTDGQEKLDSLLQDLKKAKHSIHIEYYAFVTDNIGQQVLHVLEEKAAEGVEVRILYDAFGSHGTKAKDFNRLIKNGGHVHTFVTSQRALLRFRLNYHDHRKIVVIDGKISYTGGFNIANQYVNTTKKFGYWRDTHIRIFGAASSLLQLRFLTDWNVSVPEEKKVGYHLNYFFKKADRDESKLADTSIQLVSSGPNNEREQIKLSFIKLITSAKKRVWIQTPYLVPDESVIAALKIATASGVDVKIMIPNKPDHPFIYRATQYYARQLIKENVQILVYENGFLHAKTLIMDDEICMVGSANQDIRSYRLNFETSAVIYDPEFLEELATQFKEDETHCSSMTTETVKEMSNWLLFKQQISRLFSPIL

SEQ ID NO: 4089 - protein, 138 aa, Enterococcus faecium
  misc_feature (B) LOCATION 1...138
  hypothetical: YES
SWATLGEYIGFFANNSAHERFERRKKMTLPNCPECGSEYTYEDRGLLICPECGNEWNKEEQETVIEDGLVVLDANGNRLLEGDSVTVIKDLKVKGASGAIKQGTKVKNIRLVEGDHNIDCKVEGFGPMKLKSEFVKKN

SEQ ID NO: 4090 - protein, 225 aa, Enterococcus faecium
  misc_feature (B) LOCATION 1...225
  hypothetical: YES
HGGFIMIKRNWPWLLALVLLFLFVRNNSFSFVLGLLLIGVVLVLWGLFGSRRKKGKQEEIPALTDELETHYEKSGMTANEISFFRQTMNQTKNEINQLQMNMQQTAKLKAIDLRHDPVKAAKALFKELVKEPNRLHEASQFLYTHLPNLVDLTNKYNEINDHEIKNKQTYEKLEESAQIIDQLSALIAQDYQKFVAEDLDDIDVEISVAKQSLKRDNKYEPEQKD

SEQ ID NO: 4091 - protein, 292 aa, Enterococcus faecium
  misc_feature (B) LOCATION 1...292
  hypothetical: YES
RYQTVCGQTDPTGEKGGFSMALLSYEFMRRAFLAAIFIAGIAPMLGVFLVIRRQSLMADTLSHVSLAGVALGFFLNLNPTLTTMLVVVLAAVILEYLRTIYRTYSEISIAILMAGGLALALVLMNLSGGNSATSIQSYLFGSIVTITWEQVIFLGILFVAIGILFFLFKRPMYVLTFDEDTAHVDGLPVHLMSMMFNVITGVAIAVMIPIAGALLISAIMVLPAAIGMRLGKSFNVVIAISVCVGFLGMLSGLTSSFYLDTPPGATITLVFIALFPDCKYHQTNIGCLQKKK

SEQ ID NO: 4092 - protein, 329 aa, Enterococcus faecium
  misc_feature (B) LOCATION 1...329
  hypothetical: YES
KNQTKNIFVKSIYKKIFLYNEGIRNGGAIMEIGVIGLGKMGLNLALNLKEHHHKVQGLDISSTAVNQARENDIPAYQEISEFLATFEQKKIIWLMLPAGEITENMLRKLFPKLGPGDIIIEGGNSYYKDSIRRAEKFQKNEIGYLDCGTSGGIEGARHQACLMIGGDKETFLSVEQLFKDVAIERGYLYAGASGSGHFLKMIHNGIEYGMMQAIGEGFQLVQKSEYAFDLEQVARVWNHGSVIRGWLMEIMEDQLNEHPNLSNYRGIVSASGEAKWTVETALEMAVPVPVIATSLFMRNLSQEEDSFSAKVVSALRNGFGGHEIVEKGE

SEQ ID NO: 4093 - protein, 66 aa, Enterococcus faecium
  misc_feature (B) LOCATION 1...66
  hypothetical: YES
SIQTNHCFNGFRSYCSFRSIRLSDAHLSYEDCKKSESGKKDGDKNFVTILFVFLNNRFFFSFSYIL

SEQ ID NO: 4094 - protein, 420 aa, Enterococcus faecium
  misc_feature (B) LOCATION 1...420
  hypothetical: YES
LSKTNNQKIKAVVLVSKKKEPKKLSHPSSDENNLTPWQKANRKYLAEQEMKNQEPKKEDITLDTPLSDSEEEKTVQEEQQEESQSEKKIEFFEEIKQKKNGGPYNGSFLNRLPNLKSQRHKVLFRRLALIITVLGIPLIFLIYYVSPYSKLQAVAVSGNKTVNSQEIISDTKLSLGENVWGQYFHRSTYIDRLKKAQPRIETANIHFKGMNEFDLDVTEYKEIALIAKNNQYYPVIENGTVLDEKVANPTKNLPILEEFKDSAKIKELTKQYNQLSSELQKAISEIKYTPRASNKNLIQLNMNDGNQVIVNINNLANQMKYYSQVAKDMDEKGVIDMEVGIFSHPYGSTQETEESGQSEETTESEENADQTNESSEEAETQKAQTPGSSSTNGSSDSNDSSETSQIEDNPSTTPSSLNEN

SEQ ID NO: 4095 - protein, 800 aa, Enterococcus faecium
  misc_feature (B) LOCATION 1...800
  hypothetical: YES
RSKTPGEFKEQMPYIRDLLTGLGVQYYELPNYEADDIIGTLAEKVDKDQFDVVVLSGDRDLTQLASKEVKVDITVKGVSDIESYTPEHVAEKYDGLTPKQIIDMKGLAGDASDNIPGVTKIGEKTAIKLLKQYGSVEGIYEHIDEMKQSKMKENLINDKEQAFLSKKLATINTSAPVDVSIDSLKYEGKNLDKLVPFYKEMDFNQFLSKLNIVEEEVKMDDILFEVVHEFKEEMFTTDMALYVEMMGDNYHTEEIVGVAWGTEKKIYVTNDLSVFENRAFHSWITDPTRLKKVYDAKRTYVALNRYTGKTKGIDFDVLLGAYLLDTNEKSTDIEGIAAHYGYNDIQSDEAVYGKGAKKGLPEEEELFFAHLARKVAAINALTPKLSQELAEKNQEDLFRKMELPLSIILAEMEISGIKVDATRLQEMKGEFSARLREIEQKIYEEAGEEFNLNSPKQLGVILFEKMGLPVIKKTKTGYSTAVDVLEQLREQAPIVEDILTYRQIAKIQSTYVEGLLKVIQSDGKVHTRYVQTLTQTGRLSSVDPNLQNIPIRLDEGRKIRQAFVPREKDWLIYSSDYSQIELRVLAHISNDEHLKAAFLEGQDIHASTAMRVFGIEKAEDVTPNMRRQAKAVNFGIVYGISDYGLSQNLGISRKAAQQYIDTYFEKYPGVKEYMERIVREAKDQGYVETLYHRRRYLPDINSRNYNIRSFAERTAINTPIQGSAADILKIAMIELDKRLKETGLQATMLLQVHDELVFEVPEKELESLDKLVKEVMEQAVSLHVPLITDSSWGKTWYEAK

SEQ ID NO: 4096 - protein, 220 aa, Enterococcus faecium
  misc_feature (B) LOCATION 1...220
  hypothetical: YES
STKTSPYQRSRSMDNHTRKLLGLTDKHLFFDEEWLIAKEYKGVQAQFIKGRLDDSPSHCEHCGSIRIIRNGSYTTRTQMLKVKEKLTILELRRTRFLCYDCGQTFSAKTDLVDEHHQLTKELKQAILIELYENQSRNLKIRRSTVGSSDIGNSYSKIPRHWSRSNGIIIDCLNDQLVKQKSSMNRCAQWCRERTATPSISRAVATSRGWMPSKLKATTPV

SEQ ID NO: 4097 - protein, 120 aa, Enterococcus faecium
  misc_feature (B) LOCATION 1...120
  hypothetical: YES
MYKTKLLNQLDSLELEEINQGIAELENNIGKTYFGNSFNEKLTVLYVLKKHAEHKIICREINELKNQILTAWLNITDMQEARVKTFNTWVKYQNQLKGAEFVRDGLKYELEQLKLMEVSE

SEQ ID NO: 4098 - protein, 450 aa, Enterococcus faecium
  misc_feature (B) LOCATION 1...450
  hypothetical: YES
GRKTKPARAFPFLRDARPYAVGIPAAQRVSSGRRKQIRRPGPKEVMKMHINIDAIQVNSGRREALPEAVRELADSISAVGLLNPITVDRDYTLIAGLHRLEAAKLLGWSEIECHISTLEGLQAELAEIDENFVRTDLETVEFGKLLMRRKEIYEILHPETRCGVSQANAMNRAQGNNVSERGASTSKSFTRDTAKKLGISARSVEENIQIARDITPKAQEVIQGSDRKIKKKDLLKLSRMEPEQQEHAAAQLAAGKIKSADEFQPAEPPGLPKPARKLEQSKPAPKLKQAEPRQEPKYPKPMPEPKQPEPIPEQAEQTQKPEQSKLTQKPEQTEPVQEQGQTSEPITKLPSQPSVPYTLGDQHYDTLEESIADLKNPDKDCSYTPDTLLADIDGFVQTFHKGFAWYHDPFCTIVFPRISKVQFEFVRQRFESISTAMEELLNQMERTITT

SEQ ID NO: 4099 - protein, 714 aa, Enterococcus faecium
  misc_feature (B) LOCATION 1...714
  hypothetical: YES
ITKTTVGRRRISMAKIQELSERLANQIAAGEVVERPASVVKELVENAIDAGSTQIDILVEEAGLRTIQVIDNGEGILADDVENAFKRHATSKIHNRDDLFRIRTLGFRGEALPSIASVSEMTLETANQEEKQGTYLSLKGGEVIEHRPAPLRQGTKITVSNLFFNTPARLKYVKTLHTELANIGDIVNRLALSHPSIAFRLVHDGNKMLATAGNGDLKQTIAGIYGLSTAKKMLKIEGKDLDFELFGYVSLPEVTRASRNYLSTIINGRFIKNFSLNKAIVAGYGSKLMVGRFPIAVLEIKMDPLLVDVNVHPTKQEVRLSKEKELTELISNAIQKALSQENLIPSAADNLRFKKKVPDQPKTEQIEIDLSYAFEEEKPKKPSSLNFDRETGTFFVEELKNTFVDRIVDKSVENVENYSGFSEENTTYPEKTAKTVDKFGENVDNFVEKTVEKSEKKEFPIVDNMEKTNEEQADKSVEEDEKIYEEELTLHPEFDFTQGNDKTLEQAIKKLETEKPVQRFPQLEYFGQMHGTYLFAQSSDGLYIIDQHAAQERIKYEYFREKIGEVSDDLQELLVPFVLDYPNSDALKLKEQKHLLEDAGIYLEEFGQNSFIVRAHPTWYPNGEEESIIREMIDMLLTTGSVSVKKFREATAIMMSCKRSIKANHYLNEAQARVLLKDLARCENPFNCPHGRPVLIHFTNSDMERMFKRIQDPH

SEQ ID NO: 4100 - protein, 66 aa, Enterococcus faecium
  misc_feature (B) LOCATION 1...66
  hypothetical: YES
EQKTGGLSGNWSNGFKYAVTVYRVASEIQENKVIPVLLYGTHNNFYELAENTRNFIRVDKSASVEL

SEQ ID NO: 4101 - protein, 144 aa, Enterococcus faecium
  misc_feature (B) LOCATION 1...144
  hypothetical: YES
NKKTSLSSTIIRSKKIKLIRKEEEDMTILSKILVTLVAIEFFYIMYIETVRTDSDTTSRVFKMSKEELSRKSVQTLFKNQGVYNGLLGVGLLYGAYLSSASKEITSMLLISIFFVALYGSLTSDRWILLKQGGLALLALLSIFL

SEQ ID NO: 4102 - protein, 224 aa, Enterococcus faecium
  misc_feature (B) LOCATION 1...224
  hypothetical: YES
FKKTEEKNNYTFFYTRNRRKEAKKMNTLPINTGDTAFMILCTAMVCLMTPGLAFFYGGLARKNNILTIMSQSFLSVGITTIMWVFGGFGLAFGRDIGGVIGNPADFFLMRHVTSFPNMFHGATIPFLMFFLYQLMFIVITVPLMTGAFAGRLNLKGYIILVIFWNLLIYFPVCHWIWGGGFLDQMGFRDFAGGAVIHTTAGFGSLACILTLGQKKDSFRRKKSA

SEQ ID NO: 4103 - protein, 155 aa, Enterococcus faecium
  misc_feature (B) LOCATION 1...155
  hypothetical: YES
MKKTKIVSTLGPASNSVEIISQLIESGANVFRFNFSHGDHEEQLSRMTMVREAVKKTGKDVGILLDTKGAEIRTTVQGTTEADFGRAGYIKFEVGDQTRISMDPEHVGSKEKIAVTYPGLFDDVHVGGHILFDDGLIDMQIIEKDKANRELVVES

SEQ ID NO: 4104 - protein, 330 aa, Enterococcus faecium
  misc_feature (B) LOCATION 1...330
  hypothetical: YES
AMKTKQQKAVLSRHLAKYDIIKGRKNKKEENPMQQPLAYRMRPRTIDEVVGQQHLVGEGKIIRRMVDARMLSSMILYGPPGTGKTSIASAIAGSTNYAFRMLNAATDSKKDLQVVAEEAKMSGTVILLLDEVHRLDKTKQDFLLPHLESGRIILIGATTENPYITINPAIRSRTQIFEVKPLTEQDIQLAVEHALRDKERGLGQQAIQLDEDALLHLSRATNGDLRSALNGLELATLSTPSDKEGRXXXXXXXXXXXXXXXXXXXXXXXXXXXXXXXPPXKXXPXPPTKGGRPRGXXXXPPRKTPGWGKKSLVGQTEKVRPLRRGNMQGG

SEQ ID NO: 4105 - protein, 225 aa, Enterococcus faecium
  misc_feature (B) LOCATION 1...225
  hypothetical: YES
QMKTRVLFIGDSITDAGRDRSEATDLGKGYPLLIAGKLISRYPTMEFECINRGIGGDKIADLQARWQEDCLALQPDYVSILIGINDTWHNTGDQAIFGTEKSVQQFESVYRELLNELQAAGICNIVLMEPFVLPVTNDRYGWRKDLDPKIQTVRKLAKEYGTLLIPLDGIFNALGIAYGFSKYTKEDGVHPTIGGHEIIAQSWIDAISAVDSFSGNKNERKKREK

SEQ ID NO: 4106 - protein, 162 aa, Enterococcus faecium
  misc_feature (B) LOCATION 1...162
  hypothetical: YES
EMKTKQLTIYAMLIALTVALSLTILIPVPATNGFVTLCDAGIYTAAFLYGPTGGLVVGASSGLLIDLISGYPQWAVFSLVIHGFQGYVAGACIKSPTRMWGLGLLLGSLVMIIGYGIAGWILYDWPAGVASIPGNIFQNLIGMGLAFPITASLQRIQARKQY

SEQ ID NO: 4107 - protein, 110 aa, Enterococcus faecium
  misc_feature (B) LOCATION 1...110
  hypothetical: YES
LVKTLGWELSKAKNRKVGFVLGLTGGIATGKSTAAKVFQSHGFPLIDGDVIARETVEPGTLALRKIVSVFGQEVLQPDGQLDRGKLGMIVFPSKEKRQKLDQLLDPFIPF

SEQ ID NO: 4108 - protein, 226 aa, Enterococcus faecium
  misc_feature (B) LOCATION 1...226
  hypothetical: YES
SIETHSGFAYNSDIEIDWIKAQELTRENVEERLKDADGILVPGGFGDRGVEGKIEAIRYARENDVPFLGICLGMQMACVEFARNVVGLEDASSAETNPDTANNIIDLMADQENIENLGGTLRLGLYPCKIKKGTKTAEAYGGADVVQERHRHRYEFNNKYRQLFEEQGLVFSGVSPDNRLVEIVELPEKKFFVGCQFHPELISRPNRPQKLIKAFVGASLADHETK

SEQ ID NO: 4109 - protein, 190 aa, Enterococcus faecium
  misc_feature (B) LOCATION 1...190
  hypothetical: YES
FDETLARIPKQNEGGISVIEGETRRKQIMQTLANTEKPVSASKFAKTFGVSRQIIVGDIALLRAAGKSIVATARGYILETEETNTGHISKIAVQHGKDQTEEELRLIVENGGEIIDVIVEHPLYGELAGTLHIKTPQDIDSFMRRYQKSNATLLSELTGGIHLHTIRYPEKHMLKNIKQKLAEAGILYEG

SEQ ID NO: 4110 - protein, 243 aa, Enterococcus faecium
  misc_feature (B) LOCATION 1...243
  hypothetical: YES
MKETRQFIWTYIKIIFALFILGVAINMFLGPHHIAAGGVSGLGILLEAVLGFDRAIVILVLNIVMLVLALLFLGKKPFFKVLFGSLFFPLIIAIVPETMITSDRLLSVIFGSAIFALGVAILYKNNSSSGGTTIPPLIFKKYFHLNTSIGLFFTDAFVVSLNLFVFGIEEFLYAILSIAITSIVMTYIETGINRKKSVMVMSEHYLEDIRLRLSAEIGRGLTLLEAKGGYRSKVKRGFIDRCD

SEQ ID NO: 4111 - protein, 243 aa, Enterococcus faecium; identical to SEQ ID NO: 4110
  misc_feature (B) LOCATION 1...243
  hypothetical: YES

SEQ ID NO: 4112 - protein, 136 aa, Enterococcus faecium
  misc_feature (B) LOCATION 1...136
  hypothetical: YES
EEETNMKKGKVINSDISRVIAQMGHFDKLSIGDAGMPVPFGTEKIDLAVSNGLPSFLSVLENVLEELEVQSIELAEEIKTMNPEILEKIKLLLPDTPISFIPHEEMKKELNNCHAFIRTGEMNTYANIILVSGVVF

SEQ ID NO: 4113 - protein, 75 aa, Enterococcus faecium
  misc_feature (B) LOCATION 1...75
  hypothetical: YES
HMETEWQRRERKKQKKEEMLRLCRLLDVKDWDKNEQIAQKVRSIIHKEEKVKNKDTRRTENEKRKVQKKREKSKS

SEQ ID NO: 4114 - protein, 342 aa, Enterococcus faecium
  misc_feature (B) LOCATION 1...342
  hypothetical: YES
TVETKRYDETELQEAAEALKEGELVAFPTETVYGLGANALLPNAVKKVFSVKGRPQDNPLIVHVASFEQVKEYVDNFHPAAEKIVKNFWPGPLTLIFKIKKDTLPSVVTGGLSTAAFRIPDNKKTLEVIQLSGVPLVGPSANTSGKPSPTTADHVYHDLQGKITGIIDDGATRIGVESTVLDLSDPTAMPMILRPGAVTKEQIEAVIESPVAIDQHLVKENETPKAPGMKYKHYSPDTRVLMVRDGDWSTAVQWAKNKKIRAGVIASPEIADQVRTDTAAVYMYNDNSVEAAAKGLFAGLRGLDEPTLGLDLIFVQVYPETGLGNAYMNRLKKAAGQNYFEK

SEQ ID NO: 4115 - protein, 173 aa, Enterococcus faecium
  misc_feature (B) LOCATION 1...173
  hypothetical: YES
SKETRINFNEGRDKMRKVAPILKPIAVLTISTIVATTTGIVNSSSYRAPSSSSSTVEETTPTTSVSTSEPTTTESLNETTTTSTWDDTTTSSSYDETYTTDSSSETSNTVPDGTPSDSTNPSTSPDTSASSETIPSSTTVDDNTQNDDAARTAQQNQDSGNTQTYNQQAGDSQ

SEQ ID NO: 4116 - protein, 380 aa, Enterococcus faecium
  misc_feature (B) LOCATION 1...380
  hypothetical: YES
KKETTIMRLNKLYLKNYRNYEELNIEFSKNLVIFLGENAQGKTNLLESIYVLAMTRSHRTSSEQELIGWTDDQAMIQGEITKGSSTLPLEILLSKKGRKTKINHIEQKKLSTYVGQMNVILFAPEDLSLVKGSPQIRRKFLDMELGQINPIYLYDLVQYQAILKQRNQYLKQLNEKKQTDLLYLDILSEQLAAFGSKVLKARAQFVKRLEFWANSLHQQITHQKEQLEIEYLTAVDSLETHTQEQIQEQFLALLNQNKKKDLFRGTTTVGPHRDDLSFFINQKNVQTYGSQGQQRTTALSVKLAEIDLIKEETGEYPILLLDDVMSELDDNRQLHLLETIEGKVQTFLTTTTLDHVKNKMTVEPEIFYVQQGKLKGEETE

SEQ ID NO: 4117 - protein, 304 aa, Enterococcus faecium
  misc_feature (B) LOCATION 1...304
  hypothetical: YES
LRETGQSMPDVLILPKLASFFDVSVDELLGYHPQLTKEQIRHFYQQWTTAFSEEPFEYVMEDCRKAVKQYYSCYPFLLQVAVLWLNHFMLTKDLEEQQAILSEAEALCTKIVEESAELSLCNNASLLKVAVMLQLGKPEEALSEIEEKADPYRFAQQSDTLLIQAYRAAGQTKKAVSYTQFSMFSHLINLVSSATHYLLIQIIQLPVIEETVNRIDAVIQAFNLTAVHPNSCAQFSYAAACAYAKHEKEEQVIKCLKQFVDLTLILLSEEGRILHGDRYFDEITEIFEGADLGVQQIRDTKFIR

SEQ ID NO: 4118 - protein, 321 aa, Enterococcus faecium
  misc_feature (B) LOCATION 1...321
  hypothetical: YES
GVRTMTLKIFLEVVEIRTKVASVFPFAVGVLFSIAFFHEIHWLNTFLFFIGMLVFDLATTAINNYMDYEKAHSEVYKYEENVIGRRNLSPVLIRNMILAMIAFVFVIGVILTINTGWLLLLMGFICCFIGVFYTFGPIPLSRMPLGEIFSGVTMGLGIFAMVVYVNTFGSDVYDLTVNFSSGQFALVGNLWAIAAIVLASLPLVFTIANIMLANNLRDLDRDIENHRYTLVFYIGRPAGTVLFQLLMYACYFVILMGLLSGIYEWPILVTFLTLPIVKKHLDQFKQTLPQPISFSYSIKNMVLFNASYVLGLLLTIIMQAI

SEQ ID NO: 4119 - protein, 246 aa, Enterococcus faecium
  misc_feature (B) LOCATION 1...246
  hypothetical: YES
KLRTCGQEWPGSFLGILWAFINPLFTVLIYWLVFGVGLKAQMIDAKYPFIVYLVTGMIPWFFFSDAFASTTVVFREYTYLVKKVVFNIRILPTTKILSNLYTHLFFILIGIAVALINGIYPSAMSLQLIYYLFCMCAFLTGLTWLTASIQPFLPDIMQLITIVLQLIMWTLPILWSPNQFDSGLVSILKLNPLYYVVQGYRESFLSEAWFWEHGTYTLYFWVFTLVMFVIGSAVFRRLKPHFSDVL

SEQ ID NO: 4120 - protein, 100 aa, Enterococcus faecium
  misc_feature (B) LOCATION 1...100
  hypothetical: YES
RSRTGVMMIRFKSLMIVLKPCSFCIKSLITSSDWIFTAISCAFIASSSLNSCPLICFSCNSICIAWKSLNSLCASSFACTFSYASFNALNSGNSRISRSI

SEQ ID NO: 4121 - protein, 323 aa, Enterococcus faecium
  misc_feature (B) LOCATION 1...323
  hypothetical: YES
RGRTIMSTIELIALILTSTLVYSTPLILTSLGGTFSERSGIVNVGLEGIMVMGAFSSIVFNLTMSPSLGSMTPWIAILVGGVVGILFSLIHAVATVSLRADHIISGTVINLMAPALGVFLIKAWYGKGQTDNITQNLGYFSFPGLADIPVIGPIFFKNTFLPAYCAILIAVLAWVIIFKTKFGLRLRSVGENPQAADTLGINVYAMRYSGVLISGLLGGMGGAVFAQSISGNFSAGTIVGQGFISMAAMIFGKWNPLGAMGASLFFGFAQSLSIIGAQLPVISSIPPVLLQIAPYLLTIIVLVVFLGKASGPKANGKNYIKSK

SEQ ID NO: 4122 - protein, 174 aa, Enterococcus faecium
  misc_feature (B) LOCATION 1...174
  hypothetical: YES
TGRTPIPAQYDVELEQLSNGERIDIRISPYLQDLFDAARADGVYPIVASGYRTTEKQQEIMDEKVAEYKAKGYTSAQAKAEAETWVAVPGTSEHQLGLAVDINADGIHSTGNEVYRWLDENSYRFGFIRRYPPDKTEITGVSNEPWHYRYVGIEAATKIYHQGLCLEEYLNTEK

SEQ ID NO: 4123 - protein, 483 aa, Enterococcus faecium
  misc_feature (B) LOCATION 1...483
  hypothetical: YES
NIRTTKKGEIIMGKKGTPSFLETTLVLMVIVLGIAIGVVGLKVSPNITILAAIGMVMLYAVIKRYPTDWLHEGIINGIKPGIIPIFIFILVGSLIAVWIQAGIIPTLMVIGFKLISVQWFVPSVFVVCAIVGSAVGSAFTVMSTIGIAFFGIGTTLCLNPALVVGAIVSGAVFGDKMSPLSESTNLAAAIVDADLFKHIKHMMWSTVPAFVVSFFLFMILGHTSKAASLSSIREVTDVLEANFTISIWSLIPLFLMLLCAWKKVPAILTILLNIAVAVGMIFIQNPQTSLTKLAGVIESGFVSNTGNQQIDSLLSRGGIESMMPTVSLIILTLSLGGLLIEFGLISTVMERVSRKMTNTPNLIFTTLMTSIGVNIFIGEQFLSVILPGNAFKETYEKAGFDPTVLGRTLEDGGTVINYLVPWGIAGSFVASTFGIPTLTYLPFVFFSLLSPVFSMVSAFTGWGISKKFVKPQEAVSKTAQLEQ

SEQ ID NO: 4124 - protein, 97 aa, Enterococcus faecium
  misc_feature (B) LOCATION 1...97
  hypothetical: YES
GTGTIMQKKHLFFTLSIAFLSLAHLIFSYFYIRMYGYFNLHGHLNSFMTAAWILRFIIDVYIVICGFFAIREERYKVLPFYLLFFLFNLILPFIFHI

SEQ ID NO: 4125 - protein, 262 aa, Enterococcus faecium
  misc_feature (B) LOCATION 1...262
  hypothetical: YES
RHGTMGMKGQKGGNKMKKNLYPAVSMAFILIIWQIVVIVWKIPAFILPGPAAVFSALAADAQVLLSHSVTTLNEAVLGLVIASVLSFITALAMDYWKFLEMSFYPLLVISQMLPIMVLGPLLTLWFGFGMLPKVILVVLISYFPIVVSFSDTLRKVSKEQIIFLKTMGADTGKIYRIYKIPAGLSGFFSGLKVAATYCVSGAVVGEWLSAQAGLGYYMIRVKNSYQIDKVFAAIICVILLSLLLNGACSLLKKGYYRMLYIF

SEQ ID NO: 4126 - protein, 585 aa, Enterococcus faecium
  misc_feature (B) LOCATION 1...585
  hypothetical: YES
VSGTKTMKWKKIYERLFFLILLISLFFGGWQLISHYFQQQIVEQQESYLTKKAQLLIRQLDVENLQAAQNKTALEEFVHQSNERITLMDATGKILFDTNNETLNERRSSRPEIKAVLNGGNLGSALRKSTTLNEDLLYVALPVKKGGQLEAILRIAEPTSGFLPRTESFRRWVFFFFLSFFLVLAGMIYYLIYQKNQPLKTVLPVLRKMVQNPNQAEVIMQTPDQWEELYQTINELSEQMSKMYRAYTTTEEQLYTLLNELMIGVFLIDDADSRLLLLNPKMQLHLNVTSYEPEQRYTEVIQEPKLIQLIHQVTPEHPLIHQEITIAEGRQTLDLSLRYFTNSEGTGQILGVAYDLTKVRRLEKLQKDFVGNVSHELKTPVTSLIGFTETLLDGAKDDPQTLTSFLEIMQKDAIRLDKLIREIIQLSKDGENSYEIQTIYTEPYFQQIVQNYQPIIEKKRLTIRLIGKNEPFTTKTDILYPILKNLIENAVQYSKNDSEIIIRYQATDELSFSVQDFGIGIDIEDQERIFERFYRVDKARSRHSGGTGLGLAIVKDYVQLLHGTITVDSHLGTGSTFTVTIPKSN

SEQ ID NO: 4127 - protein, 207 aa, Enterococcus faecium
  misc_feature (B) LOCATION 1...207
  hypothetical: YES
IGGTTMAKTKTVVTTFDNVSIKRIAFNFKNAGNAIATNCNGQLDGETEMQTVVKKCGATEVKSKSKPINMTVTITAHVPMEVYRRFNGLKQDGRIKPGIYSYGPDSVGEDFSLAAEIVDDFEENRKLVGMLACTSNTGLTFSIENGADEVAALELETKVMQDEFGKFYHEAIVAELEEDLTDQWMTNLSADVIKKTSVVTTTATQSQ

SEQ ID NO: 4128 - protein, 96 aa, Enterococcus faecium
  misc_feature (B) LOCATION 1...96
  hypothetical: YES
YCLTSAFFGSVKIRTRSSVVNFSKAAITGNRPINSGINPNFSKSSGMICCMTLSSSESFWFCVPNPIVFSPIRFFTIVSMPSNAPPTMNNMFVVSI

SEQ ID NO: 4129 - protein, 321 aa, Enterococcus faecium
  misc_feature (B) LOCATION 1...321
  hypothetical: YES
QKLTKIAVEKVSAEEARLMSTGFLFPGQGSQKLGMLADIPEMYMERLENVTGYRLVDKEENYQDTVFIQLALLTKAVFYLDEMEKNGIQPDIAAGHSIGAFCAAVACRSLRFENAAELVYHRAVLMKEAYPSGYAMGVVVGVTRSEAEEIVAKTFDPDHPVYLSNENCPMQHTLSGSIEGLSVTLAEAKRHQAQTAKLLKVPVPSHCLLMNDTVKKFKPYMQSVHLSDARCLYIKNTDGRATQDAEEIRKDLLENLAFPVQWNQMMDLAKELGMDLTIEFPPGNTLTKLIHTKFGVDKGIRTINLDQHGIDDATFLYQKWR

SEQ ID NO: 4130 - protein, 86 aa, Enterococcus faecium
  misc_feature (B) LOCATION 1...86
  hypothetical: YES
IFMTRYEENFKQMIVELNQTGRSVRGLAKEYGLSEATIYKWKNLYLPDQSTGLTGKEVAELRKENARLNEELEILKKAAAIFSRKT

SEQ ID NO: 4131 - protein, 70 aa, Enterococcus faecium
  misc_feature (B) LOCATION 1...70
  hypothetical: YES
SSMTKYKVAKVFIDVHTKETYKVGQEIDLNKERFDEIEKNLEAFGGGFLEPIKIEEKQVKKPTKSTKKKG

SEQ ID NO: 4132 - protein, 128 aa, Enterococcus faecium
  misc_feature (B) LOCATION 1...128
  hypothetical: YES
TAMTKEYWVAVLEQEDRLISNSDRKFRYYCYSLENMSEELAFQERTVYIQEDIVFRSLEQDFMDSVQNEHLSAALSRLTDRQRRVIELHFWQGYQYKEIAVILGCDPSAVTRLLQRAFKQIRIYFLSR

SEQ ID NO: 4133 - protein, 217 aa, Enterococcus faecium
  misc_feature (B) LOCATION 1...217
  hypothetical: YES
SNMTPNREDYLKIILELGGDTTKVNNKQIVSSLDVSAASVSEMISKLVKEELVEHSPYQGVQLTASGLQKASSLIRKHRLWEVFLVEHLDYSWNEVHDDAEVLEHVTSEHLADHLENYLNHPEHCPHGGSIPKKEEVVHEERRQTLESYPVGTKVRIARVLDEKELLDYLVTIDLNINEEYEIVDIAAYEGPITIQNDRKKIPVSFKAASTIFVDKI

SEQ ID NO: 4134 - protein, 197 aa, Enterococcus faecium
  misc_feature (B) LOCATION 1...197
  hypothetical: YES
KDMTHIRRSKLLSLFRIRKDEKMLAAIWAQDENGLIGKEDRLPWRLPNDLKFFKQMTEANTLVMGRKTFEGMGSRPLPNRQTIVLTRDSSYKAEGVHVMHSVEDVLALEKETDGIFFIAGGSAVYQEFLPFCTILYRTVIHHVFDGDAYFPPVDWSDWSLINTSQGEMDEKNRYPHQFETYQRNENPVKSGTGELTI

SEQ ID NO: 4135 - protein, 246 aa, Enterococcus faecium
  misc_feature (B) LOCATION 1...246
  hypothetical: YES
EGMTIIYKRWLFMKKVLVVDDEKPISDIVKFNLAKEGYDVYTAYDGEEALEKVAEVEPDLILLDLMLPKMDGLEVAREVRKTYDMPIIMVTAKDSEIDKVLGLELGADDYVTKPFSNRELVARVKANLRRGATAAKEPEEAAPAELTIGDLTIHPEAYMVTKRGETIELTHREFELLFYLAKHLGQVMTREHLLQTVWGYDYFGDVRTVDVTVRRLREKIEDNPSHPNYLVTRRGVGYYLRNPEQE

SEQ ID NO: 4136 - protein, 544 aa, Enterococcus faecium
  misc_feature (B) LOCATION 1...544
  hypothetical: YES
ISMTFKDKVIYQIYPKSYKDSNGDGIGDLKGIKEKLPYLNDLGIDMIWLNPIYPSPQKDNGYDISDYTAIDPIFGTMEEFEQLIAEAKKYRIEIMLDMVLNHVSTEHEWFKKALAGDQHYQDFFILREEPTDWVSKFGGSAWSPFGDTGKYYLHLYDRTQADLNWRNQAVREELFKVVRFWMEKGVKGFRFDVINVIGKDEQLKNNKENDGKPEYTDKPITHTYLKELNQATFGTDSTIITVGEMSSTTIENCILYTEPSREELSMVFNFHHLKVDYENGNKWSTPPFDFAELKRLFHTWGEKMSEGNGWNALFFNNHDQPRALNRFVAIDQYRKQGAEMLATMIHLNRGTPYIYMGEEIGMIDPDYSSISDYIDVESLNAYKLLLEQGFTEKEAFRRIKAKSRDNSRTPMQWSDTEQAGFTTGKPWLKVGGKLEEINVEKELSSEDSILSYYKKLIRLRKTYPIVAQGDYHAYEANHPEVYGFLRQFEGQQLLVLTNFYDKDTRIAIPEGFTEANILIDNYSDTVLHQSLELKPYQAIALLKN

SEQ ID NO: 4137 - protein, 257 aa, Enterococcus faecium
  misc_feature (B) LOCATION 1...257
  hypothetical: YES
FSMTFLLDLINGVHKFLGYLDISPKYLNRGYTILSVIPTLYLLRIVYGLWQNQNYLQFFLYGLAFLVLVYFTVLNVFYYFLDKNTKADVTQLFVKYLPDEAFNIQTEESIDNGNSIDKVNTQEVMVSYDEDYQLKLAENMRYLIGNGEIKTNELGRMDGFLVDRNTLYPYYYVKKTGEKEYVLNIGRSYSDMEKVGTIRLDSTEDTLEPVGLFIVGGDFVKDGLRYHEPYRLKLIAKKAQSQEEPVVYSRSQRRRHS

SEQ ID NO: 4138 - protein, 321 aa, Enterococcus faecium
  misc_feature (B) LOCATION 1...321
  hypothetical: YES
VQMTYTHLTTDELVMIESYFKINQSVAKTAHCLNRSRQTIHKVYLFFKQGKSALEYYQQYKKNKSNCGRRPLVLPEEQSEYIQRKVVQGWTPDVIVGRAAFPIRCSARTIYRMFKKGLFNPSDLPMKGKRKPNGHQERRGKQAFRRSIHEREKDYSQFSNEFGHLEGDTIVGLKHKSAVITLVERLSKVIITLKPCGRQAIDIENKLNHWFESVPKNLFKSITFDCGKEFSNWKQISNANDIAIYFADPGTPSQRGLNENSNGLLRRDGLLKSMDFNSVDESFIQSVASKRNNIPRKSLNYRTSLEVFLSYVSIDDLSNLI

SEQ ID NO: 4139 - protein, 356 aa, Enterococcus faecium
  misc_feature (B) LOCATION 1...356
  hypothetical: YES
KMMTLIKQPMYQEDLAKVINHTPKIKQLHGKSVLMIGASGMIGSFLIDTLMAANEQLGIKIKVYAMGRNRQKLEKRFASYLELDTFEIVEGDVTEPLPKEIQADYLIHGASNTHPKAYATDPIGTIMTNLAGTEQVLKHAVATQPVRVLFLSTVEIYGENRGDIEKFTEDYCGYIDCNTLRAGYPEGKRVSESLCQAYIAKHDLDIVIPRLCRTFGPTMLLSDTKASSQFILNAVEQKDIVLKSEGNQYFSYVYVGDAVSAILHLLLEGEKGEAYNVSSENFDLRLKELAQQLADISGKQVIFELPDEIEQKGFSKASTAVLENKKIKETGWKPIFPLNESLVHTVELVKGEKYNV

SEQ ID NO: 4140 - protein, 175 aa, Enterococcus faecium
  misc_feature (B) LOCATION 1...175
  hypothetical: YES
EEMTILINNVVLVGRLTKDPDLRYTASGTAVATFTLAVNRNFTNQSGNREADFINCVIWRKSAETLANYARKGTLLGVTGRIQTRSYDNQQGQRVYVTEVVADNFQLLESRSASENRQQSGGFQSSGQSAGGFGGNNNSNQTSQSSNGMPDFDRDTSDPFGSSSTIDISDDDLPF

SEQ ID NO: 4141 - protein, 92 aa, Enterococcus faecium
  misc_feature (B) LOCATION 1...92
  hypothetical: YES
FKVTQSLIENQDLLTFYDFPPSIRRTIYSTNLIESFNKQIKRYSRRKEQFQNEESLERFLVSIFDTYNQKFLNRSHKGFQQVTDTLVSMFTE

SEQ ID NO: 4142 - protein, 61 aa, Enterococcus faecium
  misc_feature (B) LOCATION 1...61
  hypothetical: YES
KRVTRIELATTAWKAVVLPLNYTRMAVPTGIEPAISCVTGRHVNPYTTEPVFLVFNCGSRI

SEQ ID NO: 4143 - protein, 358 aa, Enterococcus faecium
  misc_feature (B) LOCATION 1...358
  hypothetical: YES
VYSTKGQVGKLYTGYDIKIEKVTSTSDTATPYQPNLLDAPYYLSKKTLGKNLLDPTGITSSSYLLLTKTPSEKLLKDQTYTITLKGTKPATQTFRCFVQYETNGSTVNLFDMKPVEGLVDEWQLTFKATRSATDITGRLYVYQVPNTSLGQCKVEWIKLEKGDTRTPNISEYKYCGEGLKDSNNPNDYSWDITPEYAEKGLNNTVSLTEPQSVEGLKNFEDGLQIAGEEVATVAESTGWLALTLVDGFEVAENNPPQYKITYQANGDNEIEFRGEFQLTGGTKFTKDTSYYPFGRANQATNIPNELKPDRTAFGYGATSTGVGGRLAVTTTPTFVFIPGDSDGTYCSISPLRYTQTKK

SEQ ID NO: 4144 - protein, 117 aa, Enterococcus faecium
  misc_feature (B) LOCATION 1...117
  hypothetical: YES
MLTTKESAVILNKLKQIVMLGRQSGFFLILACQRPDAKYLGDGIRDQFNFRVALGRMSELGYSMMFGEVEKNFFMKHIKGRGYVDTGGSVISEFYTPLVPKGYDFLDSISKLEKMND

SEQ ID NO: 4145 - protein, 216 aa, Enterococcus faecium
  misc_feature (B) LOCATION 1...216
  hypothetical: YES
GDATLNKIYICLISLKQNLEKSSFFGQDSLLKNKRKSQREYFAIQKKRHHLIWAVTGAGKTEMLYPILVETLKAGGRVAICTPRVDVCNELFLRYRYVFPEEKITLLHGNTATAYTFTSFVICTIHQLYRFYRSFDLIVIDEIDAFPYNGDAGLAHAVQTAIKPDGRFIYLSATPDKKLLKEIKQTFDIHKLALRFHRRLLPEPVLVFMNNWRQKC

SEQ ID NO: 4146 - protein, 61 aa, Enterococcus faecium
  misc_feature (B) LOCATION 1...61
  hypothetical: YES
FYQTNSESELHFSNTGSAFSLRQISLNWFSQTTLFRHRSLLIRMDYSLQDFFYKINRILPL

SEQ ID NO: 4147 - protein, 291 aa, Enterococcus faecium
  misc_feature (B) LOCATION 1...291
  hypothetical: YES
DHQTFSKRRREKMIQSFIDGLMNYQFLQYALVTSMLVGLASGVIGSFIILRGMSLMGDAISHAVLPGVAISYMFGFSYIFGATAFGMLTAAVIGFVTQRSRLKNDTAIGIVFSSFFALGIILISYAQSATDLYHILFGNVLAVRESDLLLTALVSGIVLIFVFFFYKELKITSFDPTMAKAYGLNTSLIHYLLMFFLTLVAVVSLQTVGTILVIAMLITPAATAYLLTNHLLKMIITAAGIGMLSAVVGVFFSYSYNWPSGATIVLACTAFFILAFLFSPTKGILFQKGSR

SEQ ID NO: 4148 - protein, 71 aa, Enterococcus faecium
  misc_feature (B) LOCATION 1...71
  hypothetical: YES
KCQTYGLKLKGEKDKKVFDRVVEERLKAASVWDDVKDKLHKSALSLSGAQQQRVCIARVLAVNPDIILLMN

SEQ ID NO: 4149 - protein, 523 aa, Enterococcus faecium
  misc_feature (B) LOCATION 1...523
  hypothetical: YES
IMQTIKVKNPILRGFNPDPNILRVKERYYIIVSSFEWLPGIRVYESKNLVNWSHTTDILTTQVSLQGNPTNGSIWAPQISYADGLFYLVYTDVKSAGRPFKDVHNYLITASEITGPWSEPIYLNSNGFDPSLFHDLETGKKWLVNELWDYRLDTPNKSSGIVLQEYDAEKKKLDGPIYKIFAGTELAKTEAPHLYFRNGYYYLMTAEGGTGRGHSVTVCRAKNITGPYELDPGFPMLTASDKPASTLQCTGHGSLVQTPSGRWYMTYLCTRPLNGAAILGRETAIQEVYWTSDDWLRLKDSQTTPMEEIMIETNEEVQQEKDHQFMDTFEGELKKNWNARRILPNADWCDTKCRPGFLRLISGESLQSTFEHHLLAIRQTDFTFDAETAFEYMPNNFNQMAGLVLYLNESNYIYCYVTWNEDKGKCLRMIESENGVAQIEDWTIPLTEKKTFLKVTVKKETAQFHLKDVSTEEWKKVGPQKNMCILSGGFTGNFIGIAVHDLNKKRGSYADFEFFKYDGKDHL

SEQ ID NO: 4150 - protein, 101 aa, Enterococcus faecium
  misc_feature (B) LOCATION 1...101
  hypothetical: YES
EVQTMLLSMNLQLFAHKKGGGSTSNGRDSKSKRLGAKRADGQTVTGGSILYRQRGTKIYPGVNVGIGGDDTLFAKVDGVVRFERKGRNKKQVSVYPVAQEA

SEQ ID NO: 4151 - protein, 225 aa, Enterococcus faecium
  misc_feature (B) LOCATION 1...225
  hypothetical: YES
KQQTVFRLLLFLHKIRPSINRSLVKKMEYKWKANNSSRVSMKQLRKAGHHLNEMIMPNLSLFIAWGILSLATKGVSGDLHTTLEEVCHWMIQLLLPILISYSGGKSVGGQKGAVAGAIASLGLIARSNAPQIVGAMIIGPLAGIVYEQFVSRFHVKFKAGYEMLVSNLLVGLTGSVICIIGIVFIEPVLNSVHLLLASVVSWLVTMNLLPLVSLIVRTSKSTIFQ

SEQ ID NO: 4152 - protein, 160 aa, Enterococcus faecium
  misc_feature (B) LOCATION 1...160
  hypothetical: YES
YDKTRITTWGVYMENKLVEEVIEKLKKENIRITPQRYAVLEYLIEHHSHPTADEIYKALEHRFPNMSVATVYNNLRLFTSIGFVQEMKYGDASSRFDFSSKRHYHVICENCGKIVDFHYPGLEDIEMAASRLTDFEINEHRLELYGLCPDCKESAKKAQM

SEQ ID NO: 4153 - protein, 270 aa, Enterococcus faecium
  misc_feature (B) LOCATION 1...270
  hypothetical: YES
DKKTKNRCRRGQMKQEMMEIVQQKQLAPKIFEMTLKGDLVKEMQQPGQFLHILVPRADLLLRRPISLNHIDHETNTCRIIYRVEGEGTRVFSTLSAGDHLDVMGPLGNGFDLSNLHTGDEVFIIGGGIGVPPLYELSKQLVEKGIKPTHFLGFATHEVVYYEKEFNRLGETRIATDDGTYGMHGNVGNLLLGTKTEPTAVFACGSNGLLKTVEQLFSSHQNVQLSLESRMACGIGACYACVCHTPEDETGTKSVKVCDEGPIFKIGEVII

SEQ ID NO: 4154 - protein, 456 aa, Enterococcus faecium
  misc_feature (B) LOCATION 1...456
  hypothetical: YES
VVKTERRKEDGGELVSSYMCSPETAAEEFEISKKLYAQLTGRSQSEKHDIIMYRIIQSFKPDEVSPEEAHKIGCELAMKFTGGQHQFVVATHTDKRHIHTHIEFNSTNLNCDAKFQNVKNSAFILRRMNDELCRAHGLSVIENPKKKARPQKEMAAAQYGVSHKKQLQQAIDRLLPECNHYEEFLAKMRAEGYEVVDGKNPGFRLPGWDRPTRVNRLGDDYTKTALRARITSQRRRLTSGKTAPKRTGRKVNLLIDIQAKLAAGNGACYERWAKIFNLKEAAKTLNFLIDNNLTDYDQLALRADQAENCFNAVSQKIKQWDARMAGIAQLKTPIIQYSKTREVLPAYKKSRPQKDFSQSMGRKIAQHQTAKEALDALNGQAYPQITQLSADFAPPLEKNREPFYSSRHWRPIDYFSNRTPHLGLKFRNWNPPNRGRKKNLTPRNGKPKTPALFHRX

SEQ ID NO: 4155 - protein, 247 aa, Enterococcus faecium
  misc_feature (B) LOCATION 1...247
  hypothetical: YES
KGETYMEKKELLYEGKAKKIYLTSDENLIWIEYLDQATALNGARKDQISGKGELNNQITSAIFRYLTQRGIKNHFIEQLSKTEQLAKKVQIIPLEVVIRNIAAGSFSKRLGVPEGKEFIKPIIEFYYKDDQLDDPFINEEHIYFLQLAKPEEISELKAQALAINEILTELFAKVGLVLVDFKLEFGRSNGQILLADEVTPDTCRLWDERTNEHMDKDVYRRDLGDLIPVYQEVYNRLSELTEEKERV

SEQ ID NO: 4156 - protein, 510 aa, Enterococcus faecium
  misc_feature (B) LOCATION 1...510
  hypothetical: YES
MMETITYSPLNLFTNFQEAAANFSETPIIFDEPLSAFPELGLETTYKKCCESVLKRAYQLAHLGVKSGDKVIIYKSSAFDTYLLAVSVSYLGAVPVMTSYHLPTTTMEVFIDRLEDPFILFDDETKKRVREISNGTKSKQIPILYLMEQPALSVSQSFLDKNEISYMTHTSGTTGIPKLICHSAHSMGWRTKWQKTVFTKISEKKLIAFHISPVHSRFNIGISSLMSMGFPMMPLANAQSSKVVHMLEAHRPIALETHPNNFVQWRFTAKEHPEAFSGIRYYHSTFDAINNQTMKTFLRTSMAQDAVFLQVYGQSECGPMILKAHTLESLKTSDARDMGVGLEDMTSARITDSVGNVLPENTDGHIQLLSKGRALTYYKEDARFQENVYGDWWDSGDYGFMDKHGHLFLKDRQVDLIETINSTLAIEDFLLDSLDFLAEVVIVRDKNHSPQPIIALAPDKEMDWNRWWEQVHELPRLNVPIIRDFDAIPRTATMKVQRLQIEKELKSQKS

SEQ ID NO: 4157 - protein, 100 aa, Enterococcus faecium
  misc_feature (B) LOCATION 1...100
  hypothetical: YES
EKETNDMKIFAVCQSGLGTSFMVEMNIKQALADLGADVDEFEVSHTDVGSVSSDMADYFFIEHSLKDTLTSIPDEKLVPLQSIIDSEEVKEKVTKILSKE

SEQ ID NO: 4158 - protein, 123 aa, Enterococcus faecium
  misc_feature (B) LOCATION 1...123
  hypothetical: YES
FIWTVSIPIWIKTSIPSFVSSPIACLLGKILVTFPAIGATTSLDVGITAKPSPIIFCENTGSFTSDKGITSPEAAETSSCSIPKYCLLPACPFPVETISGSGISAPDCSRSSISDFKTSAFGP

SEQ ID NO: 4159 - protein, 395 aa, Enterococcus faecium
  misc_feature (B) LOCATION 1...395
  hypothetical: YES
NIWTRRCKIMTVKNLKGVTAASDQLMKAFKDGNEESFSAAMVSLSKEIQDKILEEATAKNQDQLVLMNRGQRVLTTQETKFYNEVVKNEGFAGVEELVPATVFERVFEDLEQSHPLLQKITFVNTTGVTEWIVSRGVNPAWWGKLCEAVKKVLDNGFDVINMKQFKLSGYIPVCKAMLDLGPVWLDRYVRTVLVESLRIALEQAIVDGTGKDMPVGMMRDMSKQTSGEYAEKKAEPITALDAVTMGGLMARLSKFNIEGVNDPIYRNVNPSDVVLIVNPTDYWSKVFPAKTVLTANGEYVQVLPVPVSDLQSTAVPEGKAVIGVASDYFMGVGSTLKIEASDEYHFVEDERIYLAKQYANGQPKRNDSFIVLDISALGTTTTTTKPTTTTTTTQA

SEQ ID NO: 4160 - protein, 62 aa, Enterococcus faecium
  misc_feature (B) LOCATION 1...62
  hypothetical: YES
LGWTYYCKCKLLNTVYQEVVNLPFNSESQGTISKNSFSCLMNIVTCDREVGRRKPFIRKKGL

SEQ ID NO: 4161 - protein, 133 aa, Enterococcus faecium
  misc_feature (B) LOCATION 1...133
  hypothetical: YES
LGWTYYRRCKLLNTVYSKKKDCDTAFVTVPFFRIIIVPLSPSRSQVHYSYELNYFSSFFVEPSSFNIAFLDRFTRPCLSISVTFTRISSPSLTTSSTLLTRSFANWEIWTSPSFPLIKLTNAPNFSIRTTFPR

SEQ ID NO: 4162 - protein, 73 aa, Enterococcus faecium
  misc_feature (B) LOCATION 1...73
  hypothetical: YES
LGWTYYRRCKLLNTVFQEVVSLPFISESQGTISKNSFSCLLNILTCDRGVDRRTSFIRKKRTVTRLLSQSLYL

SEQ ID NO: 4163 - protein, 696 aa, Enterococcus faecium
  misc_feature (B) LOCATION 1...696
  hypothetical: YES
RGWTMEFAELVIVFAVTITLSNIASRILPMIPAPLIQIFLGVVLGLTEWGQSIDFEPELFLVMIIAPLLFREGEKADISSILKNFGTILFLAFGGVILTLVGVGATLSFLLPSVPLAACFAFGAALGPTDAVAVSSLSGRVNIPKKAMHILEGEGLLNDASGVTAFQFALGALITGSFSAVNAGMSLVVSSIGGALIGFLLVWFKQKIIHLIEKASAQDVTGYLLIELLLPFLAYVLAEAFDVSGIIAAVAAGILQASGFRKISVFDAELSSLSHSTWTTIAFTLNALVFIFLGIELTQVFSPVWGDGLYPNGLLLAIIVLISVMLFVIRFISISLFYVFKDGSKKFKKQLNEILILTFGGVKGTVSLATIFILPFSINNMMFYQRSLLLFLTAGVILVTLVIGIIVLPMLTETEEAKSTDLNALMILEEVVEVLRKEIKEIDRNTKEFLATEAVIENYQERIRDLYLEDLTDDEKQEVQEIQALILSIERDGLDESYRSGKLSSNGYRFYSRFLSRFEHSITSQILSFIGFWFIVVRRLMRIVLHPKMFWQRRYADRQTFISDEDIQEIRETYQKNTQLIIESLDNLTDIYDETMVQFFIQQRKLEGIKMNSGNLISSWMIQQDSLFTKKMLRGYYLERKIIDEYEVAEKITTFSANSYRRNINLLESYTMNKPSDNFSFRFAFRAKSKKTSPIK

SEQ ID NO: 4164 - protein, 496 aa, Enterococcus faecium
  misc_feature (B) LOCATION 1...496
  hypothetical: YES
DRWTDRFYYIQGGMSVYQVLLVDDEYMILNGLKKIIDWQSLGFQIVATAENAKEGLAVLEQRQIDLVVTDVTMPEINGLEFIEAAQKERHNFEFMILSGYQEFDYLKGGMQLGAVNYLMKPVNKFELVESLKKIKTRLDQQNEQKNQQEIYQELLFSQWLNEELDEISEEEIIGQISEKQHRIVLIQLARTHDTLINRWLQERQQIFYYQRNYGDRVLITLLLEADEVDGFCCFVQENFPDQEWLISIGEETDSLDKIPETFQQAKDNLQLHQFYGDKDEHVFYAVQAETKDQTIDFSSFRRVLQNKQLEVAQKMITDFFEQFQLAAMMPEDIRYSSFLLFMEIQRELIDLEDEEYLQGIEKIHQAKTVQELQQLLLSFIKKHQRQKKYSDNVEKVIVILHQHYQEPLTLKEVSENLHLNVMYLGQLFKKETKKSFSAYLNHLRMEKAKQLLLHSNQNINEIASEIGYNNTTYFSKLFKKIVGRSPKEYRENSGES

SEQ ID NO: 4165 - protein, 222 aa, Enterococcus faecium
  misc_feature (B) LOCATION 1...222
  hypothetical: YES
INRTEEQQMKVLVTGFDPFGGDKVNPAYEAVKKMPDEISGAEIIKVEVPTVFEKSSQVVKEAIQQHQPDVVICVGQAGGRSAVSFERVAINLAEARIPDNEGNQPFDTALEENGPAAYFTSLPIKAMTKNVQDHGLPAYISYTAGTFVCNDIMYRLLHLIETQFPAIRGGFIHVPFSPDQVIDRPVGTPSMSLEDIASSLTYAVEAAVENKEDISGNAGTTH

SEQ ID NO: 4166 - protein, 76 aa, Enterococcus faecium
  misc_feature (B) LOCATION 1...76
  hypothetical: YES
ATRTTKSHTKLSNQSTEDNRQSLALFTAYIATLELNRKYEGGNAAILSWGIFLENYRVPCCLVKIIRGSNSEEQIS

SEQ ID NO: 4167 - protein, 62 aa, Enterococcus faecium
  misc_feature (B) LOCATION 1...62
  hypothetical: YES
KMRTLTFWISRKNEYVKMNKNNWLNLFFLLLMKIKYVIIKELEWEVSTDGFFVEKTCDPSIK

SEQ ID NO: 4168 - protein, 439 aa, Enterococcus faecium
  misc_feature (B) LOCATION 1...439
  hypothetical: YES
SLRTNVVIVRKLEAFFCWESGFFNKAKIASCLEKLLSFFCQNDSECSFFVLISPSCLLFDTKFMKNQEIVVILGNADKRDWHFILVQLFFQLLGRRDRLFKTYFRFNKIQDNPFRIMNLMLLIFIVLWLGYINHDFLISSFSSLGIFTFFYYQNIPMKYLLKRMFLIGCGLLVAFVLGILSTYVLWLEPFAVALVAFSSRFVLRLFHISKPGGLFFAMLSAMGTSMQLPIAQLPIVSLYFFMGVVFALIAAVITKLLDSRPEQTIEKATLKERFHEEPLVIIDSVFYSAALFLSVYVSHGLNLHNPYWLTLSCASILLAENLDAMKHRQVQYLIGSMGGLCVSAFLSFVPFTQLQTIFLITFLYGIAQFLVARNYAVANIFLNPMALMLSTLIRGAYLISLIEYRFLGIVIGSFIGLGVAWVMTVGLQHYLTVVRQKLE

SEQ ID NO: 4169 - protein, 248 aa, Enterococcus faecium
  misc_feature (B) LOCATION 1...248
  hypothetical: YES
RKRTNTCDMQNMWYKIRNECLREKRMKLVLLRHGESEANFENYWTGWLDVALTEKGKEQAAVAGQKMLEAGLQFDAVYTSVLKRAILTGQVALEEMGQLWLPIIKTWRLNERHYGDLVGKNKDKMKEIYGKDQVKTWRRGYTEVPPLTAENIFDRRYDHLDPHLIPYGESLEMTVNRDHFPLWQDHLAPKLKDRQDLLLVGHGNSIRALTKYLEDVPEDQMDTIDIPNAQPIQYTLADDLTILDKKIL

SEQ ID NO: 4170 - protein, 62 aa, Enterococcus faecium
  misc_feature (B) LOCATION 1...62
  hypothetical: YES
NRRTNICAKRGYDKIFVTTSNSRCSKARFSALSQIHTKMWKGTFKKILYLFYQKILFMMVTE

SEQ ID NO: 4171 - protein, 472 aa, Enterococcus faecium
  misc_feature (B) LOCATION 1...472
  hypothetical: YES
KLRTSIKNFNLWKEWYLYIFFIGMIIRAINFYSLLPSTFDSIFFKLIGISGVLLLGIDFIIKFNKRKVTYNILLIAYMVILVITSFVHKEYGLGENLKTIMWAILQYFLIYQFAFENSDNKRFFKRISWGFIYSWFVLVSMSMVLFFGKFGYEKYYNARHRIRIGFLESRLFGTFSDINNAAIASLVVIVLILFYLYNKKVTGLNKIIFLINLPLQFIYIVLSGSRSTYVVSIIIVAISSFIVVLKRNGTKKDLKNYILAIVSSIGSVLILFALFNATKILFQELLPHLKEINFFNFTERHKELMNNSQHINNTQTPDNTLVRKDVAENTDISNARITIWKSAWEIFKTSWLIGVSPKNVVSYAQSIIPDGYIAKVGIAIHNAYLNVLTSTGILGIIPFMAFLIKSFVLNVYRIIYNKCIGKDYHFVYCLVILSYALYAALNNELVYENTVGTFVFWLFLGRVNSKNNSSYF

SEQ ID NO: 4172 - protein, 241 aa, Enterococcus faecium
  misc_feature (B) LOCATION 1...241
  hypothetical: YES
KRRTTKMSNVVYQLTTEDVSHFLTNKEHLNEVIRRIQKDFSCMEEMKYFIQRVEEQLYLESETSQTKVTVSHNRLDVYKRRPETVKKGTELLRLETEKYIMNVYLERSELVENFVSYTICRKHYYSESEYYSIFESMELMEEEMEELNSKDATIDDYYLVFTRFLTCGTESIVLMGMDYELAVPEAFLREYVEEVDNPGDDWYTTLTDFLDTYTYDDTEEIQNELDRKRMPYQRFERKKRQ

SEQ ID NO: 4173 - protein, 441 aa, Enterococcus faecium
  misc_feature (B) LOCATION 1...441
  hypothetical: YES
SLGTAPFFSRRFFIEEEFFMEKQLPSPVRILMYMLKWLVITAILGVFMGNLSAFFLNSLTFVTDIRLAHPWLLYLLPVSGALFAYLYAYHGGLSSRGNKLVIDQGNGGEEKIPLRLIPLTLFGTITTHLFGGSVGREGTAVQMGGALADNIAHLFRLDKAEREILIISGISAGFSSVFGTPLAGTLFGLEVLTIGKVRTEAIFPSFFAALFANFMTESYGVSHLHYQMGVIPEWSMLLFFKVFVAGIAFGLIGWVFSRSIVFLKARYAQWIPHPVWRNTIGGAVVVAAALILQTQRYLGLSLPLLQESFNEQAHAYDFIGKLFFTVLSLGAGYQGGEVTPLFEIGATLGAVLAPLLHVSVPFLVGLGFIGVFSGATNTPIACFVMGIELFGSQAAAYFFMICLISFMCSGNSGIYSAQQVAVKKGILFLPIVKRIKEKNKV

SEQ ID NO: 4174 - protein, 847 aa, Enterococcus faecium
  misc_feature (B) LOCATION 1...847
  hypothetical: YES
FFFALFSIVTEIFSKEKLKNSFIIKIIFSRFNSFKKEIPAKNSLVCFFVLLFAIISEIKPLVEVTLLPRKNTRKKQNRRKKEKWFVPKIIFRVFQSLTVFITVLLLMFAALGIGIGAGYFAYLVENTQLPTKKALQTELGNITETSKIVYADNTEISKIQTDLMRTTISSDKISPLLKTAIISTEDEYFDKHQGYVPKAVLRALVSEATGIGSSGGSTLTQQLVKQQILTDETTFKRKANEIILSAQVEKYFSKDEIIATYLNVSPFGRNNKGQNIAGVQEAAKGIFGVDAKDVTLPQAAYIAGLPQSPITYSPYTNTGALKEDLSAGLARKDFVLFSMYREGQITKEQYEEAKAYDLTKDFLPQQIAEQTDREFLYYTVMNEATRIIAQQLAEKDNADMSDSSVSDAYYQKAQQTIQNKGYTIHSTIDKDVYAALQNGVENYGYMLDDGAGSQVETGNVLMDNRTGRIYGFVGGRNYSQNQNNHAFDTERQAGSSIKPVLVYGPAIDMGLIGSESRVSDYATTWQEGENAGEKIVNATNEGSNTFQTVRESLEWSNNIPAYHLYQDVLNSGGSKQYAYEHYLAKMNYPANDNWGVESAPLGTVDVTTLQQTNGFQALANGGVYEEGYIIDSITDNAGNVIYKHESNSVRIYSEATASIMNDMMRSVINAKITTPFKDAISSLNGNLGKADWVGKTGSTNEYRDSWLIVSTPSITISSWAGHDDNTGMDSKARIRSANYLANLINQAYQAKPDIFGTDEKFELSSDVMKKKVSGFTGQTPGKVTVNKKSIQTPGKTVESLWAKNGPKKSAFKFGVGGTDENYTDYWNTASAYARANQATKESDEKDD

SEQ ID NO: 4175 - protein, 240 aa, Enterococcus faecium
  misc_feature (B) LOCATION 1...240
  hypothetical: YES
PRFAAFFLRKRSYIMTQISIAIDGPASSGKSTVAKILAKELNYIYTDTGAMYRAVTYLAITNNVSFSDEEGLVSLIKKYPISFSQQEDGQHVFIASKDVTLEIRQPDVTKAVSEVSAHGKVREELVAVQRKIGERGGVVMDGRDIGTAVLPNAEVKIFLVASVSERAERRFKENQEKGIPTDLETLTKEIQERDHYDSTRDVSPLKQAEDAVRIDTTGKSIPEVVAAIKAVVLKKGYLLF

SEQ ID NO: 4176 - protein, 234 aa, Enterococcus faecium
  misc_feature (B) LOCATION 1...234
  hypothetical: YES
ACLACLLSLKRRNYMSLKKYSFLSIFCYGLIFISPLILASIGLVKSTSELITATAVMYILGAVVLAIFYFKQREPLAIESAVKKASAPKIVIYGLVGIFVALILQSIAVMLESVLFGKATPSENTQNIIQMIMEAPAFILATTVAGPIMEEFVFRRSILGIISRYSNFWVGAVISSLLFAFAHNDGHLLIYFFLSFFFSLEYKATGRIWTSMITHVGMNTLVVLVQLAVQKGLV

SEQ ID NO: 4177 - protein, 269 aa, Enterococcus faecium
  misc_feature (B) LOCATION 1...269
  hypothetical: YES
ITIAPKDVQFQSAKLWQRMLTNFAGPMNNFILAILLFIILAFMQGGVQVTNTNRVGEIMPNGAAAEAGLKENDEVVSVDGKEIHSWNDLTTVITKNPDKTLDFKIEREGQVQSVDVTPKSVESNGEKVGQLGIKAPMNTGFMDKIIGGTRQAFSGSLEIFKALGSLFTGFSLDKLGGPVMMYQLSSEAANQGVTTVISLMALLSMNLGIVNLLPIPALDGGKLVLNIFEGIRGKPLSQEKEGILTLAGFGFLMLLMVLVTWNDIQRFFF

SEQ ID NO: 4178 - protein, 130 aa, Enterococcus faecium
  misc_feature (B) LOCATION 1...130
  hypothetical: YES
FVYFFVYAMMEIDKKELILMKTSTKVTIGLSVAAAASVATAVVVSGKVMEKIHHMTTRTKVKKFVYDKFDGNEKLLEIVDGLSDSDLDSLMGMLAKIKSGKKKISVYGDSIKDSTEDVKDRLMHFVEKMM

SEQ ID NO: 4179 - protein, 81 aa, Enterococcus faecium
  misc_feature (B) LOCATION 1...81
  hypothetical: YES
RVIASLFICPEGGITVAKAKTPFEKAASKILERRGVSETQWKQEVLEKAQFDLLRGKDKDLEGYIYQREREKLVFDEIIKH

SEQ ID NO: 4180 - protein, 74 aa, Enterococcus faecium
  misc_feature (B) LOCATION 1...74
  hypothetical: YES
RTIAMEIPGLQRNVASSSYSFVRFFGGALAPFIAGVIGEHIGESYAFYFAGAIVLISVCCIIYHRNYFATNEEE

SEQ ID NO: 4181 - protein, 99 aa, Enterococcus faecium
  misc_feature (B) LOCATION 1...99
  hypothetical: YES
RAIAAPMTSAISVAIMANSVKIHKMTPNVLLVRARIACAKSIWLTIPNFAAIYCKSIAIRLDIKITDINKYWKFCPPVIEVDQLPGSIYPTATNAPGPE

SEQ ID NO: 4182 - protein, 102 aa, Enterococcus faecium
  misc_feature (B) LOCATION 1...102
  hypothetical: YES
EGVASASAVYTCLERETKVFFTFVPRSLFFYFVWINSFNSSIEIDSSKISLPKMTVGTNRICACSASLMTAWLSCSSFCSVSFSLSTAKSATSWRERCFHSS

SEQ ID NO: 4183 - protein, 181 aa, Enterococcus faecium
  misc_feature (B) LOCATION 1...181
  hypothetical: YES
GRVAMGVPKEGEFVTIQSYKHDGKLHRTWRDTMVLKTSEHSMIGVNDHTLVTESDGRRWVTREPAIVYFHKKYWFNVIAMIREKGVSYYCNLASPFLLDDEALKYIDYDLDIKVFPDGEKRLLDVDEYEMHSKMMNYPNDIDFILKENVKILVDWINNGDGPFSEGYIDIWYNRYKQLSRK

SEQ ID NO: 4184 - protein, 71 aa, Enterococcus faecium
  misc_feature (B) LOCATION 1...71
  hypothetical: YES
LFLFIKKHVVTLRQIIVHSDVSRVTTPNITRHHINLSALVPKLASLSNIFSYIIKFAFTPLISPNRLACVV

SEQ ID NO: 4185 - protein, 310 aa, Enterococcus faecium
  misc_feature (B) LOCATION 1...310
  hypothetical: YES
SISAIIKNAKKRKNHNKKVWMGWIIMKLLHLQYFKKVFETKNVTQAAKELFISQPALSRAIKHLENELGVPLFYHSGRNIETTVYAEEFYPYAVKTLDTLEEGIKLLSSVNEKIVTSVILYLEVASVSIPNLVRIFMEKHPDIQLTIMQHHLPDDITDPVLYITSEMKPGMTNIPIMKEPVYVAIPKKHPLAKKEHLQLEDIQRTPILMLSKSNAFRHTLDAALEAKSIELTISSTTDDPATLRSIVKQGLAVSFFPKVSWSYDKNDPFVLREIKDLPLTRTIYLSSSFTEDHPLIKMIAKTMREFYLGK

SEQ ID NO: 4186 - protein, 74 aa, Enterococcus faecium
  misc_feature (B) LOCATION 1...74
  hypothetical: YES
KVSATDPKCASLQLFKRTIGMLKQPHQSIKTQCVRLSQLLQFQTTNYDSSWQNIFNQINRTERGFLLSVLSKLF

SEQ ID NO: 4187 - protein, 74 aa, Enterococcus faecium; identical to SEQ ID NO: 4186
  misc_feature (B) LOCATION 1...74
  hypothetical: YES

SEQ ID NO: 4188 - protein, 74 aa, Enterococcus faecium; identical to SEQ ID NO: 4186
  misc_feature (B) LOCATION 1...74
  hypothetical: YES

SEQ ID NO: 4189 - protein, 74 aa, Enterococcus faecium; identical to SEQ ID NO: 4186
  misc_feature (B) LOCATION 1...74
  hypothetical: YES

SEQ ID NO: 4190 - protein, 74 aa, Enterococcus faecium; identical to SEQ ID NO: 4186
  misc_feature (B) LOCATION 1...74
  hypothetical: YES

SEQ ID NO: 4191 - protein, 828 aa, Enterococcus faecium
  misc_feature (B) LOCATION 1...828
  hypothetical: YES
TDSAGFFVIFIIETSVFNRTGGQQMSYNHKEIEEKWQKYWAKTNTFNTHDDPEKPKFYALDMFPYPSGQGLHVGHPEGYTATDILSRVKRSQGYNVLHPMGWDAFGLPAEQYALDTGNDPAEFTQKNIETFRRQINSLGFSYDWNREVNTTDPEYYKWTQWIFTKLYEKGLAYEAEVAVNWVPELGTVISNEEVIDGKSERGGYDVVRKPMRQWMLKITAYADRLLDDLELVDWPESIKEMQRNWIGRSVGANIEFKVAGTDKSYTVFTTRPDTLFGATYSVLAPELDLVREITTPEQKAAVEAYIEETAKKSDLKRTDLAKEKTGVFTGAYAINPVNGKEIPIWIADYVLSSYGTGAIMAVPAHDERDFEFAQTFGLEILPVIEGGDVEKAAYTEDGTHINSEFLDGMNKQEAIDKMNEWLEENGVGKKEVSYRLRDWLFSRQRYWGEPIPIIHWEDGTVTAVPEEELPLRLPKTKNIKPSGTGESPLANIEEWVNVVDPVTGKKGRRETNTMPQWAGSSWYYLRYIDPHNKKELADYEKLKRWLPVDIYIGGAEHAVLHLLYARFWHKFLYDIGVVPTKEPFQKLYNQGMILGENNEKMSKSRGNVVNPDDVVETYGADTLRMYEMFMGPLDASIAWSENGLEGSRKFLDRVWRLIVDENNKMRDRITTLNDGKLDKVYHQTVKKVTEDYENLHFNTAISQLMVFINEAYKVDALPYEYIEGFVQLLAPIAPHMGEELWAILGNDGGISYAPWPTYDEAALVEDEVEVVFQVNGKVRAKSNVPRDLGKDELEKAALANEIVQEYIEGKTVRKVIAVPNKLVNIVAN

SEQ ID NO: 4192 - protein, 110 aa, Enterococcus faecium
  misc_feature (B) LOCATION 1...110
  hypothetical: YES
ADSAAFGSLLGSLGVAFISDLFSKRLKMPVTIFNIPGMVPLVPGGLAYQAVRNLVTESYREAAHYAVQAIMIAGAIALGLVLSEVFNHNIRNFKVKRDAIMMKRKKRLFK

SEQ ID NO: 4193 - protein, 277 aa, Enterococcus faecium
  misc_feature (B) LOCATION 1...277
  hypothetical: YES
DVSAERVGEMTRLRAADIAAGYENKKIIENMSVTIPEGKITSLIGPNGSGKSTLLKSFTRILPVKSGKIIVNDSDISTYSSKELAKKIALLAQTSEHPIGMTVEEVVSYGRYPYQKLFSGMDAQDHEAIEWALDATGLSGYRTRDIATLSGGQTQRVWIAMALAQETDILILDEPTTFLDPSHQLEILQLLSQINQIKQTTILMSIHDINLASRFSDYLLGMKDGELITEGTPEEVITKECMKKIFEIDATIVTLPKTNKPVFLTYDLLPKEQEDQL

SEQ ID NO: 4194 - protein, 73 aa, Enterococcus faecium
  misc_feature (B) LOCATION 1...73
  hypothetical: YES
ALSAGIMLNNLLTTVQTPLKCIGLLAPHKPSVIPVILTKVLALSQYISSTSGLNIAVALPLVHTSISLSKSLG

SEQ ID NO: 4195 - protein, 64 aa, Enterococcus faecium
  misc_feature (B) LOCATION 1...64
  hypothetical: YES
CSPANSSVISSMDQELFFVWLFLSLGAGQLFHDLSTKQYSNCCFSVISPTKRKIGGAIFVWLFL

SEQ ID NO: 4196 - protein, 297 aa, Enterococcus faecium
  misc_feature (B) LOCATION 1...297
  hypothetical: YES
RCPADQPEKIGTDRSWDFRWASDPLSDRRLLDMMKKFFLFFLLLVSVGWPVATHADTATVNDEAGLFTTDQIQSLEQQAEKLNEKIKGRVLIVTTTSNSEEPRDFADNYLRDAVGNDQNGSVLLLDMGQREIYISTSGNMIDYLTDSRIDSILDDVYDQMTNAAYYNAAKAYLSKSATYVEDGVPGGHYRVDEETGKITRYKVLTTVEIIIAVVLALILSLVFYFVTVSRYQLKSGIYKYPFREKSSIKLTEKTDRLTNSFVTTRRIPKSPPPGSGGGGSTTHSSGGGTFGGGGRSF

SEQ ID NO: 4197 - protein, 426 aa, Enterococcus faecium
  misc_feature (B) LOCATION 1...426
  hypothetical: YES
LSPASYDTWIETANPRTLDQNQLVVEVPSKIHKEYWEKNLATKIVEVGYMLSGNEIIPRFITGEEAEQEEVIEEKNPKVVAPSPLKKAMLNPKYTFDTFVIGKGNQMAHAAALVVAEDPGSIYNPLFFYGGVGLGKTHLMHAIGHQMLQSQPNAKVKYVSSETFANDFINSIQNKTAEEFRQEYRNVDLLLVDDIQFFAEKEATQEEFFHTFNALYNEGKQIVLTSDRLPNEIPKLQERLVSRFAWGLSVDITPPDLETRTAILRKKAAAERLEIPDDTLSYIAGQIDSNIRELEGALVRVQAFAAMNSEDISTSLAADALKTLKSGKGHPQLSILQIQEEVAKYYHIQLKDLKGKKRVKSIVVPRQIAMYLARELTDNSLPKIGAEFGGKDHTTVIHAHEKIQQLMDSSVSMQNEVSEIKNFLLN

SEQ ID NO: 4198 - protein, 68 aa, Enterococcus faecium
  misc_feature (B) LOCATION 1...68
  hypothetical: YES
RKPAISTGANNVEKNVPIGSKIKFISDEIMINAAMINNSSDQNISLDCLSFSNNRFPPFFLTSIYYIR

SEQ ID NO: 4199 - protein, 207 aa, Enterococcus faecium
  misc_feature (B) LOCATION 1...207
  hypothetical: YES
AEPAQCAESSGMAGLVGGNGGNPAGNGRYRAGGCHGRAGRCHLCNGYRCQCCGGGGYGMKKEEAKDIPIGGEIAVRQTGVPYGWLYRRTEPGYLLANGIALLECERDSAGRYKGGAGLDGMYLQTGRLYVPVLAGDGNVRAFQEVIPENYLAAAEMSVEGNYNQIDGIINNEPPKPSVLDALNQCREDAAKGRDAPENPPRGPKWNE

SEQ ID NO: 4200 - protein, 473 aa, Enterococcus faecium
  misc_feature (B) LOCATION 1...473
  hypothetical: YES
RHYFMVRSVYMNKNGEWNAARRIFIILMDVLVLNVSIYLSFLLKFQGEVPVRNLETFQHSAIFISIIFIALNILLGAYVFYNRMISDIVFITVIGQVLIALGIMVVTFAGRWFAFPRGVILISFILGTILLSVYRIVVYKLYLRVSRDKKVLIVGLEKDVAPAIQNFQSKKNNKHKVEAVAIDNYYENTKKLIDDMDIVYLASKIPEDEKINIYQLVTKKEKKLFLNTTFENLTMINPNIMNFEDESIIEASGFRIQPEYELFKRLFDIIVSLILLILASPFMLITAILVKTTSPGPIIYKQVRITKNQKEFSIYKFRSMSATAEAKSGPVLAKSNDARVTPVGKFIRAVRFDELPQIFNVLKGDMSIVGPRPERPFFVDQFNEENPYYYLRHNVRAGITGYAQVYGKYVSDYNSKLRFDLLYIKKYSLLLDLKILLQTIKILFDKMSSQGLDEDENISSLAEIDFSQEKIYR

SEQ ID NO: 4201 - protein, 857 aa, Enterococcus faecium
  misc_feature (B) LOCATION 1...857
  hypothetical: YES
KVYASLIGGTLFISVLYWIGEVCKYPENEIDRGSHMKNKWTNRSKKKKITQKSSDKVIRLFPSYKEGLTAEQVKERIEKGAANDSVDPTFKTNQQIILENIFTYFNLIFLILAILLCLVESYKNLTFLPVIIANTGIAIFQEIRSKKVLDELSVLNTAKVNVIREGIEQTVDIENLVLDDIVILETGHQIPADAEVVEGKLQVNEALLTGEADEITKEIGDPLMSGSFVVSGKAYARLDKVGADSYISQLTVKAKTMGEGEQSEMIASLNQLIKWIGIIIIPIGILLFSQSYFFNGNTMKESVVAMEAALIGMIPEGLYLLTTIALALSATKLAKQRVLLHNMKSIETLARVNVLCVDKTGTITENKMSVQKVIVSKKQKIISQSDQLEERIADYAKAMAGDNATMEAVKEYFTKTTDQSYHQVIPFSSVQKFSSVALGDKAYVLGAPEMVLRDQLPEYAEEFVSFAEKGYRVLVFGVYDGILEEPVLTEAVTPLGYILIANPIRKEAKATFNYFKKQQVAIKVISGDNPLTVSNVAVQAGISHADQYVDASKLSEEEYEAAVEKYTVFGRVKPEQKKIFVQLLKRNNTVAMTGDGVNDILAMKEADCSIAMASGNEAAMQASQVVLIDSDFSRMPEVVAEGRRVVNNIERSASLFLVKNIFSFLLSLFSVIFALTYPLEPSQITLISLFTIGLPSFLLALEENKKRIRGKFIMNVMEKAVPGGLTDMIVVGALVICGVTLDLNKTDVSTASTMLLIAVGFLVLYKICSPLNKFRSQIILFCASGIFFSVVFLHKLFSITGISAVSLLLLSILFFSADSIFRHLTTLVEYLFERKNEKEPEIINKLPRFLRVFKRNK

SEQ ID NO: 4202 - protein, 238 aa, Enterococcus faecium
  misc_feature (B) LOCATION 1...238
  hypothetical: YES
KKYAGVMKLMLYILKLAFVIQLIGTVALSFVFVPEFGWLKGIWYSLFHAISSFCNAGFDLLGDSLANHQQKVYLIMVVSALIISGGLGFIVWRDLLEYHQKKKMTIHSKIALTVTGTLLLSGFVVCFFTERNGATLVEGNMYQLLANTFFMSVTPRTAGYYSVDYLHMSHAGLILTMFLMYIGGTSGSTAGRIENNYVRCVADPHAFDVERTYESGSIWPYHPTRRSGCGHLLYFLLR

SEQ ID NO: 4203 - protein, 174 aa, Enterococcus faecium
  misc_feature (B) LOCATION 1...174
  hypothetical: YES
MDYLDMLCESVDRAYDRFERLFEGVSIEEANRFPVEDRAPQIKSMTWLAWHTARELDFQIADLAGTSPIWHSQDWESRFPMTIADNEQDWKHSLEQAKQIQANQIEDLLGYLRGAADFAISYLRRLEPSELDEVIDENWTPPVTRGMRLVSIIDDAAMHSGQVIYARRLLGLRD

SEQ ID NO: 4204 - protein, 85 aa, Enterococcus faecium
  misc_feature (B) LOCATION 1...85
  hypothetical: YES
SDNAKNHFAASDTHHDPIIRQSVRYLIKRHTIISAIGVVELLQTGKIIVARTTQSTYVYLIIAIMYLILITALTKLAKVLEKKVK

SEQ ID NO: 4205 - protein, 291 aa, Enterococcus faecium
  misc_feature (B) LOCATION 1...291
  hypothetical: YES
MANALEINNLKKIYGSGVEALRGIDLSVKEGDFYALLGPNGAGKSTTIGIITSLVNKTSGKVNVFGYDLDKDLVRAKQQIGLVPQEFNFNPFETVQQIVVNQAGYYGVSRKEAMKRSEKYLKQSNLWEKRNVRARMLSGGMKRRLMIARALMHEPRLLILDEPTAGVDIELRREMWEFLRELNENGTTIILTTHYLEEAEMLCRNIGIIQSGELIENTSMKELLSKLQFETFIFDLAPYDTKPVIEGYACTFEDEQTIAVEVERHQGGTGFLNRLTRQGIQFLSMRNKSIR

SEQ ID NO: 4206 - protein, 293 aa, Enterococcus faecium
  misc_feature (B) LOCATION 1...293
  hypothetical: YES
RRNAFCYGFASQISIASPISPDGRTYARKTLFGGRSIMRQLIAFAKKELMENWRTGKIITLSALTVIFGIMNPLLAKLTPYLVQTMSTTLAESGISVQKITVDATTSWTQFYKNIPMLLIFFLLLFSGILTSEYQNGTIINLLTKGMKRWKIFLSKWIMGILFWSVSYWCCYSITLAYTIYYWDQSIISHPLFISFTYYFFGCWLYSLILFYSAFLSSNYAVLLASGGTVILSYGAGLFSKVAEYVPTYLISSSNYLTKEIHLTDYTQSLAVTCCSIVISIVAGWLVFNKKEV

SEQ ID NO: 4207 - protein, 200 aa, Enterococcus faecium
  misc_feature (B) LOCATION 1...200
  hypothetical: YES
PKNATVKISASMIQSGESEETWTTFFEYLKERGLQGTELVISDAHKGLVSAIRKSFTNVSWQRCQVHFLRNIFTTIPKKNSKSFREAVKGIFKFTDINLAREAKNRLIHDYIDQPKYSKACASLDDGFEDAFQYTVQGNSHNRLKSTNLIERLNQEVRRREKIIRIFPNQTSANRLIGAVLMDLHDEWIYSSRKYINFDK

SEQ ID NO: 4208 - protein, 256 aa, Enterococcus faecium
  misc_feature (B) LOCATION 1...256
  hypothetical: YES
LVDAGSSCVRRTIFCSDNRKNRSVEGNWIRRRKSMKAIEFKEVEKSFQDGDQVVKALKETTMSIDKGEFVAIIGPSGSGKSTFLTLAGGLQTPSSGSVFINDQEFSNQKESERVKLRFKEIGFILQASNLVPFLTVKKQLLLVDKIKHEHRQKEAKELFEQLGVDKLINKYPEELSGGERQRVAIARALYNDPSIILADEPTASLDSEKAREVVDILAKESKDKNKATIMVTHDTRLIDKCDRIFMMEDGVLKEKE

SEQ ID NO: 4209 - protein, 391 aa, Enterococcus faecium
  misc_feature (B) LOCATION 1...391
  hypothetical: YES
GGDAVKKRKKIDWWILGPYLTLSMIGLLEVYSASSYRLLQADENTKSLLLRQLIFIFLSWSVIFLARSVKLHYLLHPKIAGYGLALSIFFLVLVRIGIFGVTVNGAQRWISLFGIQFQPSELANLFLIFYLSWFFRDGNSSPKDLKKPFLITVGITFLILFQPKIAGALMILSIAWVIFWAAAVPFKKGIYLIVTFSALLIGAAGGVLYLGNKGWLPQMFNHAYERIATLRDSFIDSHGAGYQMTHSFYALYNGGIFGRGLGNSITKKGYLPETETDFIFSIITEELGLIGALCVLFLLFSLCMRIFCLSSRCKNQQAGLFLLGFGTLLFVQTIMNVGSIAGLMPMTGVPLPFVSYGGTSYLILSLGIGITLNISSKIQAEELPLYRPEKQ

SEQ ID NO: 4210 - protein, 193 aa, Enterococcus faecium
  misc_feature (B) LOCATION 1...193
  hypothetical: YES
FGXAHHYFMAAPQKSIRGSDVDAALHYLARLVEAGDLASICRRLMVIGYEDIGLGNPAAAARTVNAVLAAEKLGLPEARIPLADVVVDLCLSPKSNSAYMALDAALADIREGKAGDVPDHLRDSHYKGAKSLNRGVGYQYPHHFDQAWVNQQYLPDKLKNAQYYQPKDTGKYEQALGQQYYRIKEWKKHPPKN

SEQ ID NO: 4211 - protein, 352 aa, Enterococcus faecium
  misc_feature (B) LOCATION 1...352
  hypothetical: YES
GGYLKMKKKLFSQLWIYFASIVFISILVTLLCFLGFIFLLSRHSISPAESAGKPTLYPLFVFAGFSMVVGTGISIFVGRRILHPISALGTNMSLVATGDFSIRMDEQQKVAEVQQLYKDFNVMVQELNSIETLRNDFVSSVSHEFKTPLATIQGYVQLLQAPNLSDEERQIFLYRIIESITQLSQLTENILKLNKLENQRIQLEKKEYRLDEQIREVIVFFQPKWEKEQLELDIELAAVNYTGNEEFLYQVWLNIMDNAIKYNQINGQIHIKLFETATEIVLEVTDSGVGMNEETRDRMFEKFYQGDTSRQISGNGLGLSLVKKILELHDGRIDYSSIEGVGTTAMIRLSKQ

SEQ ID NO: 4212 - protein, 310 aa, Enterococcus faecium
  misc_feature (B) LOCATION 1...310
  hypothetical: YES
SSCAICRKRRSLHALCRPAPRRKYQNGRSSPRRRTMKFGTQDQAFFPRDILEKFRFIKDCGFEEYEIDGKLLIENIDTVKQAIKETGIPVVTACNGYDGWIGDFIEERRLNGVRQIAEILRALSEVGGKGIVIPAAWGMFTYRLPPMVSPRSKEGDYKAVSESLRYLDKVAEETGTVIYLEPLNRYQDHMINLLADARHYIDSNQLKHVQIIADFYHMNIEEDDISKALTTQKEYVGHIHLADNHRYQPGSGAIDFTRHFQTLLQNEYEGYMVYECRLRGENEVKIYQESLQYLKNCLETARHLNDLEKE

SEQ ID NO: 4213 - protein, 73 aa, Enterococcus faecium
  misc_feature (B) LOCATION 1...73
  hypothetical: YES
VISAANTGMTNQQRTTRKPFSPAFKEANGPTSPTTPKPAEAGVPEIENRATRIVVLMITNTIARRFDSDSALF

SEQ ID NO: 4214 - protein, 172 aa, Enterococcus faecium
  misc_feature (B) LOCATION 1...172
  hypothetical: YES
VISAAKTGMTNQQRTTRKPFSPASKEANGPTSPTTPKPAEAGVPEIENRATGIAVITALTKQGIRITGFLNRLGIIIFIAPKAIAIVTPDLLTFQEFTTKTKVVAATPIAAAPAETPSSWIAIPIATVEIGEIIKKAKEQPIKIDINSGCKVVKLLINDPIAEVIAVTKGNK

SEQ ID NO: 4215 - protein, 305 aa, Enterococcus faecium
  misc_feature (B) LOCATION 1...305
  hypothetical: YES
SSSAPETMAWRVMLGLAAVPALILFFGVLALPESPRFLMQSGRLEEAKRVLNYIRTPKEAEQEFEQIQLNVKQEKTTGTSWHTLFLEKYRSLVIAGIGVAVFQQFQGANAIFYYIPLIVEKATGHAASDALMWPIIQGIILVAGSLLFLVIADKFNRRTLLKIGGSVMGLSFILPAVLGTVLDAHTNSLLILLFLCIYVAFYSCTWAPLTWVIVGEIFPLAVRGRASGLASSFNWIGSFLVGLLFPVMTASMSQEIVFGIFGIICFLGVLFIQEIVPETRGKSLQEIEQSASKKTYPKRISIHHS

SEQ ID NO: 4216 - protein, 234 aa, Enterococcus faecium
  misc_feature (B) LOCATION 1...234
  hypothetical: YES
DNSAILFFGGERVSKINPLTLITLNIFFPVIIFLGKGNIFQVGCFIIATVLVLMFRKIKTCIYFILIYSVLFLVMKIIDAIKIEFFTIFFGTSLYIVFRMLPVVMISWLLVSVYTSNELLSSLEKIHLPKKIMLSITVVIRFFPTYRSEIRMIKESLKMRNIRLSFFQPLQYLEFLLVPVLIRATMIAEEMTANAITKGIESPVKRSSYYKTNMSLLDYIILFSVTIFFLSILI

SEQ ID NO: 4217 - protein, 565 aa, Enterococcus faecium
  misc_feature (B) LOCATION 1...565
  hypothetical: YES
RNSAILKLTNQGTERDMGQREFIVLIIIAVVILLVVLDIFSRLKVKETVRSNWGKIPYQPRFDKEESLKDAWLTEKKFRSWDSEIDDLTWYDLDMFEVFEGINSTYSSVGSEALYQRLRSFDFGEDYQLEKLIAFYQENPQLRERIQYQFARLGKKDHNFAKQYLADGKSKKIGRVGLFIFLGLLPLVGVGLLLLGQVLGIYLAIGGLVFNTVYYLVKKQTLETELNSMSYLVSTISAANQLAKMTTPLQKELKQQTKPLRDIPKLGFSFRMKSGSEAELIFEYVNIMFMLPFISYHFVLTKLEKHSTEAIKLWELLGELEVAAAVLNYRTYMPITCRPEFTEGGVTAKDIYHPLLKEAVVNPVNWQKNTLVTGSNASGKSTYVKSIAISCILAQTIQTAIAEQFTLQPGHVLTSMAIEDDLFEGDSYFVSEIKSIKRLLDQVASKERCYCFVDEILKGTNTIERIASSASVVRWLAEYPSLAFVATHDIELTEILKNYCENVHFEEQVTEGKGISFDFKLKEGPSRTRNAIALLKVLNYPKSIVEQAQKESLLFDEQRQWYPFD

SEQ ID NO: 4218 - protein, 158 aa, Enterococcus faecium
  misc_feature (B) LOCATION 1...158
  hypothetical: YES
VKSAKQGVRRLMLEIMIVTHGKLSEGLKDAAEVIVGTSSHIETMCLESGEDIQTFGEKVKEKLTMINTAEPMLVFVDLISASPYNQALLAVNELTEEKKAATYVIGGVNLPMLLEAINHQMLHTPIEEAVEQIVKQGKDNLTVWHASAEEKKLDEDDF

SEQ ID NO: 4219 - protein, 715 aa, Enterococcus faecium
  misc_feature (B) LOCATION 1...715
  hypothetical: YES
LRSAERKIILKYIKTPAFLNKRLGFFSLLVVLLWLKTIFAYLVDFHLGIESGIQYFILFINPIATTLLLLGIALYIRRPRVAYITIMVIYFLLTLLVFSNVTYYREFTDFITINTILGAGKVASGLGESAIRLFRPYDVIYWIDFIILTVLLIAKKIKLDPRPIRARMAFAISTLAVMIFSGNLFMAEADRPELLTRTFSRDYLVKYLGLNAFMVYDGVQTYQTNQVRAEASPNDMKEVENYVKEHYAAPNDDLFGLAKGKNVIYIHLESFQQFLIDYKLTDENGVQHEVTPFINSLYHSNSTFSFDNFFHQVKAGKTSDAETLMENSLFGLNQGSLFTQLGGKNTFQAAPDILSQTEGYTSAVFHGNAGTFWNRNETYKNLGYDYFFDSSYYDVNDDNSFQYGLHDKPFFQQSVQYLERLQQPFYSKFIAVSNHYPYSKFTNDEAGFPLANTNDETINGYFATANYLDTAVQEFFNYLKESGLYDNSVIVLYGDHYGVSNSRNKNLAELVGKTSSTWTNYDNAQMQRVPYMIHIPGQTQGGINHTYGGQVDALPTLLHLLGVDTKNYIQLGQDLFSKDHEQLVSFRDGDFVTPKYTYYGGTIYSNETGEAITEPTEEVQNEIDSLKEKVDKQLAVSDQINNGDLLRFYTNSGLDPIDTSDYDYKNGLEKLKEAEKSLGDKSTSVFSQHNGQSTVDLYKTQTYQELHGTTTSSSE

SEQ ID NO: 4220 - protein, 215 aa, Enterococcus faecium
  misc_feature (B) LOCATION 1...215
  hypothetical: YES
RGSAMEVLVFPKNEEKALQMEKYMKNLFSFAGVPKPERALLQQPLLDESKNLSISEVLAFVHYYYEQIEREYQYVAIDLVQKNIKRLTFEDLVVLLPLVQKKEWWDSIDSWRKVYSTWCKAYPEQREEVFQLFEKKEDFWLRRIAITLQLGYKQQTDTGLLIRAIDEDRQTKEFFIQKAIGWALRDYSKTDADWVKRQLTTDLSKLAVREASKYL

SEQ ID NO: 4221 - protein, 66 aa, Enterococcus faecium
  misc_feature (B) LOCATION 1...66
  hypothetical: YES
IKSAIIAGNLPTPNSGIINANKAREGIVCKALVKPITIVAAFGKRVSKTPSGTAMMIPMIKASPEI

SEQ ID NO: 4222 - protein, 172 aa, Enterococcus faecium
  misc_feature (B) LOCATION 1...172
  hypothetical: YES
AVGAVSGNTYVKLNRGLLTVDQINYFLDSMPMELTFADNNNQFLYYNLRQEAKEMLAARVPGQVGNPLANCHPEKSYKNVEWVIQQLRSGATDAVRVHVPKQVPEKYIVHNYQAMHDENGEYAGINEYILDFKPIIEWYLQQTGQQLVGNEDAVMNISLISAINKRKKHIKS

SEQ ID NO: 4223 - protein, 177 aa, Enterococcus faecium
  misc_feature (B) LOCATION 1...177
  hypothetical: YES
MKGAIFDLDGLLVDTEKTYRDGWLWGFQQFDIHIPKEIVDAWGGKNWKQSFDILVKAAGSPEKVQEVRAKREEYFYQQLTSGAIHLKPYAKEILADLKERHMKLGIATTTVTKRATDILDHFKLADYLDTFTFGDEVSENKPSPIPYLTALERTGLEASSAFAVECSRRVHHGIAPT

SEQ ID NO: 4224 - protein, 88 aa, Enterococcus faecium
  misc_feature (B) LOCATION 1...88
  hypothetical: YES
QSGARLQMSVPAFVKAKAQNARLVTPKVAPDIAQAIARDLAKAGGNINQIAKWCNTHQHDVASGDAQRLSENLKIMQKELQKIWQQLR

SEQ ID NO: 4225 - protein, 305 aa, Enterococcus faecium
  misc_feature (B) LOCATION 1...305
  hypothetical: YES
RIYLLNVEKFKLKRRTIMYDGELIKKLRVNKKLTQSQLAEGICFKTSLVGIETNSVKKMSFVTLRSFLERMNMTLAEYEWMRNQLDEPIKLKKKRRMLDRVQEDSFDPYKEISNNRRHFKKTEDLYYLVLNLHMVEKTEVSETEFEFLRYECRIIEEYLMQIPDYGQFELSILADFPWIFSDRFIENNYLKIKKRMRRLAQLNNHEQYLFTFLMNLTSFYIENGRLKKARSVNEDMKRSLAHKERSTVIYETLMADYYQRLISAALGEEKTKDYQEFFTVLEYMLGKNQRRSLEKKLLAIAEPSN

SEQ ID NO: 4226 - protein, 113 aa, Enterococcus faecium
  misc_feature (B) LOCATION 1...113
  hypothetical: YES
AVLLLMLLGTFSRFVGSFLTSLLFQLKMILAAPAFVSILLFVTSIGLLMLLLPIAWLTSACFLLFLVYIDVLDTSVRFLQLLVLASNQHIDLLILPIILSLIFGIFLILAVFL

SEQ ID NO: 4227 - protein, 110 aa, Enterococcus faecium
  misc_feature (B) LOCATION 1...110
  hypothetical: YES
CFFATGLTSCTAMLSGFQSSYISASYMANEQEICQSDLYYTEKETDLQIDIDKTEENYPGYDEYRYNIGEISHNPYELLGYLSTAFNAFTFAEVQPEIDRIFSPAVHPHP

SEQ ID NO: 4228 - protein, 60 aa, Enterococcus faecium
  misc_feature (B) LOCATION 1...60
  hypothetical: YES
CLFATLQTDSPAFTVYIVLPVDDVLVVADVFGVFGFAAEVVEPVFVFAEVPPLTINCCPG

SEQ ID NO: 4229 - protein, 67 aa, Enterococcus faecium
  misc_feature (B) LOCATION 1...67
  hypothetical: YES
NYIAHSEKKCRMKLTKFLWIKQQLLVREQMYLLSHTEQWCVKQSKQQTILQKKIYLLKSLIFVQLRH

SEQ ID NO: 4230 - protein, 221 aa, Enterococcus faecium
  misc_feature (B) LOCATION 1...221
  hypothetical: YES
RRIAWEMTGSLAFLSLKVKVAKRPLGFSLMSSANSSVESASGSMSCCTKRLVTSFFGCLKTVNTSPSSTTFPNSITATLLQILRITFISCVIKTMVKFNFLLIANNKSNTSSVVCGSNALVASSQSRISGSFANARAIPTRCFCPPESCEGYACPRPSNPTKRNSSSARSLRLLFGTPANSSGSWIFSSTVLDHNRLKCWKIIPIFFRNVRNSLFFNFVIS

SEQ ID NO: 4231 - protein, 364 aa, Enterococcus faecium
  misc_feature (B) LOCATION 1...364
  hypothetical: YES
RLIANEYMQAKGYEDKNIYIIGDLVFYEEFPGTPTPQIVQAAEQTGHTAAANIVASIKGGEKHKFKGNYQGFMVSIGAKWGVANLFDKIHLSGFLAIVMKHIVNLKYFFDIRSGYYMFQYLMHEFFHIKDDRNVTRGHSSRYGNVLWSVPLRIFYGLVWFVEASKKIIGNGEVFKPSTWFGEGSWFTGNSVFPWTWEYNVTDVASGASAAGDATTAASGAGASAGEAATQAAHFGLSYAYGEEPMAVIEKSPDWFTKIMQVIMPNNDVAMFFQKFMVFFEIALALALIAGLFTWLCSATTIVLVITFCLSGMFYWVNIWFIFVAFALMNGSGRAIGLDRWVIPWLQRTLGNWWYGRPSSQYGKK

SEQ ID NO: 4232 - protein, 116 aa, Enterococcus faecium
  misc_feature (B) LOCATION 1...116
  hypothetical: YES
GVVAIQKELNKTGFVLLESLTALMIASVCVYLVSFGQLFLLQAEKKSGEELLFIRMIYEDIKTQRMYHKRPERREEMIPYDIQIVDNNGVIEKVFVNMEKEAISIEKTSNSSIYAD

SEQ ID NO: 4233 - protein, 215 aa, Enterococcus faecium
  misc_feature (B) LOCATION 1...215
  hypothetical: YES
FDYFEIKFKGIGVINLTNVADMTNVEKIIVLDYGSQYNQLITRRIRDLGVFSELLSHRITAEEVKAMNPKGIILSGGPNSVYDENAFGIDPEIFNLGIPVLGICYGMQLITYKLGGSVEPAKNREYGKALLEVTSDQAVLFKETPKQQTVWMSHGDLVTKVPEGFETVGTSKDCPIASIQDTTRNFYGIQFHAEVRHSEYGIELLRHFAFDVCHC

SEQ ID NO: 4234 - protein, 514 aa, Enterococcus faecium
  misc_feature (B) LOCATION 1...514
  hypothetical: YES
CDYLGHSINRGQVNCRFRRFPALFFLGRKGVERMNVEKGGKKAPLLQQSFIRHGNEQGFWQQGSRILAAVSGGVDSMVLLHLLLQVQRQIGFSLGIVHINHQLREESAEEAAYLRSYCEEKNLPLYVSIWEDPAKSAIETEARNFRYQEFTRVMEEGQYDTLMTAHHGDDQIETVLMKIVRGGQLNTFSGIKEVQPFATGRLIRPLLSFSKEDLYTYAAESQLVYFEDQTNQLLDIQRNRLRHLVVPQLKQENTQALRHFQQFSQQIQWADQVIQKYMGQLIEKEVEQWEEQFRFSAEMIEEMTDAERYYFFYSFFDKAFSKTGIILKEQQMESILDQWQQKKSQWQLSIGNNWILKREYHFVVLSKKEKQATSQTEDQRLLLIPEQGIYLNETEWIGLVKPENAGDIKATDSWSLFSHDIWIPADVQLYVEKRKAGDRIKLTENLTKKVSRYFIDQKVPNSQRQHAWIITDAKRNIYSLIPFAFSYLSIREETDKIHYILLYKYQKEAIGRRT

SEQ ID NO: 4235 - protein, 110 aa, Enterococcus faecium
  misc_feature (B) LOCATION 1...110
  hypothetical: YES
LSAAVENTCDLLVGIVVLRSINLVNTPPIVSIPNDNGVTSSKTTSFTSPVITPPWIAAPIATTSSGLTDLFGSLPVSLRTASTTAGIRVDPPTKITSSISDCDKPASFSA

SEQ ID NO: 4236 - protein, 354 aa, Enterococcus faecium
  misc_feature (B) LOCATION 1...354
  hypothetical: YES
LFHALFFRVNKFLDVNKFRGRKMLLAMNEYNKCCFAKHAEKGKKYYCRGCRKRVILKKGKKKCAHFAHQKSDNCSVFSERESKEHLQLKECFMDWLGQSVEPVFLEAYLPRLRQRPDILLANLAIEIQCSRLSHQRFIERTQNYLNNSYQVWWILGNSFLGQSQFSLIEKSCCYYNRKRGVHCWKADLKKQKLYLYHHITETVSGHISFCSSCWTFSSRDLKEIFTSNEIKMNQMKKIEKVSEDGKKWLTRQLIHKQKNTVSIQEQCYLRHKHLLHLSSWIYQKSRFFFYLQEQVFLYRMLYEEALENQKVPDFNSWLCQIKEHKREWLFPMIDEEMVYQQFFNECIHLSSLKK

SEQ ID NO: 4237 - protein, 90 aa, Enterococcus faecium
  misc_feature (B) LOCATION 1...90
  hypothetical: YES
KSHAPCEWGEKFEIFIISGTYLSIYQWFLTNAQSLVLLAIVVIGLFLGFKREFSKLIGFLVIALIAVGLVFNASGVKDVLLSLFNRIVGA

SEQ ID NO: 4238 - protein, 336 aa, Enterococcus faecium
  misc_feature (B) LOCATION 1...336
  hypothetical: YES
FANAILTGELPVDSQLPTEKELSRTYKVSRITSKRALTELEQLGLIYRVRGKGSFVKSASPEQILASPTKTRRILFLLPYVADLSVGDFSKGLNPVMQDKQIDVMMTTLDFLQNKTAKELINEFDGLIYYALDTEQHLDLLFELSLKEFPVVILDKKIYELPFPTVLSDNFQGGALAASYLIEQGHSKIAYLFGTQTHPQSVRQRYLGYLEALDKAGLTFHTSLDDKSATLDELLSYITKYEVTAFVCENDVVAIQTMNLLRQHGYHIPEDFSIIGFDDIQAAALVDPPLTTIAQDFEQLGKLAGDALVTWLETKDRPSDSKFPVSFIKRQSTKEK

SEQ ID NO: 4239 - protein, 561 aa, Enterococcus faecium
  misc_feature (B) LOCATION 1...561
  hypothetical: YES
EKNAMDGIIKQIEKGKPFFEKISRNSYLGAVRDGFLTAMPAILFSSIFILIAAVPEIFGYQWPESVSTWLWKVYNYSMGVVGLLVSATTARCLADSMNRRLPKNKVINTTSVMLASVVSFLLLSVSPIEGGFSTEYMGTKGLLASFVAAFLTVNLYKFCVLKDITIKMPKEVPGTISQTFRDIFPFSFSVFAAVLIDLGIRQIFQISFAEAIITVLQPLFTAADGYLGIAIIWGAMALFWFVGVHGPSIVEPAIAAIIYANVETNLQLFNSGEQASKVLTVGLGNFVGTMGGTGATLVVPFIFLLFAKSKQLKAVGKASFIPVSFAVNEPLLFAAPMILNPYFFIPFLLTPVVNVCLFKFFVDVLGMNSFMYVLPWATPAPIGLVLGTGMGILAFVLAAVLIVVDFLIYLPFCKAYDAVLVEKEAQKAEVIATEEGASADVREEVPVAASQVISDANKEINVLVLCAGAGTSAMLANALKKGASESKAPISAMAGAYGSHYEMLQDFDMVVLAPQVNSYYDDIKEDTDRLGIKLVATKGAEYIGLTRDPEKAVQFILNQFQ

SEQ ID NO: 4240 - protein, 155 aa, Enterococcus faecium
  misc_feature (B) LOCATION 1...155
  hypothetical: YES
GIYFMESWLFLGIILLVAILAKNQSLMIAAAFVLIMKLIPASRSFFPWLQGKGINIGVTIITAAILIPIATGEIGLRDLLEAFKSPIGWVAVFCGGLVAVLSSKGVGLIASDPQITVALVFGTILGVVFLRGIAAGPVIASGITYCILQVFALGK

SEQ ID NO: 4241 - protein, 140 aa, Enterococcus faecium
  misc_feature (B) LOCATION 1...140
  hypothetical: YES
YSLLCMECIELFLLVSFPLIHVYGIQLITAYAVMFEGGRFSLVIKKYVYSHPINVFIIGKLGLSVEVFCELYGFKQGTLSSWITREREVADLPISFLYALSLASGGNMNEVYDCLCEYEKEYKEYLKISAPKRNKKYIED

SEQ ID NO: 4242 - protein, 71 aa, Enterococcus faecium
  misc_feature (B) LOCATION 1...71
  hypothetical: YES
AMGAYLKCRGPESNRYGDHSPQDFKSCASASSATPARLLWQSGKRGSNPRPPPWQGGALPLSYFRVFKDAG

SEQ ID NO: 4243 - protein, 109 aa, Enterococcus faecium
  misc_feature (B) LOCATION 1...109
  hypothetical: YES
RRGARWGCFTKVSPEEKAAIDRKMELMGPSTCGAYLRKMAVDGYIVQLDMGAVLELVKLLRSVSSNVNQIARRCNSTHNLYEQDVEDLRQGYSEIWQGVNDLLKKFEAL

SEQ ID NO: 4244 - protein, 292 aa, Enterococcus faecium
  misc_feature (B) LOCATION 1...292
  hypothetical: YES
DFLALTLAITLNVPFAIADATSLTEAGYVGEDVENILLKLLQSADYNVELAEKGIIYIDEIDKIARKSENVSITRDVSGEGVQQALLKILEGTVASVPPQGGRKHPHQEFIQIDTTNILFIVGGAFDGIETIVKNRMGEKTIGFGTQNQKLSEDESVMQHIIPEDLLKFGLIPEFIGRLPVMAALEKLTTDDLVRILTEPKNALVKQYQKLLSLDNTELEFEPEALRAIAKKAIERNTGARGLRSIIEEIMMDVMFDIPSNENIEKVIITKEAAELSGEPTVIYKDSEKKAG

SEQ ID NO: 4245 - protein, 356 aa, Enterococcus faecium
  misc_feature (B) LOCATION 1...356
  hypothetical: YES
MFLALNEIMHSKLRYALVAGVMFLIAYLVFFLTGLAYGLAQDNRTAVDKWEADSIVLSKDANSNLGMSMITKKIAEEVEGGKVAYLAQTPGVVTSKDSTEEGKINVSFFGIDKNQFIMPNLVEGKAFDNDDEAVGDISLKEEYGLAVGDTVKLSGSDKTFKLTGFTDHAKFNVSPVLYTTINAYQEIRFEKEDTSENARINAIVVRGKISNLPEDLEQIKISKFINELPGYNAQVLTFGFMIGFLIVIAAIVIGIFIYVLTMQKINIFGVMKAQGITGGFIARSVVAQTFILSFVGILLGLLGTVGTSLVLPDAVPFQSNWLFFGVISLLMLVVAVLGALFSVRTIVKIDPLKAIG

SEQ ID NO: 4246 - protein, 198 aa, Enterococcus faecium
  misc_feature (B) LOCATION 1...198
  hypothetical: YES
SDLAFLFLKITVLYIKKGIIVISFFKEYLEIINFRLKTKKESVIILVYFQGGNLMIKKLFLLSILTLAMAGCSDSGLATELITKSTEATTEELKCGNDHSDYRGLNRRCMGILGRSNCKHRCSNRRRCRRSNRKIKRKIKRSNLCCASYTDVEDAVLLNHVRRCSFMSREVGDEPKLEYAFSFAREDEDNPKTYDILA

SEQ ID NO: 4247 - protein, 294 aa, Enterococcus faecium
  misc_feature (B) LOCATION 1...294
  hypothetical: YES
LPLALLDSHYLFRRENMLRFLILSGYFELMMYLQVSGKLDQYINVHYRYLAILSMILSALLALVQLYLWVKNGKAEEKAHEHDHDHGLSKPYQRGIAYVLLALPVIVGTLFPTVSLDTTIVEAKGFNFPVSKESVGDPEMQTQYLKPDTSIYFNKSDYLDQMNELKEKYGDKQTIKITDENYLEVMELIYNYPSEFIGKKISYEGFVYQTPNDSNTDIFLFRFGIIHCVADSGVFGLLTHMPEGVTVKNDEWYKIEGTIQSDYYQPFKREIPSVVVTNAEKVSAPKNQYVYRSF

SEQ ID NO: 4248 - protein, 104 aa, Enterococcus faecium
  misc_feature (B) LOCATION 1...104
  hypothetical: YES
ISLAREAKNRLIHDYIDQPKYSKACASLDDGFEDAFQYTVQGNSHNRLKSTNLIERLNQEVRRREKIIRIFPNQTSANRLIGAVLMDLHDEWIYSSRKYINFDK

SEQ ID NO: 4249 - protein, 80 aa, Enterococcus faecium
  misc_feature (B) LOCATION 1...80
  hypothetical: YES
QRLAKMCLASIFYSFKFPQLFFHKINIFPIIAKNHRRTNPSLIPKIKKSLHHKPTLIFFIPTNKLASRIDCCKCSSDRSV

SEQ ID NO: 4250 - protein, 210 aa, Enterococcus faecium
  misc_feature (B) LOCATION 1...210
  hypothetical: YES
GEYFMILSVENFTLSINKKKIKQNWNFSISEKDFIIVTGKSGSGKTTLLNNLSLIDKQYTGNLFYFEKKVSKHDIQRLRRNHISYLFQNYALLENQTVQYNFELAKKFNSNISNDHIYNLLTDFSLPKDILKEKIFLLSGGEQQRIALIRNMLKPFDILFADEPTGNLDKENSTFIMNFLKNLTEKEKKAVVLVTHDLNVLNYGTNIIEL

SEQ ID NO: 4251 - protein, 140 aa, Enterococcus faecium
  misc_feature (B) LOCATION 1...140
  hypothetical: YES
YMLACFCKKKKEGVLVMYLKITEQAQERLQKYIDEGATVILDLDDGVGEYSKMGVCSLDTSFRLLLLDKEQRKNDYKLQLDSDIGDVYIKDYSKMYMDEHMTLSLDPRLGVFTLESPSGSLDSHVQLVDLRPEKFSGIKQ

SEQ ID NO: 4252 - protein, 94 aa, Enterococcus faecium
  misc_feature (B) LOCATION 1...94
  hypothetical: YES
KSIASKMLSQIINFIKKAARKKNQPHSMSRSNFTKGGKVGANLNAINVRRVRSSLMFYQKEKKPLLITNKRTPFFQCSLRWLLEGFQSVVLVIF

SEQ ID NO: 4253 - protein, 234 aa, Enterococcus faecium
  misc_feature (B) LOCATION 1...234
  hypothetical: YES
KKIAGGMTMNHFKGKQFQQDVIIVAVGYYLRYNLSYREVQEILYDRGINVSHTTIYRWVQEYGKLLYQIWKKKNKKSFYSWKMDETYIKIKGKWHYLYRAIDADGLTLDIWLRKKRDTQAAYAFLKRLVKQFDEPKVVVTDKAPSITSAFKKLKEYGFYQGTEHRTIKYLNNLIEQDHRPVKRRNKFYRSLRTASTTIKGMEAIRGLYMKTRKEGTLFGFSVCTEIKVLLGIPA

SEQ ID NO: 4254 - protein, 234 aa, Enterococcus faecium
  misc_feature (B) LOCATION 1...234
  hypothetical: YES
KKIAGGMTMNHFKGKQFQQDVIIVAVGYYLRYNLSYREVQEILYDRGINVSHTTIYRWVQEYGKLLYQIWKKKNKKSFYSWKMDETYIKIKGKWHYLYRAIDADGLTLDIWLRKKRDTQAAYAFLKRLVKQFDEPKVVVTDKAPSITSAFKKLKEYGFYQGTEHRTIKYLNNLIEQDHRPVKRRNKFYRSLRTASTTIKGMEAIRGLYKKTRKEGTLFGFSVCTEIKVLLGIPA

SEQ ID NO: 4255 - protein, 234 aa, Enterococcus faecium
  misc_feature (B) LOCATION 1...234
  hypothetical: YES
KKIAGGMTMNHFKGKQFQQDVIIVAVGYYLRYNLSYREVQEILYDRGINVSHTTIYRWVQEYGKLLYQIWKKKNKKSFYSWKMDETYIKIKGKWHYLYRAIDADGLTLDIWLRKKRDTQAAYAFLKRLVKQFDEPKVVVTDKAPSITSAFKKLKEYGFYQGTEHRTIKYLNNLIEQDHRPVKRRNKLYRSLRTASTTIKGMEAIRGLYKKTRKEGTLFGFSVCTEIKVLLGIPA

SEQ ID NO: 4256 - protein, 234 aa, Enterococcus faecium
  misc_feature (B) LOCATION 1...234
  hypothetical: YES
KKIAGGMTMNHFKGKQFQQDVIIVAVGYYLRYNLSYREVREILYDRGINVSHTTIYRWVQEYGKLLYQIWKKKNKKSFYSWKMDETYIKIKGKWHYLYRAINADGLTLDIWLRKKRDTQAAYAFLKRLVKQFDEPKVVVTDKAPSITSAFKKLKEYGFYQGTEHRTIKYLNNLIEQDHRPVKRRNKFYRSLRTASTTIKGMEAIRGLYKKTRKEGTLFGFSVYTEIKVLLGIPA

SEQ ID NO: 4257 - protein, 129 aa, Enterococcus faecium
  misc_feature (B) LOCATION 1...129
  hypothetical: YES
KKIAGGMTMNHFKGKQFQQDVIIVAVGYYLRYNLSYREVQEILYDRGINVSHTTIYRWVQEYGKLLYQIWKKKNKKSFYSWKMDETYIKIKGKWHYLYRAIDADGLTLDIWLRKKRDTQVCRLRHILLM

SEQ ID NO: 4258 - protein, 234 aa, Enterococcus faecium; identical to SEQ ID NO: 4255
  misc_feature (B) LOCATION 1...234
  hypothetical: YES

SEQ ID NO: 4259 - protein, 62 aa, Enterococcus faecium
  misc_feature (B) LOCATION 1...62
  hypothetical: YES
KKIAGGMTMSHFKGKQFQQDVIIVAVDYYLRYNLSYREVQEILYDRGINVSVLLQSFKSTIK

SEQ ID NO: 4260 - protein, 234 aa, Enterococcus faecium; identical to SEQ ID NO: 4254
  misc_feature (B) LOCATION 1...234
  hypothetical: YES

SEQ ID NO: 4261 - protein, 234 aa, Enterococcus faecium; identical to SEQ ID NO: 4255
  misc_feature (B) LOCATION 1...234
  hypothetical: YES

SEQ ID NO: 4262 - protein, 234 aa, Enterococcus faecium
  misc_feature (B) LOCATION 1...234
  hypothetical: YES
KKIAGGMTMNHFKGKQFQQDVIIVAVGYYLRYNLSYREVQEILYDRGINVSHATIYRWVQEYGKLLYQIWKKKNKKSFYSWKMDETYIKIKGKWHYLYRAIDADGLTLDIWLRKKRDTQAAYAFLKRLVKQFDEPKVVVTDKAPSITSAFKKLKEYGFYQGTEHRTIKYLNNLIEQDHRPVKRRNKFYRSLRTASTTIKGMEAIRGLYKKTRKEGTLFGFSVCTEIKVLLGIPA

SEQ ID NO: 4263 - protein, 236 aa, Enterococcus faecium
  misc_feature (B) LOCATION 1...236
  hypothetical: YES
PEIAKEKWLMAEQFTPEIMTELRKDIVRVPEIILEASGIKIFGKLIRSIIFTTDIAIIRNTNANAVIAVYPFTPHPAITKSIIEAADIPVFSGVGGGLTQGARSSYMSMFAEAQGSLGVVLNGPTPLETVKEVCRVVDIPVISTVTSKYTEIDEKLAAGISIINISAGKETAEAVRHFRKKYPELPIIATGGPTEGSIAETIQAGANAITYTPPSSGELFSRKMEKYRETEKKNHE

SEQ ID NO: 4264 - protein, 109 aa, Enterococcus faecium
  misc_feature (B) LOCATION 1...109
  hypothetical: YES
ITVAAACTKLVIVFLILFQILEAVALIEFQIFEAVVLIAVHIPFHHATTGSNIVWNVVTIPFQAILIHCVIVSQVFLRKSEIGVQTACQAAPNNCPATSKIPTIILIPA

SEQ ID NO: 4265 - protein, 131 aa, Enterococcus faecium
  misc_feature (B) LOCATION 1...131
  hypothetical: YES
MQVARFLKRKNTLDAEVIVMQLDNSEFEITKRRGLIVWVYSLKQLKNLKKFGLLHYVSRRMKYVVLYLNEETLEETEERIRKLHFVRNVERSYRPDIEMNFAEKIGNKTVLKDEGFEIEELNTEIRLAEHL

SEQ ID NO: 4266 - protein, 70 aa, Enterococcus faecium
  misc_feature (B) LOCATION 1...70
  hypothetical: YES
STSAPAILMKVKGSNLLTLVNFNEKKGGMQDVFPTTLYNYFLFSFTKYDTYSRICTRSKKTRLHFISHNG

SEQ ID NO: 4267 - protein, 913 aa, Enterococcus faecium
  misc_feature (B) LOCATION 1...913
  hypothetical: YES
SNSAEKRRRGRSMQSIKNTLRLYLLDWKRIFKNPIATLLIIAIMIIPSLYAWFNIKALWDPYGNTGELPIAVYSADKPAEFQGKEVAIGEQVIESLHKNKQLGWQFVDSKEQLEDGVRSGKYYAGIYLPKDFSEDLLSFTSGDIKKPKIEYTVNEKINAIAPKITDKGASSIQSQITNEFIKTASSTLLKVFNEIGYDIDTNLVSINKVKDMILSTDENLDTIDGYTKQVLELQSQLPEIKEKLNKANEFVDYIPKVDEMGEKVVALNDKMPELKDQAKIILDLQEKIPEIQNAGKQLAEIDGDFASIQETMNQGIDEAKQGLTIIQQVQDILPDVKNLENQASDLANQTKSGASQLKDAIPSITNSVDVTLKSIGQVATTTGSLIDTVRTAIEDGKLTDDEKKNISNVLNGFIDGISQQQNAIDKLVEFLTKLQTSAGNTKLQPIIDQLNQLKPLLSNLQNRLSALNTAVQNEDTKAIDELLDQIDAVVNNINGIIAGINTGQISSTVTSLLDQVIDTIGTAQGALSKADQIDFDSLLSSTKATVTNAVAILEKYQKEMPAIGQEIHDANTMLNGNMDTIVNGINEGADLYNNELPIIQQKLGLAADFIQNDWPALKNEITGTLTTVNEKMPEVETAVNAAADLINNDWPNIKAGIQKAADAIRKGEQEVDLGEVIKLLKLDATKESDFFTQPVELQTNALYPIANNGSASTPFYTALCLWVGAVLLSSVATTEYYLGKKDRNNFTKREQFVARMLTFLTMAIAQSLIVTLGNIFLLGVDVQNPVYSVSFAVLIALAFMMIVYVLAALFDNVGKGIAIIILVLSISGGGGNYPIQVSGKFFQMINPFLPFTHAVNLLRESAGGIYWPNATKAIWIMIGLFVVFGIVGTAIYPFIEEKMTKFKEAAHESHIFH

SEQ ID NO: 4268 - protein, 345 aa, Enterococcus faecium
  misc_feature (B) LOCATION 1...345
  hypothetical: YES
EESAHMIEKIILGTYTRRESKGIYTIDLDTEKEELANLSLAVEENSPTYVAKSKAGNLYTVTSVDGLGGAGAYDKDFHFLNAVTESGAPLCYVAVDEARQLLYGANYHKGEVNVYHILGDGELKAADSIFHQEATGPHKNQDHAHVHYTDLTPDQRLVVCDLGTDRVYTYDVSENGKLNLVTTFTAEPGTGPRHLVFHPNGQFAYLFGELDSTVRVLSYNKETGAFEELQKISTLPEEFDGENGGAAIRISNDGKFLYASNRGHNSIAVFAVFEDGSHIQNKQIISTEGDFPRDFALDPSNNFVVCANQNTDNLTLYRRHPETGLLELLKKDVYVPECVCVYFDR

SEQ ID NO: 4269 - protein, 163 aa, Enterococcus faecium
  misc_feature (B) LOCATION 1...163
  hypothetical: YES
REPAEHGIMDQPPIPKNEGIFARGLLRKIAINAGVFTIVTLFGYYLGSYVDTISPWVDASQHVGQTVAFLILAYSSILHVFNVRSSQSIFKVNLATNKALVEMALLALAITTAVALLPFTQELFGLVHISLNHWFLVGILSIVPIAVNELIKFHRLPEAEEEE

SEQ ID NO: 4270 - protein, 61 aa, Enterococcus faecium
  misc_feature (B) LOCATION 1...61
  hypothetical: YES
ANTATFSVKSKLFLSPSRSPFSSSIPVRHKKVMSLVFDFVDSIRKQFIKHPLNKKYKNHKN

SEQ ID NO: 4271 - protein, 331 aa, Enterococcus faecium
  misc_feature (B) LOCATION 1...331
  hypothetical: YES
ICTANSSNRRINKRNEENMAFESLTERLQQAMGKLRKKGKVSEADVKEMMREIRLALLEADVNLQVVKDFTKRVRERAVGAEVLESLSPAQQIVKIVDEELTITLGSETAELNKSPKIPTVIMMAGLQGAGKTTFTGKLANYLKKNENARPLLIAGDVYRPAAIDQLKVLGQQLDVPVFDMGTEVSPVEIVRQGMELAREKKNDYVLIDTAGRLHIDETLMDELKQIKELTQPNEILLVVDAMTGQDAVNVADSFNQQLGITGVVITKLDGDTRGGAALSIRSVTGAPIKFIGSGEKLTDLEVFHPARMASRIVGMGEMVTFFEKAQQEFG

SEQ ID NO: 4272 - protein, 188 aa, Enterococcus faecium
  misc_feature (B) LOCATION 1...188
  hypothetical: YES
RMTAIYKALKNSNVSEYVKSRVLNNNLDYILENGVADLISKLSDPIDIDHLVVWQDGTLEVSIYGEFYSRNKVTTFKNSISGREDLKGINKNSKFYRTNKELLEKISKRVFELVNPFSKKRSKELFGIFYDGFSAKSNVEKFFYFNDSAYIAVKDSKRIPEATLEYLEPIKLSVFYSLYEKEIADEAV

SEQ ID NO: 4273 - protein, 234 aa, Enterococcus faecium
  misc_feature (B) LOCATION 1...234
  hypothetical: YES
KKTAGGMTMNHFKGKQFQQDVIIVAVDYYLRYNLSYREVQEILYDRGINVSHATIYRWVQEYGKLLYQIWKKKNKKSFYSWKMDETYIKIKGKWHYLYRAIDADGLTLDIWLRKKRDTQAAYAFLKRLVKQFDEPKVVVTDKAPSITSAFKKLKEYGFYQGTEHRTIKYLNNLIEQDHRPVKRRNKFYRSLRTASTTIKGMEAIRGLYKKTRKEGTLFGFSVYTEIKVLLGIPA

SEQ ID NO: 4274 - protein, 307 aa, Enterococcus faecium
  misc_feature (B) LOCATION 1...307
  hypothetical: YES
MTAAAEKKDHQKVILVGDGAVGSSYAFALVTQNIAQEVGIVDINTAKTEGDAIDLSHALAFTSPKKIYSATYADAHDADLVVITAGAPQKPGETRLDLVNKNLKINRDVVTQIVESGFNGIFLVAANPVDILTYSTWKFSGFPKERVIGSGTSLDSARFRQALAELVDVDARNVHAYILGEHGDSEFPVWSHANVAGLQIYEWVKNNPEIDEEAMVNLFFGVRDAAYTIIEKKGATFYGIAVALARITRAILDDENAVLPLSVFMNGEYGLNDIYIGAPAVINRQGIQKVIEIPLSDSEQDRMAGFC

SEQ ID NO: 4275 - protein, 762 aa, Enterococcus faecium
  misc_feature (B) LOCATION 1...762
  hypothetical: YES
FAAARNMTIKVEGIEVAYSDPATDPPGQERPTRLIDPIYTVTSSNHSGNQDHTMSFRANADGLLTIKNKATGEVLKNAKNLAITANREFDYQTKLMEGTNEFTFSFTPDKNYPPEEYVEMTSYETKEILHTVDYRKPKYSTVYVTPEGSDAGNGSRQNPLSLTQALRYAYAGQTIVMAPGTYSFERGLTIPKGVNGTRENPIQLIAEKNPENKRPVLDFKGTGNGMTLFSHYWGLRGFDITNSAAMQKGLQISGNHNLIEEIHAYRNGNTGIQISGSSNDPFEAWPAHNLVKNCTSFENADPGFEDADGFAAKLTIGEGNVFDGCIAYHNADDGWDLFAKNETGSIGKVIIKNSVAYRNGWVPGIEGEGNGNGFKMGGSSLTGPHELINSLSFENLAKGIDSNSGTDIIVNSSTSFNNGSYNVALYTSSAGNTDYHASGILSFRTENLEMREQIRPLNQNEDQIYHSLNYYWNEREKQSENTLGHTISKDWIESLNTCSKEGQQPVTRYENGSIHVHGLMQIKPGNRQTEKERVDGLPLSVGAIFDGETSPSSEYPEYAIVQEPNQTKPNEQNNPIIIQEANGVAENAEGNIIELKPFTVFVSTFTPNQGTPVFEDMRYFPEKIQIVETQSSAQFSNHTAIFSAPSKGEYTLEVTYRSEIFDGEKWSAHTESVTQQKAITVRETADVPPGNDKPERENPGNESPNGKPNGKPSHPDRTAKESEKNGTQGLPKTGEFNNPLLALAGGILLIGVVVYVMKQRKK

SEQ ID NO: 4276 - protein, 355 aa, Enterococcus faecium
  misc_feature (B) LOCATION 1...355
  hypothetical: YES
ATLLEPFLICYIVSSEYGKIGKNESKKRGCLFLTEESSSLEIRLTAADDVSMLLGAHDKHIKLIEETTETTIHTRGEIIQIIGEQSQISLAASVIRTLQELIKRGIHVSTPDVVTALKMGQKGTLDYFVEMYEEEIVKDRNGKPIRVKNSGQKKYVESVAKHDIVFGVGPAGTGKTFLAVVLAIAALKKGEVQKIILTRPAVEAGENLGFLPGDLKEKVDPYLRPVYDALYQIFGLDHTNRLMERGVIEIAPLAYMRGRTLDDAFVILDEAQNTTVAQMKMFLTRLGYQSKMIVNGDTSQIDLPRGTTSGLVHAERTLKQIKKIDFVNFEASDVVRHPVVAEIIKAYEKADLHQE

SEQ ID NO: 4277 - protein, 396 aa, Enterococcus faecium
  misc_feature (B) LOCATION 1...396
  hypothetical: YES
FNQALLSQFTLIRLVNYSTSPLNFWSGLAFSSTFLVTTLISPWWGKLADQKGRKLMLLRASLGMAIVISLMGCVTSVYQLVALRLLQGIFSGYISNATALVATGTPKEKSGQVLGTLATGSVTGTLLGPLLGGISASAFGYRPTFFITGIILFFVFLLSLFFVHEKFVPVKKENMVSAKQIFKDLKYPHVVIGMFVTTMIIQASNNSISPIISLYIRQLLHGHGNVTLISGIIASIPGIATLIAAPRFGRLGDKIGSERILAIGLGFAILVYIPMAFVTNVWQLAALRFLIGISDACLLPAVQALITKYSPHQAAGRIFSYNQSFQATGNVVGPMIGSSVSSAFGYRGVFLSTSLLVLVNFLLVRHNTQEIHQQETAEEKASGVSIASGHSPSHRQ

SEQ ID NO: 4278 - protein, 60 aa, Enterococcus faecium
  misc_feature (B) LOCATION 1...60
  hypothetical: YES
NMYFYGKIFLLGVNFFFVQKKGCDKSLVTVPYPEQAVFSRQLLGHNLHFNNKPVNVRAIL

SEQ ID NO: 4279 - protein, 305 aa, Enterococcus faecium
  misc_feature (B) LOCATION 1...305
  hypothetical: YES
YFKASGADIRTKRQVIDANKHKYSISAMCKILNISRQTYYYQAKPIENESDLEEIVQEEFIRNRKAYGTRKLKKCLAKRGLQLSRRRIGRIMKRRGLTSTYTIAHFKGQRTACNEAKTANVLDRTFTQEQPLEAIVTDLTYVRVGKKWHYICLILDLFNREIIGYSCGEKKDASLVKEAFGRIPYSLTDVKLFHTDRGKEFDNQTIHEILNGFGITRSLSRKGCPYDNAVVESTYKSVKVEFVHQYQFETLAQLRLELFDYVHWWNYLRLHGTLAYETPIQIRQQRLAKRILDNERGSDTSGEAA

SEQ ID NO: 4280 - protein, 305 aa, Enterococcus faecium
  misc_feature (B) LOCATION 1...305
  hypothetical: YES
YFKASGADIRTKRQVIDANKHKYSISAMCKILNISRQTYYYQAKPIENESDLEEIVQEEFIRNRKAYGTRKLKKCLAKRGLQLSRRRIGRIMKRRGLTSTYTIAHFKGQRTACNEAKTANVLDRTFTQEQPLEAIVTDLTYVRVRKKWHYICLILDLFNREIIGYSCGEKKDASLVKEAFGRIPYSLTDVKLFHTDWGKEFDNQTIHEILNGFGITRSLSRKGCPYDNAVVESTYKSVKVEFVHQYQFETLAQLRLELFDYVHWWNYLRLHGTLAYETPIQIRQQRLAKRILDNERGSDTSGEAA

SEQ ID NO: 4281 - protein, 241 aa, Enterococcus faecium
  misc_feature (B) LOCATION 1...241
  hypothetical: YES
YFKASGADIRTKRQVIDANKHKYSISAMCKILNISRQTYYYQAKPIENESDLEEIVQEEFIRNRKAYGTRKLKKCLAKRGLQLSRRRIGRIMKRRGLTSTYTIAHFKGQRTACRADDYMTKPIDVNEMILRVEALLRRSKINYSSSLIIGQTKLELDAYTVLQDQHSLILPQKEFLLLYKLLSYPNKIFTRQQLMDDIWGLDTNTEERTIDVHIKRLRTRFEKTEDFQIITVRGLGYKAVI

SEQ ID NO: 4282 - protein, 87 aa, Enterococcus faecium
  misc_feature (B) LOCATION 1...87
  hypothetical: YES
YFKASGADIRTKRQVIDANKHKYSISAMCKILNISRQTYYYQAKPKGLRYPKIEEVFSKAWASTQSAPNRSNHETPRIDIYLYDRSF

SEQ ID NO: 4283 - protein, 305 aa, Enterococcus faecium
  misc_feature (B) LOCATION 1...305
  hypothetical: YES
YFKASSADIRTKRQVIDANKHLYPISAMCRILGLSRQSYYYQSKPKKDESELEEVVAEEFIRSRKAYGSRKIKKALSKRGIQISRRKISRIMKNRGLKSSYTVAYFKVHHSTCNEAKTTNVLNRKFLRDNPLEAIVTDLTYVRVGKKWNYVCFILDLFNREILGYSCGEHKDAVLVKKAFSCIKQPLTEVEIFHTDRGKEFDNQAIDELLTTFDINRSLSHKGCPFDNAVAESTYKSLKVEFVYQYTFETLQQLDLELFDYVNWWNHLRLHGTLGYETPVGYRNQRLAQRILDNELGCANASEAV

SEQ ID NO: 4284 - protein, 305 aa, Enterococcus faecium
  misc_feature (B) LOCATION 1...305
  hypothetical: YES
YFKASSADIRTKRQVIDANKHLYPISAMCRILGLSRQSYYYQSKPKKDESELEEVVAEEFIRSRKAYGSRKIKKALSKRGIQISRRKISRIMKNRGLKSSYTVAYFKVHHSTCNEAKTTNVLNRKFLRDNPLEAIVTDLTYVRVGKKWNYVCFILDLFNREILGYSCGEHKDAVLVKKAFSRIKQPLTEVEIFHTDRGKEFDNQAIDELLTTFDINRSLSHKGCPFDNAVAESTYKSLKVEFVYQYTFETLQQLDLELFDYVNWWNHLRLHGTLGYETPVGYRNQKLAQRILDNELGCANASEAV

SEQ ID NO: 4285 - protein, 305 aa, Enterococcus faecium
  misc_feature (B) LOCATION 1...305
  hypothetical: YES
YFKASSADIRTKRQVIDANKHLYPISAMCRILGLSRQSYYYQSKPKKDESELEEVVAEEFIRSRKAYGSRKIKKALSKRGIQISRRKISRIMKNRGLKSSYTVAYFKVHHSTCNEAKTTNVLNRKFLRDNPLEAIVTDLTYVRVGKKWNYVCFILDLFNREILGYSCGEHKDAVLVKKAFSRIKQPLTEVEIFHTDRGKEFDNQAIDELLTTFDINRSLSHKGCPFDNAVAESTYKSLKVEFVYQYTFETLQQLDLELFDYVNWWNHLRLHGTLGYETPVGYRNQRLAQRILDNELGCANASEAV

SEQ ID NO: 4286 - protein, 305 aa, Enterococcus faecium; identical to SEQ ID NO: 4285
  misc_feature (B) LOCATION 1...305
  hypothetical: YES

SEQ ID NO: 4287 - protein, 208 aa, Enterococcus faecium
  misc_feature (B) LOCATION 1...208
  hypothetical: YES
YNKAFTMWLSNEGGFYMKKISTLLFIGLVSLGLFGFSIPGFAHGYITSPGSRAYLGTSAAGNLNQNVGRAQWEPQSIEATKNTFIDGKIASAGVSGFEPLDEQTSNRWHKNMVNPGTLNITWNLTAQHRTSTWDYYITKPTWNPNQPLKFSDFELITKIDDKATVPPKTVNQTITLPQDRKGYNVILAVWNISDTTNAFYQVIDVNIQ

SEQ ID NO: 4288 - protein, 64 aa, Enterococcus faecium
  misc_feature (B) LOCATION 1...64
  hypothetical: YES
VNKAVKISFIPLVNPLTTYCTKQIVVQTADQNAAWIFLCDTSYLFYQLEQLFISNKITSFLSDK

SEQ ID NO: 4289 - protein, 336 aa, Enterococcus faecium
  misc_feature (B) LOCATION 1...336
  hypothetical: YES
MLKAFKFRMYPTEEQKQQLIRTFGCARFTYNHLLKKRQKSWQQTGVANFSLTPATLKKEYPFLKEVDSLALANAQLNLDRAFRNYFKGRASFPKLKTKKSMWQSYTTNNQTRTIYLENGYLKLPKQKELIKINQHRPVEGSIRSATISARYNEEFYVALLCDVSPVKKESLAKWIGIAYHPKTLIQTSRPLEVTLPKFHQTEEKLQHAQRKLNVKVRSAHHRKIRLDQASNYQKQKRKVMDLYLKQKNQREDYLEQLSGKLVKQYDYLFVESFPKEEAHADFSIHDWHKLITKLRYKSQWYNKKFLLINTDGAEESNSVRKSQVVEKMGRHSVIKG

SEQ ID NO: 4290 - protein, 128 aa, Enterococcus faecium
  misc_feature (B) LOCATION 1...128
  hypothetical: YES
TPKAEGTNCTTAAGGSIVLLVIRNCTVRENAGHSRIDEGMKEMKKRLVLVPASFIFCAFLLLPLLFMVLCSLHSDLTNQWTLANYSDIFSNKYYTQAFVNSVLIAVSSSVIGLIGTFIKCLCFMNLWD

SEQ ID NO: 4291 - protein, 68 aa, Enterococcus faecium
  misc_feature (B) LOCATION 1...68
  hypothetical: YES
GKKASKVKIPKLLVETWVDVYSMLTDVFSMPSDLVLSDICLDDILQMAYNKSAYEGWKNYAINQSQKN

SEQ ID NO: 4292 - protein, 366 aa, Enterococcus faecium
  misc_feature (B) LOCATION 1...366
  hypothetical: YES
WKKACKERGSFIMMLRVEKLRKKMQEENLDSFLVTSPYNLRYLTNFTGTTGLAVITLEKAFFITDFRYTEQAAAQAQGFEIIKNVGPIFDEVANLVRKEELHSLAFEETTVSFLEYSVLEEIIDAELVPVSQMIEELREVKDEEEIAIIEKACHIADMAYDHILKMIQPGMTEIEVANQLDFYMRSLGASGVSFDTIVASGLRSAMPHGVASKKIIEQGDLITLDFGCYYEGYVSDMTRTFAIGDPGEKLKEIYQIVLDAQLAVIDAAKPGMTGVQLDAVARDYISKHGYGEAFGHSTGHGIGLEIHEGPNVSSRAEKQFVPGNVITDEPGIYLPGIGGVRIEDDLLITEDGNRVLTRSPKELIIL

SEQ ID NO: 4293 - protein, 235 aa, Enterococcus faecium
  misc_feature (B) LOCATION 1...235
  hypothetical: YES
RKKADFTVLKKRGKEMELNRMIDHTILKADASKEAVMQIIEEAKKYHFYSVCINPAWVALAKEQLQGEPVAVCTVIGFPLGANTPETKAFETTDAINNGADEVDMVINIGALKSKDDQQVQKDIEAVVEAAKDRALVKVIIETSLLDREEIIRACEIAKAAGADFVKTSTGFSTGGAKVEDVRLMRETVGPEMGVKASGGIHNEEEAMAMIEAGATRIGTSAGVAIVSGSTGEGY

SEQ ID NO: 4294 - protein, 88 aa, Enterococcus faecium
  misc_feature (B) LOCATION 1...88
  hypothetical: YES
EMKARKKPVTVEIVQLKMLSARSYRKCKEFVGEAWVDHNNMPNGLPGIETLEGTMEISDGDYIIKGVHGEFYPCKPDIFLETYEIIEE

SEQ ID NO: 4295 - protein, 130 aa, Enterococcus faecium
  misc_feature (B) LOCATION 1...130
  hypothetical: YES
NAKAKKGAYKMAELAYKRTGDYLIPDLVMDGEDEMEEMPLGKYGRLRQTFLQEHHKGTYTSMLLTGRLEPHLREIDRQAQEQADRIVAELKKQNGVDEGMKARDQMGWVQAVNLFLAQAEETVLNEIVYK

SEQ ID NO: 4296 - protein, 123 aa, Enterococcus faecium
  misc_feature (B) LOCATION 1...123
  hypothetical: YES
KKKACTSFLNRKEVKQVLEALEQIRKAEEENEKRARTLRQQLKTYAEEKEQELEIIQTNSRQQLKQLVEEKEQFEKQELEKEKMKLKAEADKVQATLKDQYQKHQSQAIGAIIERVKETYGRH

SEQ ID NO: 4297 - protein, 401 aa, Enterococcus faecium
  misc_feature (B) LOCATION 1...401
  hypothetical: YES
EEKAKAGEGMKVQVKKRASSRLKKGYPLIQKEDLAHPQKETTQWVELVDPQNQFIAKGYLGKQNKGIGWVLSQQDIPFDQSFFEELFVKSREKRTFFFSDDSTTAFRIFNGEGDGIGGLIIDYYAGYAVFSWYNETLYTHRELLIQAFREIYPEIIGGYEKIRFESVNLPESQFIYGKEAPEPLIVKENGIKFAVYLNEGLMTGIFLDQKEVRGSLAEGFASGKTVLNMFSYTGAFSVAAAMGGAIETTSVDLAKRSLKKTQEQFEVNGLDVDQQKIIVMDVFEYFKYAKRKQFLYDMIVLDPPSFARNKKKVFRVAKDYGELVKDSLDILAENGILIASTNAANVSIEQFQTMIEEEFHAKNVSFEQLALYRLPKDFQTTDTFLEGNYLKVFVYQIKNNH

SEQ ID NO: 4298 - protein, 649 aa, Enterococcus faecium
  misc_feature (B) LOCATION 1...649
  hypothetical: YES
SIEAVQKANSGHPGLPMGAAPMAYALWTKHLKVNPTTSKNWADRDRFVLSAGHGSAMLYSLLHLAGYQVTIDDLKQFRQWDSKTPGHPEVHHTDGVQATTGPLGQGIAMAVGMAMAEAHLAATYNKENFNVMDHYTYAICGDGDLMEGVSQEASSMAGHMKLGKLIVLYDSNDISLDGPTSKAFTENVGARYEAYGWQHILVKDGNDLEAISKAIEEAKAETDKPTLIEVKTVIGYGAPKEGTSAVHGAPLGEDGIKMAKEVYGWEYPDFTVPEEVAARFHQTMIEEGQKAEDAWNEMFANYKKAYPELAQQFEDAFDGKLPENWDAELPTYEVGSSQASRVSSKEVIQELSKAIPSFWGGSADLSGSNNTMVAADKDFTPEHYEGRNIWFGVREFAMASAMNGIQLHGGTRIYGGTFFVFVDYLRPAVRLAAIQHTPVVYVLTHDSVAVGEDGPTHEPIEQLASVRCMPGVQVIRPADGNETRAAWKVAMETTDAPTILVLSRQNLPVLPSTKEVADEMVKKGAYVLSPSQGETPEGILIATGSEVDLAVKAQKELAEKGKDVSVVSMPSFDLFEKQSSEYKESVLPKSVKKRVAIEAAASFGWERYVGTEGATITIDHFGASAPGTKILEEFGFTVENVVNTYNQLS

SEQ ID NO: 4299 - protein, 80 aa, Enterococcus faecium
  misc_feature (B) LOCATION 1...80
  hypothetical: YES
FSEASAVATKDVMFGCCDKSHVTAPFFRINIVLLPTPRSQVTISNKYKKLFFELVPCDSELNGRLTTSFLNGVQSAVPRY

SEQ ID NO: 4300 - protein, 239 aa, Enterococcus faecium
  misc_feature (B) LOCATION 1...239
  hypothetical: YES
PREAQTSTGLGDGIAMPHAKNSAVKEATVLFAKSQKGVDYEALDGQPTYLFFMIAAPEGANDTHLQALAALSRLLIDADFVGKLKEANTPEEVQDLFQTAEEQKEAEEKAEQETQAAEASAHPERKFVVAVTACPTGIAHTYMAEDALKKKAKEMGVEIKVETNGSEGIKNRLTAEDIARAEGVIVAADKKVEMNRFDGKELINRPVSDGIRKPEELINLAPSGTAPVFHGDGKDSSSE

SEQ ID NO: 4301 - protein, 218 aa, Enterococcus faecium
  misc_feature (B) LOCATION 1...218
  hypothetical: YES
KKEAKEWNKRNMKNYIWDFDGTLFDTYPAMVDGAWQALKDFGISMDKKEIYFKMKKYSTSYLINESNLNAREFNELFHRYEKESTEVSRPFPETKQVLEMLKDNGGRHFILTHRLTESTWGLLKEHRLAHLIEEVVGIDQDFPRKPDPASLNYLIDTFHLERTDTMMIGDRRLDIEAGKNAGVATCLYDIDHFLGEIPADYVVGNLNEILTLQSIIKK

SEQ ID NO: 4302 - protein, 177 aa, Enterococcus faecium
  misc_feature (B) LOCATION 1...177
  hypothetical: YES
KEEAVNKYEIRKMTPSDVDLLQQISIETFTDTFGKDNSPEHLADYLTQAYALEKLTEELKDKETDFFLVSIDQEPAGYLKLNTGTSQSEEMADHFLEIERIYVRKKFKHQGIGTFLLDTAIEKAKEKQKTAIWLGVWEHNDVALAFYRKKGFIKYSEHVFYMGDDPQTDYLFIKQLF

SEQ ID NO: 4303 - protein, 67 aa, Enterococcus faecium
  misc_feature (B) LOCATION 1...67
  hypothetical: YES
YKEASIPNNRVNSDKKVIRLFRESTIVICSSGKAIFKGMLGNPAPEPTSHKDKGCVKSTSNANVSES

SEQ ID NO: 4304 - protein, 639 aa, Enterococcus faecium
  misc_feature (B) LOCATION 1...639
  hypothetical: YES
CDFLPVILLKYLLLNPKDINRAGGEKMAQRIPQEVIETVRSQTNIVEVIGQYVQLKKSGKNYLGLCPFHEERTPSFSVAEDKQIFHCFGCGKGGNVFTFLQELEGLSFPEAVVKVADFEQIPLEDQWRQRTIAVQNPESATGKLIAAHEKAAEIYHHMLLHTKAGQPALEYLQSRGLSLELIEEFNIGFAPNERSFLQQVFKNESISNELLERSGLFVTHDDGRMSDRFYQRVMFPLRNSQGQTIGFSGRWLAPEKGQEKDQPKYLNSPETELFNKRQVLFNLDKARSDIRKNGEILLFEGFMDVIAAWQAGIKTGLASMGTSLTAQQIQQMEKLTKELVFCYDGDNAGFEATNRGIELLRQNSRLALSVVVVPEKLDPDEYLRKYGEASFQELVAHGRETVFTFKSRYLKQGKNLDNEKDKIEYLEELLVELSRVVSPIEQDMYLSQLSTEFQIGRETIQKQLRDLRRTNQQNRQEPQESQHTQVTRQETARKKRPLTQVEKAEQILLYRAFKEVSVRNILKEREFQFIHDAYAEVYFLFDAYVSQHYEFNLAEFLDFLQDENLRRLVVEIEYLPVAEESSPREIQDLLDVISKSGLADEITLKKQMQQEARRTGNKQLELELTIEIINLTKQLKQAK

SEQ ID NO: 4305 - protein, 120 aa, Enterococcus faecium
  misc_feature (B) LOCATION 1...120
  hypothetical: YES
NHRALHWKMASKEKEERVNELTEINIKLDVFEGPLDLLLHLIQQMEIDIYDIPIATITEQYMNYIHTMKTLELAVAGEYLVMAATLMAIKSKTLLPVQEFVTDDEDYGKKILEKNWSLSF

SEQ ID NO: 4306 - protein, 76 aa, Enterococcus faecium
  misc_feature (B) LOCATION 1...76
  hypothetical: YES
GKRADRRLDLYTARNERNFIMTNDWLIQQLDELSEKSEYQDRALLYEIKKLMAEIDERTMQLQGEIDGQSWNHLNW

SEQ ID NO: 4307 - protein, 108 aa, Enterococcus faecium
  misc_feature (B) LOCATION 1...108
  hypothetical: YES
QKRAEAFIFEKRLPRSGAVFQKLSDLNIDPASLIQTGKLTTKRAEFPIEEGLLAIDESWGDNLHDFELELEVGDASVGKIAFINFLKRFSLPYRPAKNKIQRMLEAKN

SEQ ID NO: 4308 - protein, 461 aa, Enterococcus faecium
  misc_feature (B) LOCATION 1...461
  hypothetical: YES
RQGAIRMNEVWQDRIPPQNIEAEQAVLGSVFLDAETIIDAMEYIEPKDFYRRGHQIIFETMIELNDRNEAIDVVTVKDRLEQANLLEDAGGLSYLSDLALAVPTAANIVYYAKIVEEKSLLRTLIQTATGIVTKGFEQGEEVQTILDDAERSILEVSEKRNRSGFLSIAEVLNSTIENIDRLAQNNEEITGLPTGYQGLDKMTAGFQPEELIILAARPAVGKTAFALNIAQNVGTKTDRSVAIFSLEMGAESLVNRMLCAEGSIEASHLRTGQLSEEEWSNLIVAMGSLSRANIFIDDTPGIKISEIRAKCRKLAQEKGNLGLILIDYLQLIEGNGKENRQQEVSDISRQLKKLAKELKVPVIALSQLSRGVEQRQDKRPVLSDIRESGSIEQDADIVAFLYRDDYYEREGGDDDDGNEPKNDNVIEVIIEKNRSGARGTVELLFIKEYNKFSSLSPREEF

SEQ ID NO: 4309 - protein, 90 aa, Enterococcus faecium
  misc_feature (B) LOCATION 1...90
  hypothetical: YES
RKGASMMYFVKVYVTYKDSVLDPQGEAVKKAVHRMGYETIEDIRIGKYFEIQLADAEEPIDTVIETICDKLLANVNMETYRYEIKKMEEV

SEQ ID NO: 4310 - protein, 172 aa, Enterococcus faecium
  misc_feature (B) LOCATION 1...172
  hypothetical: YES
MRYLVVSDNHGDRDILVDLVDRYRSEVDIFFHCGDSELEASDPLWDTFQVVQGNCDYGPGFEQKKVIQTGQDTVFMTHGHLSNVRFGLTQLAIEARAATADMVFFGHTHQIGCEMDQKILFLNPGSISQPRGPIQIPSYALIESLDDQISVQYYNRAHQAVEELAFSFSRER

SEQ ID NO: 4311 - protein, 163 aa, Enterococcus faecium
  misc_feature (B) LOCATION 1...163
  hypothetical: YES
YFLAKKKIVKTNAIRMVEQKKIPYTEHEYEWDENHLSASSVAEQLPESQSRIFKTLVAVGNVTGPLVAVIPGEAELNLKKLAKVSGNKKVEMLHLKDLEATTGYIRGGCSPIGMKKLFPTYLDQIAENYDQIIVSAGRRGLQMELAPQDICALTSGQFADIKQ

SEQ ID NO: 4312 - protein, 375 aa, Enterococcus faecium
  misc_feature (B) LOCATION 1...375
  hypothetical: YES
IILAMRILIINLMKEVPSMNEHDEAEWTKNEEQTEDHEETNTSLEEQTSNPLDDTEEIPMLEETKIHEKEKVTPTNTNTAENTHAYEITENPGYLEGKEQDHQDIVSLIETAEAELADLRMRKDLIESDFPQLLESYDRFILNEEPISTIGKTSLIEYFTYELLKPLNDIGLERSNSAYDTWKTRHFSINYTLNGQNELVFSFVLPTIDQRYQVESMSLLNVSPETMEINVQDDRVLSLIRHWSVDRVFSAGQITIFNHKLNQLLAHARTLGFTVNQTLLDNTKPLRLNLQSEFELTNEVLDDIFIVAMKNPSYDMEKINETTYQVRLDKGQSLTITTNEKDQTVLSISSGDYPRSVIDFFINYEFLVPLMVRKS

SEQ ID NO: 4313 - protein, 285 aa, Enterococcus faecium
  misc_feature (B) LOCATION 1...285
  hypothetical: YES
KILADNKRYYYLKLKENFFDSDEMVLLESMPDGYIYSNILLKLYLRSLKHEGKLMFNDRIPFNSTMLATITRHSVGVVEKAVQIFRDLQLIEVLDNGAIYMSDIQSFIGKSSTEADRKRKYRKEIEEAKQNLITSGQMSDKCPDKTTPELEIELEKDIELEKDIENVTPPKKSKAKPIRHKYGEYKNVLLSDEQMEKLKTEFPNDYQERIERLSEYCESSGKTYKNYLATIRSWARKEKSEPKNASGAYKRTGRREKLPEWAIDQEAYQKKKALERANRQSKAPF

SEQ ID NO: 4314 - protein, 129 aa, Enterococcus faecium
  misc_feature (B) LOCATION 1...129
  hypothetical: YES
PTLAISQQKNLILMVLKIPIILTKNGFPITYSIPNPCVNQVKVSHTVRMKPISSHILWEQGYLFLKIIKNLPLKAITISLPPPLNLGMISKNSDPIWPGKQNKNHWKRFFPPLKKLSSSIFQLPSVLWG

SEQ ID NO: 4315 - protein, 86 aa, Enterococcus faecium
  misc_feature (B) LOCATION 1...86
  hypothetical: YES
FILANKSIKKELTKGSKTFPKRRQNQSCERNLIIGVFPSANYSQTTMRHILSNATVEKERNVSKAIVCTNVKHAEKNTPCLMAIIF

SEQ ID NO: 4316 - protein, 86 aa, Enterococcus faecium
  misc_feature (B) LOCATION 1...86
  hypothetical: YES
FILANKSIKKELTKGSKTFPKRRQNQSCERNLIIGVFPSANYSQTIMHHILSNAIVEKERNVSKAIVCINVQHAGKNIPCLMAIIF

SEQ ID NO: 4317 - protein, 241 aa, Enterococcus faecium
  misc_feature (B) LOCATION 1...241
  hypothetical: YES
RRLAMMSCEEKIAAMKQRVLEANLALPRYGLVKLTWGNVSEVDRELGVIVIKPSGVRYECMQADQMVVTDLSGNIIEEDSLKPSSDLPTHVVLYQTFEDITAITHTHSTHSVMWAQAGRDLPAYGTTHADAFYGKVPCTRQLTKEEVREAYEVHTGNVIVETFKERKLDPNEVPGVLVYGHGPFTWGDSPMKAVENSLILDEICLMAKENELINPNICEIPQYLLDKHYFRKHGKYAYYGQ

SEQ ID NO: 4318 - protein, 377 aa, Enterococcus faecium
  misc_feature (B) LOCATION 1...377
  hypothetical: YES
YGLARWNRMTEELQCIGCGAVIQTNKPGELGYTPQTALEKGLASGEVYCQRCFRLRHYNEIQDVSLTDDDFLRLLNELGQKDALIVNVVDIFDFNGSLIPGLHRFVGDNPVLLVGNKVDILPKSLKKTKLTQWMKERAYEAGIRPVDVLLTSAKKSHEMTELLEKIEEYRDGRDVYIVGVTNVGKSTLINQIIKNTAGVQDVITTSQFPGTTLDKIEIPLDDGHFLIDTPGIIHRHQMAHYLGKKDLRIIAPLKEIKPKVYQLNEGQTLFLGGLARFDFISGNRASFIAYVSNDVNIHRTKLEKADEFYQKHVGGLLQPPRPDEVEAFPELVRFEFSVKEKTDIVFAGLGWITVTAPVVIAGWAPKGVDVLKRKALI

SEQ ID NO: 4319 - protein, 118 aa, Enterococcus faecium
  misc_feature (B) LOCATION 1...118
  hypothetical: YES
LIMAQNRIFTTSFASVYPMYVAKAERKDRIKEEVDEIICWLTGYSQTELEYQLQKQVTFEQFFAEAPVPNPSRSLITGVVCGVRVEDIEDNLMKEIRYLDKMIDELAKGKKMEKILRS

SEQ ID NO: 4320 - protein, 91 aa, Enterococcus faecium
  misc_feature (B) LOCATION 1...91
  hypothetical: YES
RYMAKKSKIAKAKKQMAMIEKYADKRQELKAAGDRTALAKLPRDSNPNRLRLRDQTDGRPRGYMRKFGMSRIKFRELAHQGLIPGVKKASW

SEQ ID NO: 4321 - protein, 75 aa, Enterococcus faecium
  misc_feature (B) LOCATION 1...75
  hypothetical: YES
VNMAVKISGVLSDGTGKPVQNCTIQLKARRNSTTVVVNTVGSENPDEACFFILSWHYNKALLINLLPRTGHYQSK

SEQ ID NO: 4322 - protein, 311 aa, Enterococcus faecium
  misc_feature (B) LOCATION 1...311
  hypothetical: YES
ECMASIRDVAKMAGVSVGTVSRYLNGQQLKEKNMKKIAEAISALDYKENIIAKGLKNNRSFSIGLLINGISSRFGSEVVSGIERVAEENGYSLLLSGFADQPEKIEQKIEYLMKHVIDGLIVFLSEEEWSGFEMLTKMSIPVIALNCPEGPAGIDTILVNDRESVAKVIAHHGEQGHKKIGFIAATQTDYVARERLAGAKEAVQNDPSIQLEVFTGDYSRKSGYYGAKALLEKGATAIFVSNYNMSIGAIECFNQEGVRIGKDIAFSHYDYLDKNDLSILPKITITPPTDKIGERAAEQLLIRIQKRRGRK

SEQ ID NO: 4323 - protein, 131 aa, Enterococcus faecium
  misc_feature (B) LOCATION 1...131
  hypothetical: YES
NFMAAKKVNRKRRVKKNIEAGIAHIHSTFNNTIIMITDTHGNALAWSSAGSLGFKGSKKSTPFAAQMAAETATKAAMEHGLKTVEVTVKGPGSGREAAIRSLQATGLEVTAIRDVTPVPHNGARPPKRRRV

SEQ ID NO: 4324 - protein, 139 aa, Enterococcus faecium
  misc_feature (B) LOCATION 1...139
  hypothetical: YES
SKMANVPSIRDMFPDFNDVFSPAFNDFLGVSSYPKVDLVENEKEYKLTADMPGCDKEDTTVEYSDNTLTISANHESHTEDKEDGNYVRKERHSVSYKRSFYLPNVDEEKITGTFKNGVLKLVLPKTAYQPKETKKIELN

SEQ ID NO: 4325 - protein, 104 aa, Enterococcus faecium
  misc_feature (B) LOCATION 1...104
  hypothetical: YES
VLMARLNVNPTRMELTRLKKQLTTATRGHKLLKDKQDELMRQFILLIRKNNQLRQEMEESMTEAMSDFVLANASITEPFIEELFVLPAENVDLCYRDRIRIQPH

SEQ ID NO: 4326 - protein, 280 aa, Enterococcus faecium
  misc_feature (B) LOCATION 1...280
  hypothetical: YES
LAMADTCWSHSYWLICWIIYFKRKKEKEMKKTIALSTVLAGSLLLCTQSVFAENKSSATTEGTISVTKPDAANPEDVVPVPPVDPNDPDTPFTPDEPNQGTSGLLTIDQAPDLDFGTIKLGTAKTVYAALQSGTDSTGAQTQVQNFVQVTDKSGNYAGWKLSVKRTEFIGTTSDTNKLTGSKVKFKNAVIRNSATNSSGMPSTVSGTGAEGIEIPADQAVDLVTAGANEGIGTWIYSLGENVEQGRQSVELFVPVSNYAVDNYVSTFTWSLTDAPTEEEA

SEQ ID NO: 4327 - protein, 247 aa, Enterococcus faecium
  misc_feature (B) LOCATION 1...247
  hypothetical: YES
SKMAEKILVEHLVKKYGDNTVLNDINVSINEGDVVCIIGPSGSGKSTFLRCLNRLEEPSDGEIIIDGAHLMDKSTDINLVRQHIGMVFQHFNLFPHLSILENIILAPMDLKKESREEAEKKAIKLLQTVGLEDKKDMYPEMLSGGQKQRVAIARALAMNPDIMLFDEPTSALDPEMVGDVLNVMKKLAEQGMTMVIVTHEMGFAKEVANRVMFIDDGNFLEDGTPQQIFENPQNERTKDFLNKVLNI

SEQ ID NO: 4328 - protein, 164 aa, Enterococcus faecium
  misc_feature (B) LOCATION 1...164
  hypothetical: YES
GGVARFSEGIYEPITVLILASMVTPFGLTIAYFLGKIIRKNILNRQEIDTLKTAFPMGICQITEGCFPIVLNDLARNVIATGVGGTVGGGLSMFWGADSRIPASGMFAVATMTRPWAFIGALLTGSFVTRITILLLKKPVDPNAEIIHEEKEEEDISWDDLTIS

SEQ ID NO: 4329 - protein, 282 aa, Enterococcus faecium
  misc_feature (B) LOCATION 1...282
  hypothetical: YES
VGVAFFLMKPEILVVVVLYQQLFSQSPAYGPLSKALSEKQIQLIIYDNSPQRQQNELFEKENIVYHHDPQNPGLAVAYNFALSQADEGTRCLVTLDQDTRLVDDYFELLRKVTFTDECVAAVPMIFSGSRQVSPLYSDRYINRTAQAVEVEGPTAERIMAINSGVAWSVKFLKKIGGFNPAFSLDFLDHWLFWKVDQLEKTVEILPVRMEHDLSVLDYEKVSSNRYRSILQAENRFYHEYDQRHLSSHRRQLLLRTAKQFLTVKNRHIWRMTLRSYVKNWKV

SEQ ID NO: 4330 - protein, 135 aa, Enterococcus faecium
  misc_feature (B) LOCATION 1...135
  hypothetical: YES
FFSAPVRGAVFDLLDSPDKFVVGGNALFLTLAAAPHTRRFVNRDPVNQFVQHEAVEFFKAGVFLDKGGEAVNISLCIPNLFQCFFQFCNFCFQCFPFRIIVRDKHRKDMVGQFAAHVVLVGAFQFHIQVSQPFFC

SEQ ID NO: 4331 - protein, 130 aa, Enterococcus faecium
  misc_feature (B) LOCATION 1...130
  hypothetical: YES
SVSANVEEAILRSPNTGRINNGSQLINKLLKAEPNTAPLLPPVELPKTPEAAPQKKCPTTPGMITVVCKPIIANMDSVPTKKLTKKPINTALGAYGKTIGTSNAGLESGTSFLAIPWNAGTISANTIRTP

SEQ ID NO: 4332 - protein, 72 aa, Enterococcus faecium
  misc_feature (B) LOCATION 1...72
  hypothetical: YES
CTSAEHLGRRPGGLKTTTLGVLLIHMRSMLKGRTRAEAFGRTIRQGAVVAGTYFIFCYVDVVCSRHHDFIGD

SEQ ID NO: 4333 - protein, 287 aa, Enterococcus faecium
  misc_feature (B) LOCATION 1...287
  hypothetical: YES
SGSAESAFPDLFFRRENMSQLAESKGLILSSRNYKEKDKLVKIFTESSGKMMFYIKGIHRQNQPLAPALLPFTEAVYIGNFRSEGLSFLSSVKDVHAFRNIQEDIFLSGYGTYLLNLVDAAIEDHQYDPHLFQFTQQALQRMDQGDDAEIITNIFEVQILQRFGIAPIWTHCVVCGETKGKFDYSSKSGGVICEKHWPMDEHRYHADPRAVYFVRMFSAISYDKISGIHLKEETKQAIRDLIDQLYDEYVGIHLKSKKFIDQMKSWAHVLKTPEKNMPEKEIPEKEE

SEQ ID NO: 4334 - protein, 83 aa, Enterococcus faecium
  misc_feature (B) LOCATION 1...83
  hypothetical: YES
LSKAFMTTHLSARVIKEFVIQGGALDGSGDEAVSSYEGFFADEVHRGLYHFNGALALGDHGPHTNGNQFFIVQNTKAQADLLM

SEQ ID NO: 4335 - protein, 927 aa, Enterococcus faecium
  misc_feature (B) LOCATION 1...927
  hypothetical: YES
RSKAQISAFLCYDYENGNKIGCQRRGYVKERQEEILQLLTENQQGLTASDVAERLTIDRSNASRYLSELYKAHHIVKTAGRPVVYSLPTEKSKSDEVHVDSSTQVTFETLVGENDSLKVSIQQAKAAILYPPRGLHTIIFGETGTGKSMFAECMYHFAIDSEMLSADAPFVSFNCADYAQNPQLLFGHIFGIKKGANTGAAQDSPGLIAKADGGILFLDEIHRLPPEGQEMLFTFIDKGIYRPLGESAQVHEASVQIIGATTESSESFLSTFNRRIPMAITLPNLASRSLDERYEIISLFIKQEANRLNQRIDIEKEAILAFMLYDAEGNIGQVKRDLKLVCAKSFLHYRTHHEKKLIIRKEELSLQVQKGLLKIKEIPERLDRFMDSKSQYLTFEPGFADVVWSQDPERNMQVYNDIEEKVTSLSETGVENIDLETLISKDVDAYFQTYVKELTKSSIPKDLLPDEIWRLTNQLYDVAEKRLDRIYNEKARFAFALHLQSTLDRVREGHMIVHPDLNNVRKNFKREFQVAIDLSTIIEEEEQVEIPFDEIGFISMFLSINLGESEPVKENKVDVLILMHGRQTASSMLEMAQELLGTKVGKAFNMPLVMEVQTMYEEVLQYVKNYQEHLTNGLLLLTDMGSLNTFSDLIYEETGIRTKAITMTSTMIVIEAIRMASVGRSLEDIYQNIQLSFESIVRDQFKAEKSETLQRKKAVIVTCFTGEGVAAKLYQRIMPVINQNKVELIQMQFLERESFKKHIDALLEEYEIKAIAGTVDVDYQNIPFFSAYDVFDDEKLNILKRIADDEIPTAKIVDSLAGSLSDVFSIDELIRSLQKTVQQIQTDLSIIVEPGVDTGIVIHLAFMLDGLIKQESHRQFEKLSIFSKIYRLEMDIVRANLMALERKYQVKIPEDDIAFLTQMFLENKIKK

SEQ ID NO: 4336 - protein, 71 aa, Enterococcus faecium
  misc_feature (B) LOCATION 1...71
  hypothetical: YES
VLKAKENDFMSYTLQQEHQILGLIKQRRKQLQDDRAALRKADELSDRQAELIASELEDLRMLEIKNREIRL

SEQ ID NO: 4337 - protein, 63 aa, Enterococcus faecium
  misc_feature (B) LOCATION 1...63
  hypothetical: YES
NQKAVRQLILKIRLMNGFNPYPKIFSNQLPLIVEKNSLIGKVLVIRMILIFISQTQERLPNGD

SEQ ID NO: 4338 - protein, 63 aa, Enterococcus faecium; identical to SEQ ID NO: 4337
  misc_feature (B) LOCATION 1...63
  hypothetical: YES

SEQ ID NO: 4339 - protein, 63 aa, Enterococcus faecium; identical to SEQ ID NO: 4337
  misc_feature (B) LOCATION 1...63
  hypothetical: YES

SEQ ID NO: 4340 - protein, 63 aa, Enterococcus faecium; identical to SEQ ID NO: 4337
  misc_feature (B) LOCATION 1...63
  hypothetical: YES

SEQ ID NO: 4341 - protein, 63 aa, Enterococcus faecium; identical to SEQ ID NO: 4337
  misc_feature (B) LOCATION 1...63
  hypothetical: YES

SEQ ID NO: 4342 - protein, 63 aa, Enterococcus faecium; identical to SEQ ID NO: 4337
  misc_feature (B) LOCATION 1...63
  hypothetical: YES

SEQ ID NO: 4343 - protein, 63 aa, Enterococcus faecium; identical to SEQ ID NO: 4337
  misc_feature (B) LOCATION 1...63
  hypothetical: YES

SEQ ID NO: 4344 - protein, 63 aa, Enterococcus faecium; identical to SEQ ID NO: 4337
  misc_feature (B) LOCATION 1...63
  hypothetical: YES

SEQ ID NO: 4345 - protein, 81 aa, Enterococcus faecium
  misc_feature (B) LOCATION 1...81
  hypothetical: YES
NQKAVRQLILKIRLMNGFNPYPKIFSNQLPLIVEKNSLIGKVLVIRMILIFISQTQERLRYAFLRKRTKPMGQTFFFCCLI

SEQ ID NO: 4346 - protein, 63 aa, Enterococcus faecium; identical to SEQ ID NO: 4337
  misc_feature (B) LOCATION 1...63
  hypothetical: YES

SEQ ID NO: 4347 - protein, 63 aa, Enterococcus faecium; identical to SEQ ID NO: 4337
  misc_feature (B) LOCATION 1...63
  hypothetical: YES

SEQ ID NO: 4348 - protein, 63 aa, Enterococcus faecium; identical to SEQ ID NO: 4337
  misc_feature (B) LOCATION 1...63
  hypothetical: YES

SEQ ID NO: 4349 - protein, 338 aa, Enterococcus faecium
  misc_feature (B) LOCATION 1...338
  hypothetical: YES
IFEATTADPSVAYRAIGVKNMYYPYLRGKQFDLLALKEALSRGLLSNKIQPVIEPVRDSATLKNVIELFQKKHHPIAVIQNPQVGQFKLFDQHVHSWTVKENSSVVPAQILTPENLSEVLDSPPAFLVFDGQHYPKDTEVWKQLAGVDSKFLIPDTSRFRIWLPENKIVIRDSFQTRKHVESYADKTDDFFSDDYLFFHADGYIGFSDFTIEGSRYFDKGFPSRALAIHLTYIDAYGNIRVKHFVSDSNDSAKDQALKFLEAGDKMKKWIMRHHHQLLITSGMIELLALYQQQKFPGLGVLKKWSLMHHLELISHLLDHPKDWLKYYSKVQELYEVIQ

SEQ ID NO: 4350 - protein, 67 aa, Enterococcus faecium
  misc_feature (B) LOCATION 1...67
  hypothetical: YES
LKEANYVAKKSMIAKNKRPAKFSTQAYTRCERCGRPHSVYRKFHLCRICFRELAYKGQIPGVKKASW

SEQ ID NO: 4351 - protein, 234 aa, Enterococcus faecium
  misc_feature (B) LOCATION 1...234
  hypothetical: YES
YGEAKMAFYLPYLLIFVSISGSIWLIYKIFQTRYSLKGSKIRFKRFFFLGFIFYLIIVSSGLFGVLEGNKRVSRSILLGNVTQKYESARDKKKKEQALAQKMEEFTTCYEEMNDIFVNQEKRLTDKNMEKLTRLYQNLPEKQQKEVQDNYERTKKDVQYVKDTKIEEACSDLFGDTNPWFASEEEKKEKQQSVTYERYEILLQQATNMQNPTKKETALNYLKSVKEWLDQQQQN

SEQ ID NO: 4352 - protein, 335 aa, Enterococcus faecium
  misc_feature (B) LOCATION 1...335
  hypothetical: YES
MDFLFPKIKEEKEMKKNIIIGLGAALLLALGGCAQKDNSAEASDGQKTIGVLQLVQHNSLDAAYKGFKEGLAEEGYKEGDNLTIDYQNAQNNQDNLKSMSEKLVKEDPDLLLGIATPAAQSLLNETTTIPMTVSAVTDLEQAHLVTSNEKPGGNVTGTTDMVPIEKQIGLLLNIVPDAKTIGIMYNNGEANSKIQADLAEKELKKAGVKVKVLTANSTNDVQQVTKSLAKDVDGIYIPTDNTFASAASVVGEVAKETKTPVVAGAVDQVKDGGLATVGIDYESLGKQTGIMAAKILDGKNPSELPVETANDLELYVNKDMAKALGINPDSIKEAE

SEQ ID NO: 4353 - protein, 77 aa, Enterococcus faecium
  misc_feature (B) LOCATION 1...77
  hypothetical: YES
LCWAVDDGLSFDDGRRGAFKRLPDRPGWPGDFGISRLGLIVGNPGHVYVFVSGLSFVAIHCRYCHHGCRQCLVPVPQ

SEQ ID NO: 4354 - protein, 73 aa, Enterococcus faecium
  misc_feature (B) LOCATION 1...73
  hypothetical: YES
QKWAASRNKKEFTKIAFQIFVKFRLIFRRSYFWNTVYQRLRKSCPASSNKNSQTKIVPHILRLVELITADASF

SEQ ID NO: 4355 - protein, 137 aa, Enterococcus faecium
  misc_feature (B) LOCATION 1...137
  hypothetical: YES
KRRAFFYTLLIVVFIFPLFSQVTFSMTQPVSSEEHDNLFRATEEFKKYQENIVPETPLASEPITDIDGNQIGWYIQYEVMVVNNDSIVKNTVGLELTPIEKVSSLLTYIYTDESDETEIILTDYSKIATDKKYILWM

SEQ ID NO: 4356 - protein, 68 aa, Enterococcus faecium
  misc_feature (B) LOCATION 1...68
  hypothetical: YES
SGRARLYLFEATDKITEKTIRKKTKIGYEERFHIQLTFVFFSTILFLTNCYVHLPGYFSFVSAKGSFG

SEQ ID NO: 4357 - protein, 86 aa, Enterococcus faecium
  misc_feature (B) LOCATION 1...86
  hypothetical: YES
TVRAVHVNPTIEITMIGHSKGGAEAANSVAINTNAIIFNPATVNLSAYELDSNTYTANMVAYVVEGDALNVVFGGVYTYWRINHVR

SEQ ID NO: 4358 - protein, 166 aa, Enterococcus faecium
  misc_feature (B) LOCATION 1...166
  hypothetical: YES
SIGAVIFDLEGNQIAVGQAEWRHLAVPDVPGSMEFDLNKNWQLACECMRQALHNAGIAPEYIAAVSACSMREGIVLYNNEGAPIWACANVDARAAREVSELKELHNNTFENEVYRATGQTLALSAIPRLLWLAHHRSDIYRQASTITMISDWLAYMLSGELAVDPN

SEQ ID NO: 4359 - protein, 390 aa, Enterococcus faecium
  misc_feature (B) LOCATION 1...390
  hypothetical: YES
KDFFLQKTKKRVSEMSKNRPFTVDHVGSFLRPQSIKEARKKVQEGLLSKEELRAIEDQEIKKLVEDQKAVGIKGITDGEFRRGFWHLDFLEELNGIEGYVPETGYNQTFHGKAAPAYNIRVVDKLSFNPNHPFLKDFAFLKEVVETDDTFVAKATIPSPTMILRQEILSNDGSSKIKEIYPDLSDFYEDLSSTYKAAIHAFYEKGCRYLQFDDTNWAFLADQTKREALLQKGIDPKEMAHICTEIINNALEDKPEDLTITTHICRGNHASSWLFSGGYEPIAEELFSTNYDGFFLEYDSDRAGDFTPLRHWSNKESKVVLGLVTSKFPDLEDTEKIKERIKEAQQFVPLENLSISPQCGFASTEEGNHLTEEEQWKKIQLLQQVAKEVWL

SEQ ID NO: 4360 - protein, 148 aa, Enterococcus faecium
  misc_feature (B) LOCATION 1...148
  hypothetical: YES
EDFFMYSIGQVSEMFGLPVSTLRYYDKEGLFPDIQRVSGIRKFSENELEALRVIDCLKKSGLEIKDIKQFMEWSKEGSKTFEVRKELFEKQKEVVEKEIAKLERVLAMLNYKSWYYEEAIKAGNEEAVLTMIPDDLPQHVKEAYVHSH

SEQ ID NO: 4361 - protein, 66 aa, Enterococcus faecium
  misc_feature (B) LOCATION 1...66
  hypothetical: YES
IVHFAVLKEFDSLFFTPFQYSTQCFFLIYFLQTVVIIFFQHHIKRTDASEWTKFAGNPLFIFISWI

SEQ ID NO: 4362 - protein, 421 aa, Enterococcus faecium
  misc_feature (B) LOCATION 1...421
  hypothetical: YES
PVHLGQEAGAATFWANLRFLVTGIGLPFLGVIAIGVSKSSGVYELAKRINQTYAMVFTILLYLVIGPFFALPRLATTSFEIGLAPFIDPSRQTLYLAIFSIVFFVLAWWFSRKPTKILDYVGKFLNPAFLVLLGALLLLAFLNPLGSVNQAPIQPNYQEHAFFTGFTQGYNTLDALAALAFGIIIVTTIQNMGVTKPAEIAKDTIKSGAISIILMGIIYTLLAYLGAMSLGSFALSENGGITLAQIADHYLGTYGSILLAFIVILACLKTGIGLITAFAETFTDLFPQRNYAFFVALASILPCLAANVGLTNIIQFSLPVLMFIYPLAMTLILLVLVGPLFKQRTAVYRMTTYFTLIASIFDGLNACPETIKQTPIVQNLLYVAESYLPFFKLGMGWIVPAVIGFVIGLIWSFAKKEEVAD

SEQ ID NO: 4363 - protein, 64 aa, Enterococcus faecium
  misc_feature (B) LOCATION 1...64
  hypothetical: YES
ASHFLRIHLLMKSFVVLINESIRSVIVMYRDLTNGSYDCMYQNKSTAYFQSNASNDLFFRRENE

SEQ ID NO: 4364 - protein, 74 aa, Enterococcus faecium
  misc_feature (B) LOCATION 1...74
  hypothetical: YES
ILHLYQNDAQFKEDYDAVKQHLIDVLEPIVKEVYEAARKVIEPVVQSITELVQSNPEYFKALQNNMNQSMLQSR

SEQ ID NO: 4365 - protein, 153 aa, Enterococcus faecium
  misc_feature (B) LOCATION 1...153
  hypothetical: YES
KVHFFKTRNILKAVASGQIIPLTAVKDEVFSSKMIGVGYAITNHDGYIHAPVKGIIDNIFPTRHAITIESESGRKILIHMGLDTVELEGSPFQIRVESNQEVKEGTLLAIIDLKKLEQAQKDTVIIVVSPGIFEGNLLKQNQEVKIKDSCFEF

SEQ ID NO: 4366 - protein, 585 aa, Enterococcus faecium
  misc_feature (B) LOCATION 1...585
  hypothetical: YES
EPPTLNMGVFVGIIAGFVGAMAYNKYYNYRKLPDALSFFNGKRFVPFVVILWSTIVALILAIVWPNVQAGINNFGLWIAESKESAPIIAPFLYGTLERLLLPFGLHHMLTIPINYTQLGGTYEILSGAQAGTQVFGQDPLWLAWATDLVNLKGAGDMSQYEFVLTNWTPARFKVGQMIGSSGILMGLTLAMYRNVDPDKKSKYKSMYFSAALAVFLTGVTEPLEFMFMFAAVPLYIVYSVIQGAAFAMADILPLRVHSFGNIELLTRTPLAIKAGLGIDLLNFVICVILFGVLTYFVANFLIKKFNYATPGRNGNYDNDSEETPSGSATNADQQIIKIIHLLGGKENIKDVDACMTRLRVSVEDPGKVGSEEEWKRAGAMGLIVKDKGVQAVYGPKADVLKSDIEDLLQSGADIPEPTVEATNKNEKNEEKHVLGIEKELFTVATGEVIALTDVNDPVFSQKMMGDGFAVIPATGEVAAPLSGKILSVFPTKHAIGMQTAEGAEVLIHMGLDTVHMSQPAFEILVSEGQEVVAGTTIAQMNLDAIKNEGKETTIIVVFTDDKVNGLTINKLGDTERGTVIGKINL

SEQ ID NO: 4367 - protein, 248 aa, Enterococcus faecium
  misc_feature (B) LOCATION 1...248
  hypothetical: YES
IFNLIGDYHYLPLSGSKYIFIVMEEEMKKIVGLGLILFSSIVLGACGNSNSNSDTPKETTTASSTMVSLEFSSSVEKKTNLLSNDSDFGKIADNVPDGESIEVQGKQDYSTNFNDNSWAGVNLNIDRVSVVKTTDIKDYSDNQYNGFVAVHYNIDNTQQDVSIYPNQATIVTDYGEQVDDGGVFNYDSWDGDFMKGTKKDGWGIYPLSKLPVASSIKSLRLKIDSSYETDNYDDENSYHTYDINLNLQ

SEQ ID NO: 4368 - protein, 457 aa, Enterococcus faecium
  misc_feature (B) LOCATION 1...457
  hypothetical: YES
RSNFTTMGKYFGTDGVRGEANKELTPELAFKLGRCGGYVLSQHEEEGKRPRVLVGRDTRISGQMLEEALISGLLSVGIEVFQLGVISTPGVAYLTRLQKASAGVMISASHNPAQDNGIKFFGADGFKLVDDQELEIEALLDAEVDELPRPSAEGLGTVEEFPEGLLKYSQFLVQTINGDLSGLTICVDAANGATSTSVNRLFADLETDFYTMGTNPDGLNINDGVGSTHPERLAEMVVEKGADAGLAFDGDGDRIIAVDELGNIVDGDKIMFICAKYLAEKNRLKKDTIVTTVMSNLGFHKAVEGIGLKDVVTQVGDRYVVEEMRKNDYNFGGEQSGHMIFLDFNTTGDGMLSGIQLLNIMKQTGKKLSELAAEVTIYPQKLVNIRVSDKNGAMDVPAIKKVIEEAEAEMGSEGRILVRPSGTEPLLRVMAEAPTDEKVNYYVDKIAAVVKEEIGLD

SEQ ID NO: 4369 - protein, 117 aa, Enterococcus faecium
  misc_feature (B) LOCATION 1...117
  hypothetical: YES
GINLKIAYIRVSSIDQNEQRQIEEMKKFGAEKIFIEKQSGATISHRPIFQEALDFVREQDIFIVEAIDRLGRNYDEIIDSVNYLKKKNVRLIITSLPIMAEAIGNPLLDKFIKDLII

SEQ ID NO: 4370 - protein, 85 aa, Enterococcus faecium
  misc_feature (B) LOCATION 1...85
  hypothetical: YES
MSNLENKEEKVVNKIVSVVNKLDKELDELDTLSENPEKKHNLKKWLVERKAIHEIKKVLHEADKYEKYDEKELDKEFKEINDLLL

SEQ ID NO: 4371 - protein, 69 aa, Enterococcus faecium
  misc_feature (B) LOCATION 1...69
  hypothetical: YES
FIFYFLDNYFLIIILDVVTKTFVYIPMLFVCSFHYPAKLFTRGEYMIYIQAIVFVTLMVGLLIGLKENS

SEQ ID NO: 4372 - protein, 61 aa, Enterococcus faecium
  misc_feature (B) LOCATION 1...61
  hypothetical: YES
PIFYVTNRKNLPRHSPKEIVDRSSLLLIFLMILSSFRSLDNIFKQAKNDKIQVMRMINSAD

SEQ ID NO: 4373 - protein, 61 aa, Enterococcus faecium
  misc_feature (B) LOCATION 1...61
  hypothetical: YES
TVFYLIKIFKGGTFDSYPFFAFIFVIRTNYEVIYSKFYFFVKTRLFLSREKQGYDKLNTTS

SEQ ID NO: 4374 - protein, 100 aa, Enterococcus faecium
  misc_feature (B) LOCATION 1...100
  hypothetical: YES
MPFYFSNLILQFALLKNGAPVDIATLENAKEVFGESNIFSTTIKNMERLKRYDLTGITDEDMHDKKVHNVCLVDSLTDEQQHTFKNQFEVLRKRTMEREK

SEQ ID NO: 4375 - protein, 108 aa, Enterococcus faecium
  misc_feature (B) LOCATION 1...108
  hypothetical: YES
CAFYFDSRSCHMINLGEWGAIAGSITAIVSLILLVIKPITASFSKITETLSKVSHNLDLLTKDLESSKSDRLMIHEELKTHDERLDTHAEKLVEHTQQIKTLFRERRK

SEQ ID NO: 4376 - protein, 312 aa, Enterococcus faecium
  misc_feature (B) LOCATION 1...312
  hypothetical: YES
KAFYIKRERKVVLLLTNNQSSNLVKKTLTYSIDTHLHLSAAPYFRLLINESANLYAEFAHKSIELDNPSLLFIDKQQEVQIFSTQKETQTFIIIQFYFDEQLLAHITGQSFSIDQEITSIITFLKNEQFKIDYLKHSKPAISYDQEINSFFILCQQMSIHLLSLLVTYCLQKIQLSSLPRHYQQELALLTIPSNEKVIPKKKHILYSDELVDPIIRYLEEHLSENFLLEQLAQIFFISPASLKKHFRKVNGKSVISYFKELKMEKAKRLVLENELTYTEIADILGFHSIHHFSSAFKKYTGLSPSKYYLSLK

SEQ ID NO: 4377 - protein, 75 aa, Enterococcus faecium
  misc_feature (B) LOCATION 1...75
  hypothetical: YES
FYFYFIDLLFLNKNNREEKYNILTRFLFKKDFLAVHINRLKSLFLYFFNLLHTLFNIDIYTVKHAFHPLSKYFYR

SEQ ID NO: 4378 - protein, 77 aa, Enterococcus faecium
  misc_feature (B) LOCATION 1...77
  hypothetical: YES
TYFYNLLIDSRWRKKMNPYEQLIQDLIDGKIEKIDVKREELMAFREAWLKLENRKYVVGKASLNGNVTYHYDPTRLF

SEQ ID NO: 4379 - protein, 134 aa, Enterococcus faecium
  misc_feature (B) LOCATION 1...134
  hypothetical: YES
RSFYMYSFTNKHSKVFGYVSVLFTGLGFTIVSPVLPFLTLPYSHSIHQQAFYITLLMSVYALAAFLSAPILGSLSDHFGRHPILIISLLGSSIGYLLFGLGNSIWMLFLGRIIEGLTAGRNLHLICLLCRHHGT

SEQ ID NO: 4380 - protein, 111 aa, Enterococcus faecium
  misc_feature (B) LOCATION 1...111
  hypothetical: YES
SIFLLLSTYHCYSLNVGEKKIKGAGILLVMSKALFLLPCTFMFIVLCYFKRRKKWCWIDVLLFLPFFPLIYFLEEIWDDMACDSAFLFSHSLGLMISLTIFAIVLFFLNKK

SEQ ID NO: 4381 - protein, 251 aa, Enterococcus faecium
  misc_feature (B) LOCATION 1...251
  hypothetical: YES
TPFYLSHTFILPTCNLAPVLETCYTKYVKLLTRSVVMREKTDTLPKATAKRLPLYLRYLKMLDDSGISRIKSNEFSEITQIPSATIRRDFSQLGELGRSGYGYDVPFLIDVFNNILNTKEEKRIALVGYGNIGKALKHNNFRRNENLNIVCVFDNDPALINRVIDGEMIYPIDRFAEIAKAKNVTVAISTVPSKYSQSAIDEIVKGNVTAILNFAPDRVTVPAYVNVQYIDLTTELQTLIYFDENYSEVFS

SEQ ID NO: 4382 - protein, 78 aa, Enterococcus faecium
  misc_feature (B) LOCATION 1...78
  hypothetical: YES
TEFYFRGWRDRKINRENLPTQKIPRLTNYFLSCTNPKEIEFLVTDMNATYFQLTKHVLPNAKLVIDRLLGFSTPFKEA

SEQ ID NO: 4383 - protein, 71 aa, Enterococcus faecium
  misc_feature (B) LOCATION 1...71
  hypothetical: YES
KRFYFGGCLHGYRATEKRNWFNSTCCLSNWFSDWRWRIWYYDGHLRIGWRPSYFQLGTRRNSNVDALLVDQ

SEQ ID NO: 4384 - protein, 98 aa, Enterococcus faecium
  misc_feature (B) LOCATION 1...98
  hypothetical: YES
EENLMKITVPDELIADELTEQIVRKVLDALDERLKVMNKSVELPPYPNKSEVKKVLGIGDDKLTHWINLGLKTQQWSKLDIRIERSELQRFLKENFEF

SEQ ID NO: 4385 - protein, 104 aa, Enterococcus faecium
  misc_feature (B) LOCATION 1...104
  hypothetical: YES
GELYMLMEGKTQLWFKFDPSNKFIKDFHKVWDSEVFFLAIEDSLLINLYYSNKNYFKIPAAKTRMKKDVYFLFDIVTDVPDARSDHRRYDYIKYTFVDPERYID

SEQ ID NO: 4386 - protein, 507 aa, Enterococcus faecium
  misc_feature (B) LOCATION 1...507
  hypothetical: YES
ALIYFGTGISSRKGENMDNEMISQLQFDRIKKEIQARAIGNYSKKRISDMTVSTNLQTVLDRQEETREARLILESSQHVPFMGLPRIDALTEQVKKGLILQPTDLIEYADFLRSSRMITKFFDKNQYQTPLLFAYSKHLPDLINVEELIDQKIKNNKVSDDASRNLRKVRKQLQLIEKEIQSKLLKFLRHPKNKEMIQEAMIVQKGEYYTIPIKASYKNKIDGTIIDESNKRTTVFIEPTVISKLNEHYQLLKAEEISEEYQVLAALTGAIAENEEVIDLLIETITVLDIIFARAKFSREINGSTPRINKSEHIIIKQGRHPFLPEHAVPLDVEIGKDYRGLIITGANAGGKTVVLKTVGLLTLMAMFGMQVPAKEGTELAVFDEIFVDVGDHQNLENALSTFSGHMQNIAAILKKIKRNTLVLLDEIGSGTEPNEGAALAIAIMESMYEQGALIIATTHYGEIKKFAGDHEDFVPAAMAFDREALRPKYQLRVGRNRRKPSFVDCS

SEQ ID NO: 4387 - protein, 81 aa, Enterococcus faecium
  misc_feature (B) LOCATION 1...81
  hypothetical: YES
ALIYFGTGISSRKGENMDNEMISQLQFDRIKKEIQARAIGNYIKKRISYMTVSTNLLTVLDRPEETTEPRLILQSIQHVPI

SEQ ID NO: 4388 - protein, 770 aa, Enterococcus faecium
  misc_feature (B) LOCATION 1...770
  hypothetical: YES
FVIYGGRSKHAMNEKQLEQTHVDETIELIQIEQNMLDTKQQELTQEMNHSTKDTANHKIRAGSNEAFYESAVEYRQHEQELLLKYHTLEAQQKRLQTLSVMKDSPYFARIDFKEDRETETLYLGIASLRDLAEETIVIDWRAPIANLYYEGEIGPAFYETETDRIDVDLQLKRQFKIQEGRILSMVDTSEVINDDFLLEILDESSSNHMKNIVSTIQKAQNAIIRDTTSKVMLIEGIAGSGKTSALLQRIAFLLYHNRKWLEAENVLLFSPNHLFSDYISTVLPSLGESGVPTQTFKNYLVQLLPEFSLLDEQQQESGFLLGEKDPIQVMKSGLTLVDQIDRYIQGITNYGPLFRDMKINGRTILSKESIRQWYKETNEQLPLHHRLSLLQTKLLKKLGGLQKDETRQQWVKDLAEEQLQELYATDPNLEYTEQKERSLRKKLANQIVRKRFRRIHRGIMNYQFVNITKQYLHFLQTVPLSLLTRHKISETRWQEHLTTVRTHLRQRELRQEDAVLFFLLMRRTYPVTVTHKARYIFIDEMQDFAPSQVALLQALFPKANLTFCGDLNQNVFGNETIVGSLEDLFVDREVTRFQLTTSYRSTKEITDFANHFIVKEHQVETTARKGDLPLLIQGTTDDIKLNWLADTIRTTQGKARYWRTAIIAKTQEECEALYAQLPDELKQQVQLILNESDFMKRSIILLPAFLAKGLEFDRVFLWDVDAEHFSSQQDKLILYTMCTRAMHELTLFTSNNESPLLNNMDISSYEKKVL

SEQ ID NO: 4389 - protein, 184 aa, Enterococcus faecium
  misc_feature (B) LOCATION 1...184
  hypothetical: YES
IIIYGSEFDQGRQSRAEIVGSPLGQPPQQFGKTVDSDQMEKPSRQKKNQGHDLVPGIQEFWKKVHPHADLYIVTNGVSHTQHRRLTDAGMLDYFKDIFVSEAVGAQKPMKEFFDHVFSHIPNFDKKQTVIIGDSLTSDIKGGNMAGIDTIWFNRNKLPEIEEIQPTYRIDSLEELYSLLEIEKD

SEQ ID NO: 4390 - protein, 319 aa, Enterococcus faecium
  misc_feature (B) LOCATION 1...319
  hypothetical: YES
ESIYIKQVLKWLILEKPLLLPGRWCLYLLYYRLFNLNSEVIKMTKQKIQSRIFTYVIIVFGALIFLMPYLYMIVASTQSNQEILSGGINFKFGDMLLKNWQAIMARYNYPLIIWNSIVIAVISTVLATASSTMAGYALAKYRFMGNKLLFNTVMLSRMVPFFTTLIPLFYIMSRLGLSNTYAGVIIPSIASTTSVFMMRQYSSQFPTALMEAARIDGANEWVIFTKIAVPILSPTIITSGLLIFMGSWNQYLFPLVMLSDKDKYTVPLIIKNMTVSSTGEPINYGAIMLILATSVIPMVLIYVWAQSKFKENDIGAANK

SEQ ID NO: 4391 - protein, 164 aa, Enterococcus faecium
  misc_feature (B) LOCATION 1...164
  hypothetical: YES
MKIYFAAPMFAKSDLLYNQQLVKEIRELSSELSIYLPQENEAINDKTAYADSRMIALADTEKVLASDLMIALLDGLTIDAGVASEIGVAYAKGIPVIGLYTDTRQQGGTHPKKIAALQETAENQFHYLNLYTIGLIKLNGKVVSSEIELLSEVKRFLDGGTFSD

SEQ ID NO: 4392 - protein, 68 aa, Enterococcus faecium
  misc_feature (B) LOCATION 1...68
  hypothetical: YES
EGIYENCFSNFCDISAYCRRSNSKHRRSNDKKSHYIRSICRKRQTCVSRFLRNQISKVKPSASMARYK

SEQ ID NO: 4393 - protein, 867 aa, Enterococcus faecium
  misc_feature (B) LOCATION 1...867
  hypothetical: YES
KVIYLLKNTIQWLKNHLGLFKTIFLISVIVIIVGELMSIGKTLSIQQLGETFATIPVWKSGLMLLIGLISVLPMVGYDIILNRMLEQKQNPRYLFETSWLINTINNIAGFGGFVSVGLRSELYGQKKESRNVIQALSKVFLFLMAGLSIYSLLSFLLVVFTPVAPFLKQYWIWLIGGGLYFPVVFLFTTFKKKGFLGGTSLKTQGQLLLVSLLEWTGVLFSFLSVGYLMEIRIDLWQTIPLFIAASVIGIVSMIPGEIGSFDVMMIIGLSAIGVPREIVVVWILLYRLFYYIIPFLIGIVFFFKNIGSTFDQRYSGIPKQLATEIAHKIVVVLLYFSGIMLVLSATIPQAFTEFRWLHSLNPLKFHFIIQFPSILLGFLLIIMGRGIAARVKRAYLPTIFLIVLALLYVLLSDFSFTPVVFLSILLLIILASKNELFREQLIYSWEWRTIDGIIIGALSLLYIVIGVYNLPDFPHRRHHFISFFLFPSEKIWFSGLLAIIAVSFMIVLFVHFLQGEKKQIGEAFNEEKALKILTTYGGNSDSQLIFLKDKRMFAYEKDGEPTVLLQFACFNNKCIVMGDPSGKKEDFPEAIEAFIEETDRLCYLPVFYETSEEIVMILHEFGYDFIKMGEEAYVDLNSFTTSGKKMKGTRAVLNRIEREGFTFDVLQPPFSTEQMSTFKNISDNWLGSRKEKGFSLGFFSEDYLQRAPIAVVKNTQEEIVAFATIMPTYTNNKVGTIDLMRYDSKKAPSGSMDFLFLHLFAYMKEEHIQWFNLGMAPLSNVGTSRKSFLQERIAYLVYEFGSHFYSFHGLREYKSKYATNWVSRYTLYSRDSWIAYVMIALLIIDNAPVEQTQGRISGLKKWIRRKY

SEQ ID NO: 4394 - protein, 63 aa, Enterococcus faecium
  misc_feature (B) LOCATION 1...63
  hypothetical: YES
LNFLTLSGTLEKTTTRRRENTMMRMTKITSNENYQRYHIAFSHAIGFTVAVDGTSLSKTVEFT

SEQ ID NO: 4395 - protein, 141 aa, Enterococcus faecium
  misc_feature (B) LOCATION 1...141
  hypothetical: YES
NRNFTNQNGNREADFINCVIWRKPAETMATLAKKGSLIGVVGRIQTRTYLTKFPGVGKKTAQQMILDLKGKFGELSIDTPFSLFDEANTKDATALSEAMEALSALGYSDREIKRVEKQLKEVDNQTTDEYLRQALKLMMKK

SEQ ID NO: 4396 - protein, 113 aa, Enterococcus faecium
  misc_feature (B) LOCATION 1...113
  hypothetical: YES
YHVYEMKKGAVMMEKMRQQLMEWGKELETFRLPHWEELPDLELYMDQVRTLVDRYLSPVIQGEKHPLLTSSMVNNYVKLGLIPAPVKKRYNKEHVAFLLAITTLKQVLTIPEI

SEQ ID NO: 4397 - protein, 393 aa, Enterococcus faecium
  misc_feature (B) LOCATION 1...393
  hypothetical: YES
EDFLMTKFTIEIMQTLLNKGDLDELFQDHLERAINSLLQAELTAFLDYEKYDRNGFNSGNSRNGNYSRTFKTEYGELNLTIPRDRNGEFSQQTLPAYKRTNDSLETTIIQLFQKGITMAEISKLIEKMYGHHYTPQTISNMSKLVAEDVLAFKERTLEANYSVIFMDATHIPVKRQTVSKEAVYITIGIRLDGTKEVLGFTIAPTESAYIWKEVLQDLRKRGLEEVLLVVTDGLSCIEESIHSVYPNAQFQQCCVHVSRNIAHKVRVRGRKEICEDFKLVYQANSKEEALDHIDFMTRKWKKQYPRVVNLLLNPALLTFYNFPHAIRRTIYSTNLIEGFNKQLKRYTRRKEQFPNEESLERFFISQFNQYNQKFLGRIHKGFKEIQDTLESMI

SEQ ID NO: 4398 - protein, 168 aa, Enterococcus faecium
  misc_feature (B) LOCATION 1...168
  hypothetical: YES
IIVYIGEKMEDLGSKLRELRVKKGYTQEYVARKFNVTRQTISKWENNKTTPDIETLKKICEFYSTNINSILNEDNLKNKQNNLLVLTAIIFNIFVTILGLFELIQMNFFSFTHGIFTWFALSGLIVIDILNYFYIYYSYLKNEKFFYTIFFPLVILIIWFCCKVLNKE

SEQ ID NO: 4399 - protein, 60 aa, Enterococcus faecium
  misc_feature (B) LOCATION 1...60
  hypothetical: YES
NSFLDSSSIPVVGSSRTNKSGSVAKIRAKLIRCFCPPDNSPIRRFRISHIPTASKARCTC

SEQ ID NO: 4400 - protein, 149 aa, Enterococcus faecium
  misc_feature (B) LOCATION 1...149
  hypothetical: YES
KPFLPEEKQKMTTEEFRQEILLKIFGVESVEEVKTYELTDEDWKKINRISEEYYRNWDWNYGKSPDFNFSRQKRFSIGSIEVHLNVSEGMIKEAKIFGDFFGLGDISDVEKKLVGQKYDKASLSKIVSQIDVKKYFGAIEPEELLTLLY

SEQ ID NO: 4401 - protein, 69 aa, Enterococcus faecium
  misc_feature (B) LOCATION 1...69
  hypothetical: YES
RTSYIIKVVVDLCFKSFSPNAFPSSAIAFRIATLDHEIFDDAMESQSVVVTVFCMCHKVFNRFWCVFGK

SEQ ID NO: 4402 - protein, 289 aa, Enterococcus faecium
  misc_feature (B) LOCATION 1...289
  hypothetical: YES
RRFLMKKLKLFLPIIGLAILLSGCSKWIDRGESITAVGSSALQPLVKTVAETYQTENPGKFINVQGGGSGTGLSQVQSGAVDIGNSDLFAEEKSGIDASALVDHRVAVVGITPIVNKDIGVKDISMENLKKLFTGEIKNWSEVGGKDQPVVILNRASGSGTRSTFEKWVLDGETAVQAQEQDSSGMVRQIVADTPGAISYVAFSYVSDDVDTLNVNGVEPTDENVTTNKWTIWAYEHMYTRDHPKKLTKEFLDYILSDEVQDNIVGELGYIPVSHMKVERDWQGNIVKE

SEQ ID NO: 4403 - protein, 114 aa, Enterococcus faecium
  misc_feature (B) LOCATION 1...114
  hypothetical: YES
ERSYPSMLSGGQQQRVAIARGLAMNPEMLLFDEPTSALDPEMIGDVLDVMKKLAHDGMSMIVVTHEMGFAKEVADRVIFMADGEVLEDSRNVRDFFENPNEVRAQQFISKVINH

SEQ ID NO: 4404 - protein, 69 aa, Enterococcus faecium
  misc_feature (B) LOCATION 1...69
  hypothetical: YES
SLPYNLPCQKLLRTSTCLYSSNDGQNRADDSCNRVPKRFQENTQANYSSSSPFMKHLFIFSIKKRLRKK

SEQ ID NO: 4405 - protein, 78 aa, Enterococcus faecium
  misc_feature (B) LOCATION 1...78
  hypothetical: YES
TWFLFYYLFPEAEVLLDGVWSFAASAPLVAGSLEEAGGADEDGVELSSDEEEGTVVEDAGSLVSAVVLSFEDSAVDSL

SEQ ID NO: 4406 - protein, 160 aa, Enterococcus faecium
  misc_feature (B) LOCATION 1...160
  hypothetical: YES
GGAYYLLKHCRKGFCKVIKGKNAADLIFEWKESNLINVRGKNGSGKTERVMASIDNSRPRSRALVITDEKNHYKGIRTIEKKYLTNNDLKVVDDILNIYPDFNLVVFDETIPVTEIKGFYQSFSNLANKYEEVLFVWITEEDSNSKSAFFSEKNAFLHSI

SEQ ID NO: 4407 - protein, 76 aa, Enterococcus faecium
  misc_feature (B) LOCATION 1...76
  hypothetical: YES
SGAYKEVPPEQERNFLPGHGARDCPSREAAKESLESPRMGRVIPKSSAAFQRNNPAVVGGKTGTVWTVQDIAAGYD

SEQ ID NO: 4408 - protein, 247 aa, Enterococcus faecium
  misc_feature (B) LOCATION 1...247
  hypothetical: YES
HMAYETFAFIYDEVMDETLYQQWLAFSKRHLQEDTKNILELACGTGALAVAFAKDGYKVTGLDLSEEMLMIASQRAYEEDASIQFVEGNMLDLSEIGQYQAITCFSDSLCYMKNRQEVQQVFDEVYQALEENGRFLFDVHSTYQVDEVFPEYSYHYQGDNFAFLWDSYPGSEKHSIEHFLTFFVEEQEGSGRFIREDELHQERTYPLESYLRMLENSGFSKVEAFSDFTDEAASEKSKRWFFVAYKD

SEQ ID NO: 4409 - protein, 817 aa, Enterococcus faecium
  misc_feature (B) LOCATION 1...817
  hypothetical: YES
EVAYLKEVVMIDAARTPIGKYRGSLSPFTAVELGTLVTKGLLDKTKLKKDKIDQVIFGNVLQAGNGQNVARQIALNSGLPVDVPAMTINEVCGSGMKAVILARQLIQLGEAELVIAGGTESMSQAPMLKQYQSETNEYGEPISSMVNDGLTDAFSNAHMGLTAENVATQFSVSREEQDRYALSSQLKAAHAVEAGVFSEEIIPVKISDEDVLSEDEAVRGNSTLEKLGTLRTVFSEEGTVTAGNASPLNDGASVVILASKEYAENNNLPYLATIKEVAEVGIDPSIMGIAPIKAIQKLTDRSGMNLSTIDLFEINEAFAASSIVVSQELQLDEEKVNIYGGAIALGHPIGASGARILTTLAYGLLREQKRYGIASLCIGGGLGLAVLLEANMEQTHKDVQKKKFYQLTPSERRSQLIEKNVLTQETALIFQEQTLSEELSDHMIENQVSEVEIPMGIAQNFQINGKKKWIPMATEEPSVIAAASNGAKICGNICAETPQRLMRGQIVLSGKSEYQAVINAVNHRKEELILCANESYPSIVKRGGGVQDISTREFMGSFHAYLSIDFLVDVKDAMGANMINSILESVANKLREWFPEEEILFSILSNFATESLASACCEIPFERLGRNKEIGEQIAKKIQQAGEYAKLDPYRAATHNKGIMNGIEAVVAATGNDTRAVSASIHAYAARNGLYQGLTDWQIKGDKLVGKLTVPLAVATVGGASNILPKAKASLAMLDIDSAKELAQVIAAVGLAQNLAALRALVTEGIQKGHMGLQARSLAISIGAIGEEIEQVAKKLREAEKMNQQTAIQILEKIREK

SEQ ID NO: 4410 - protein, 77 aa, Enterococcus faecium
  misc_feature (B) LOCATION 1...77
  hypothetical: YES
CLNFFGDRFFQPYKINRNSIIESCDYKKIARKKKKVSIHFKYFIPISIAKKVEILYLPLTLASLANVVSILIDNKLR

SEQ ID NO: 4411 - protein, 514 aa, Enterococcus faecium
  misc_feature (B) LOCATION 1...514
  hypothetical: YES
VVYYQMHLLGGMQNMNFMKRAWKSTKVKWGRSLLLFAVFTAILIFVLAGLTIRSAAEEAANQAQKEVGATVTLSANREASFKKQEQTSSSGSTTEERPDPGSFSLTPVSLTDAEKIAELDNVKSYSFESSASAMAKDGITAITSSDSSEDSSETTDAGGEPAGGMGGNPQMTQADFQISGVSATAQNSNFSDGTAKITDGEGIDDSDKGTNNVVIDSTLAETNDLAVGDTFTITSTEDEDTTYEMTIKGIYESSETSGSMGMKFNFMNPSNTLYTSYTFANELNGTSDDNTIDSAIYTLSDPDKMDEFLKEAEKLIDTDTFSLQSNDSMYQSMLEPLNNVASFSKNVVLLVAVAGIIILTLIIMITIRERRHELGVLLSLGESRSKIILQLFTEVAICMILALGVASLSGNVVANAVGQQLLDQQTETTTQNQQAPGGGQMPGNRQEQGGQRDGQQGTTNNPFAVSDQVSELEINVKPAQLGLLAGVAFGISLFSVFLASIGILRLNPRKILLN

SEQ ID NO: 4412 - protein, 230 aa, Enterococcus faecium
  misc_feature (B) LOCATION 1...230
  hypothetical: YES
LFHYEKVKRMFKGVLFDLDGVITDTAEFHYRAWKKLGDEIGIPLDRSFNEQLKGVSREDSLTLLLAHGKKEEQFSKTEFLELAKRKNDYYLEMIQSITPKDVFPGILELLKDLRANNIKISLASASKNGPFLLAKMGLESYFDAIADPAKVANGKPAPDIFLLAAKEIGLTPRDCIGIEDAKAGIAAIIASGAQPIGVGRSEDLGEDIPIVPDTASLTFDYLKKTWQPNA

SEQ ID NO: 4413 - protein, 121 aa, Enterococcus faecium
  misc_feature (B) LOCATION 1...121
  hypothetical: YES
FSHYCCPPYPINSSTDLPRSSATSSARFNCFKPSTVARTTLIGVFEPKDLEVISATPANSNTARTGPPAATPEPSTAGFIRILPPLKAPITSCGIVEPTIGTSTKFFFASSIALRIASGTS

SEQ ID NO: 4414 - protein, 224 aa, Enterococcus faecium
  misc_feature (B) LOCATION 1...224
  hypothetical: YES
VTNYFAGGQFIYTKLLTLPMFNEGLKELKRTGEYDKIIKEYVADGSETSSESSTADESTFLGLIQNNYQALLKGLWRTILLTLISFALAIVIGVIFGLFSVAPIRALRTIASIYVDIIRGIPMMVLAFFIFFGLPGIVGFTIPDFLAGVITLTLNASAYIAEIVRGGINAVPVGQMEASRSLGLSYNRTMQKIILPQAIRIMIPSFVNQFVISLKDTRSFPQSV

SEQ ID NO: 4415 - protein, 71 aa, Enterococcus faecium
  misc_feature (B) LOCATION 1...71
  hypothetical: YES
TNNYGYVKRIETSGGITVLIVHHDLSKVKKYFDNIILLNRNLIAHGSVESVFNEENLKKAYGDTIFIGEGE

SEQ ID NO: 4416 - protein, 493 aa, Enterococcus faecium
  misc_feature (B) LOCATION 1...493
  hypothetical: YES
LSNYIYILQILYRRKIIMDSGFLWNITSTVLALFIPIATFLFENENAVDWDKMVVFDQVIKIKKLSFGLILLTLPLLFYQTNSASNEFYRKLNCIVLLLYVIGISLSILSLVRCYFWIINKRTYSKNNSSETVKYRTECRKRYISNLSKNEAVQKEIWSLIWNSVDQHGEIEEIDLMDMYIDQCEENKDYEKKLKFLSIFFTSIDMNKFDEINTYNTIDYDVYERLSKFIYSEIKCVYLEGKNIDIKKVNDFFDIYTKNSIFNWNSSNRYNQFLSQFLEELSGEEYRLFLNNNILKLISYAKKANSLSLVDNLDNLLPDKLIYDENEDNSQKQIIIFELYLKWLSSLSVSPESNDDDKYFANKLFQFIFPDYSSMPFFTLINFMLYVKEHLGYDDLVEMIKAYDKEPYPFKGINTGSDMAMISGETVEEILANYKEQNIKTLELIKKNIKYYDPLLANKENIDKLLNAIADSDVRSPRIDELKEEILMYKELF

SEQ ID NO: 4417 - protein, 153 aa, Enterococcus faecium
  misc_feature (B) LOCATION 1...153
  hypothetical: YES
AFNYNVVPNFVQQKNPEQVKKAFEEXGPTFIKIGQMLSVREDLLSSAFTQTFKTLQDSVPSDTFSTVKKTIETELSLSLSDIFDDFSKSPFASASMGQAHRAKLKNGDAVVVKIQHPNIAEEIRLDLQLFERAIPLIKYIPETSVVDLKGGPI

SEQ ID NO: 4418 - protein, 60 aa, Enterococcus faecium
  misc_feature (B) LOCATION 1...60
  hypothetical: YES
TVNYKRLMKLNQLKNGRVIARFLVEVTKSGHIIIMTRRKSDKKLAKNIAECLIKLSVLAK

SEQ ID NO: 4419 - protein, 391 aa, Enterococcus faecium
  misc_feature (B) LOCATION 1...391
  hypothetical: YES
SKNYISLRTIQRKLRELNTILKNYHLSCSLKKGNPIEGEEYRIRYFFHLMYWQSFDENHSDILSSIKNKRQLLEKFAKHAPYTRSIDRKKWISLLRISLQRMKQGHSITYVPEEMNKFVHPLITKEEFTHYILEPFFEANFWSMNHITPTEQAYLYFMFGVMNTYLEEDLLDTPDKVQESWGWIESSIVENFEKNFKICFTTSEKNYLYVNLAMIHLYSRVFGTKKKVDAFGKSAEDRDFQHIFPVMYPIMQQFFSGVARRIPELNTYYEKNRRLIFQYCMLVRDIFIKHEQPVIFYIQSKYGKTQELWAKKRILSMTERPIKYSASADQLPDIVISDYPIDKKAYDQTNTQIFYWNGQPTKNDWARLKAEIIKIRNEKNRSILEKLDFVN

SEQ ID NO: 4420 - protein, 76 aa, Enterococcus faecium
  misc_feature (B) LOCATION 1...76
  hypothetical: YES
KKNYNKLKTPAQIASFIPIGGVGTWVITNAFSSAVDAMNVFVRAANQGKGVQLTYNAHFSNTTSYQYNDYARYVIK

SEQ ID NO: 4421 - protein, 131 aa, Enterococcus faecium
  misc_feature (B) LOCATION 1...131
  hypothetical: YES
MKNYPLLLTPVIRMMPVIILKKTFSGVMEEFDKIIGLDRLKVLHINDSKNPQGSHKDRHANIGFGTIGFDTLNKIVHDPMFDNISKILETPYVGKDKKKAYAPYGKEIAMFKAQTFDPEVFPELLAQEVIL

SEQ ID NO: 4422 - protein, 153 aa, Enterococcus faecium
  misc_feature (B) LOCATION 1...153
  hypothetical: YES
LMNYEFFLSKEDHRSYSLLKYLEASSNLSESISNVQEELSLSTFLLKKTIDKLKHDLQKFDLEKNLRVTVSELDICLEINGKCSSKALLSRYITDSLSMKMVLAFFQEKYISVENFAKQHHVSYSVAYKVLQRLKRNLKKYQIFFEKRKLTRV

SEQ ID NO: 4423 - protein, 214 aa, Enterococcus faecium
  misc_feature (B) LOCATION 1...214
  hypothetical: YES
QPDYIGDREVTRMENGFLFLDEMLHGVRWDAKYATWDNFTGKPVDGYEVNRIIGTKAVALALREAQIHAAALGYGLLLWDGYRPKSAVDCFLRWAAQPEDNLTKEKYYPNIERAELITKGYVASQSSHSRGSTIDLTLYHLDTGELVSMGSNFDFMDERSHHTAKGIGNAEAQNRRCLRKIMESSGFQSYRFEWWHYKLIDEPYPDTYFNFAVS

SEQ ID NO: 4424 - protein, 139 aa, Enterococcus faecium
  misc_feature (B) LOCATION 1...139
  hypothetical: YES
LKDYLKSLSRIKPNGRKALDIETALNQWFSRFPKNFFKSITFDCGKEFSNWKAISNQHDIDIYFADPGTPSQRPLNENSNGILRRNGLPKSMDFREVNQTFIFSVSNQRNHIPRKSLNYRTPIEIFLSYVQEAFYSSLI

SEQ ID NO: 4425 - protein, 655 aa, Enterococcus faecium
  misc_feature (B) LOCATION 1...655
  hypothetical: YES
KEDYDRVYRKIRXMXLGTALYRKSTKNVCKDKTKGFSCSWKHSYEFIIESKMFFMCGIVGMIGLKNVTPGLIDGLEKLEYRGYDSAGIFVSDGTTDYLVKAQGRIQNLKNKINIDTTGNIGIGHTRWATHGQPSEENAHPHTSQSGRFVLVHNGVIENFEELKIAYLANDHFIGETDTEIIAHLIETFAKDTTTQEAFLKALRVIKGSYAFALIDRTAPDVIYVAKNKSPLLIGLGDGFNVIASDAMAMLAHTKEFVEIEDEEMVTVTSEKVIIQNFAGDIVERSSFEAQVDASDIEKGTYPFYMLKEIDEQPIIMRRIAQKYVTEDNRVSLDQKLVDTLSDSDRIYIVACGTSYHAGLAGKQTLEKLTQIPVEVHLASEFGYNTPLLSKKPFFIFLSQSGETADSRQVLVKINRLGYPSLTITNVAGSTLSREASFTLLLHAGPEIAVASTKAYTAQIAVLTLLAKAIGDKKEFETSLVFDITHELSLVANAMESVIAQKDYLEELAEVYLSDTRNAFYIGRGADYNVSLEAALKLKEISYIQAEGFAAGELKHGTIALIEEGTPVIGIISEEVTGAHTRGNLKEVESRGAKTLVIVSEGLEKESDQLVLPTVHPYLTTLTTVVPTQLLAYYATLLRGFDVDKPRNLAKSVTVE

SEQ ID NO: 4426 - protein, 345 aa, Enterococcus faecium
  misc_feature (B) LOCATION 1...345
  hypothetical: YES
KLDYLKRLLVGKPLKSAENDEHKLTRFAALALLSSDALSSIAYGTEQIVVVLVALSAAAIWYSLPIAAFVIILLISLTLSYRQIIHAYPHGGGAYVVSSENLGKNAGLISGGSLLIDYMLTVAVSVSAGAEAITSAVPALYGHQVAISVTIVLLLMMLNLRGLRESASFLLFPVYTFILVISLLIVVGLYNIVTGAVPLQATALPGAAVPGVSIALILRAFSSGSSSLTGVEAISNAVPFFKKPRAKNAAATLTMMALILGFFFVGITFINYWYGIVPEKEVTVLSQIGKAVFGHGILYYVLQFATALILAVAANTGFFCFSSSCIQSGQKINSCLTCIKILGID

SEQ ID NO: 4427 - protein, 100 aa, Enterococcus faecium
  misc_feature (B) LOCATION 1...100
  hypothetical: YES
NMDYTVEFDSELLKQFPQEEHFMYKEAISHKVTEYLEHNFFRIKPVRTRSAKGIYEMKVKINKKNYRIAFALKKNHVFIFYISSNLQKIVFDKEVSKKIK

SEQ ID NO: 4428 - protein, 85 aa, Enterococcus faecium
  misc_feature (B) LOCATION 1...85
  hypothetical: YES
PVLLVQLRSVYGRCFRQIVQGLQLQNFVSPFSSFSIFFSQYNKAFPKTKASIIIVKKPRKIIVIFSAFDYPLYHRFYFTKPCLNA

SEQ ID NO: 4429 - protein, 129 aa, Enterococcus faecium
  misc_feature (B) LOCATION 1...129
  hypothetical: YES
LFCYFNFYLLILEKMLFFYLFSMLGVIILPFIAILFDLVAAAAYFLQLNYQTSGILFIGMIFQGVITLLLLVMMLSYKGKRYARIQTKVFVKYVSIRYGIIILSFLVNAIVLFLYVLNYLDINPLIFSR

SEQ ID NO: 4430 - protein, 240 aa, Enterococcus faecium
  misc_feature (B) LOCATION 1...240
  hypothetical: YES
IIRYFVIKCHVSFTYEIFLNDKVNSVERIKNGEKKEFNMNSFKKIVLGTTFAAGATAMFVGTTNAHADEVYTVKSGDSLSKISQKFAGDNSMIDAIAEKNSIANINRIYVGEQLTIPTSNDSSATTENKTTENTASTTETATQEHTYVAPVETVEVAPAAPAAATAPTSSSAKEWIAQKESGGSYTATNGRYIGRYQLDASYLNGDYSAANQERVAEQYVTSRYGSWDAAKTFWLANGWY

SEQ ID NO: 4431 - protein, 329 aa, Enterococcus faecium
  misc_feature (B) LOCATION 1...329
  hypothetical: YES
VLLLSVFLLLLNRRNHKGANDMSKILVFGHQNPDTDAIGAAIAFSHLQNELGKETEAVALGTPNEETQYALDHFQLSAPRVVESAKAENADVMLVDHNEFQQSISDISEVNILAVVDHHRIANFETANPLYYRAEPVGCTSTIILKLYKENQVTIPKEIAGIMLSAIISDTLLFKSPTCTPEDEAAAKELAAIAEVDLNTYGLEMLKAGTNLSDKSAAVLLDLDAKSFPMGSSNVRIAQVNTVDLNEVMDRQAELEAAMEDEMKANGYDLFVLVVTNILDSDSELLVAGKGKEKVEEAFQTTLTNNRALLKGVVSRKKQVVPQLTAVFS

SEQ ID NO: 4432 - protein, 202 aa, Enterococcus faecium
  misc_feature (B) LOCATION 1...202
  hypothetical: YES
AVRYKVRIKGGSKMTSLIEKQIVNKEIRVTDPLFEVIHQIQAENEEPLAALNTGYHEPADIRKRLENIISDKVDDTVTVLLPFYTDFGKHISIGKNVFINRQVMFVDLGGICLEDSVLIGPRVNLITVNHLTDPKERRGLSVKPIHIKKNAWIGAGATILPGVTIGENAIVAANATVTKDVPDNTIVAGIPAKIVKPVERII

SEQ ID NO: 4433 - protein, 88 aa, Enterococcus faecium
  misc_feature (B) LOCATION 1...88
  hypothetical: YES
GVRYMITLVRVLFWVPAVALVASIVYLMNWNKERFYLAILTLPAIYFMWKVFNYNYFEPDSVFIEELSGLVLSLLIVILYLIRLNKKH

SEQ ID NO: 4434 - protein, 81 aa, Enterococcus faecium
  misc_feature (B) LOCATION 1...81
  hypothetical: YES
ISLLSASSGKGVSKSIVSPSTLNTRPNVSLPTGTEIALPVSMTSIPLCKPSVDSIAMVRITPSPNSNAASRTTFDLFSSFL

SEQ ID NO: 4435 - protein, 93 aa, Enterococcus faecium
  misc_feature (B) LOCATION 1...93
  hypothetical: YES
NQLLYPLFISSPILTPISPPHFLLWGPSNTALTFFYPLFSKSLIVLSTSPTISGSNAEVGSSNSNTSGFIDNARAIATRCFCPPNNCAGLASI

SEQ ID NO: 4436 - protein, 77 aa, Enterococcus faecium
  misc_feature (B) LOCATION 1...77
  hypothetical: YES
KQLLMFLIWLGLLPQMQAFKHRLSRGCDNCAMLRVVRMMGRKQPYISLPKVKISKRIELDFLSQVLSFYYRIQRKSP

SEQ ID NO: 4437 - protein, 462 aa, Enterococcus faecium
  misc_feature (B) LOCATION 1...462
  hypothetical: YES
RFSYYGMRALLIYYMYDTVANGGLGLPRATALAIMSIYGSLIYMSSIVGGWVSDRVLGAKRTVFFGGVFIMLGHIVLALPFGVSTLFVSMALIIIGTAFLKPNVSGMVGHLYSKTDLRRDAGFSIFYMGVNLGALLAPLIVGTIGQEYNYHLGFSLAAIGMFFGLLQYIIQGRKTLDGVGTTPPNPLTTEERKGFIRNLIIALVVIAAVFGGAQLTGHLTIDFFVNTISVLGIILPLYYFIKMLTSKDVTAEEKPRVWAYIPLFLAAIIFWSLQEQGSSILALFASERTQSTLFGVTIQASWYQSLNPIFIFILTPVFVTMWTKLGERQPSTVVKFSLGLLFAGLSYLLLMLPGMLYGTSGKVSPLWLLGSFFIVVIAELCLSPVGLSVTTKLAPRAFESQTIAIWFLADASSQAINAQIARFYTPGTESAYFGIIGAVAIVGGILLFTVKEPIKKLMGSIH

SEQ ID NO: 4438 - protein, 311 aa, Enterococcus faecium
  misc_feature (B) LOCATION 1...311
  hypothetical: YES
RRSYSFKSRERIFKKVRNLDSRTRFEQEEIKVKTILQLKKEFKLNLLLSIAQLAKSTYYYWVKKLDKPDKYSKIKQEITAIVKESRNSYGYRRVTLAFKMKGYTINHKTVRKLMSQMGLTCQIRIKRYKSYKGTVGKIAKNVLKRNFSVDTPNKKWVTDVTEFKIKGRKIYLSPILDLFNGEIISYSISTSPTYKLIEEMLQQAIKKKGTEGSLILHSDQGWQYQMPQYQKKLKENNIIQSMSRKGNCLDNSVIENFFGVLKSEFFYREKFRSIEIFQSKLNEYIRWYNNKRIKLKLNGLSPVEYRKQSIK

SEQ ID NO: 4439 - protein, 311 aa, Enterococcus faecium
  misc_feature (B) LOCATION 1...311
  hypothetical: YES
RRSYSFKSRERIFKKVRNLDSRTRFEQEEIKVKTILQLKKEFKLNLLLSIAQLAKSTYYYWVKKLDKPDKYSKIKQEITAIVKESRNSYGYRRVTLALKMKGYTINHKTVRKLMSQMGLTCQIRIKRYKSYKGTVGKIAKNVLKRNFSVDTPNKKWVTDVTEFKIKGRKIYLSPILDLFNGEIISYSISTSPTYKLIEEMLQQAIKKKGTEGSLILHSDQGWQYQMPQYQKKLKENNIIQSMSRKGNCLDNSVIENFFGVLKSEFFYREKFRSIEIFQSKLNEYIRWYNNKRIKLKLNGLSPVEYRKQSIK

SEQ ID NO: 4440 - protein, 69 aa, Enterococcus faecium
  misc_feature (B) LOCATION 1...69
  hypothetical: YES
WAGYPRVTHPFATPLFPVEQAPVEKEAFDLHVLGTPPAFVLSQDQTLIKSSNNLAIVKLNLFASILLAC

SEQ ID NO: 4441 - protein, 69 aa, Enterococcus faecium; identical to SEQ ID NO: 4440
  misc_feature (B) LOCATION 1...69
  hypothetical: YES

SEQ ID NO: 4442 - protein, 177 aa, Enterococcus faecium
  misc_feature (B) LOCATION 1...177
  hypothetical: YES
ISILFLFSGEEKARRVVMVTFFTVLLFLFVVVMFLFLWLVRKEIIYRTVRNRWVYLVIPFLVSLVIWYTLISHPTADELAKGILSAMIFISFLLDSRGITEEGLVLNSFDKKGVPFSEINKIVLYQPKGSKIVKMNFFRNGWRGPMLKFSASLEELVPFLSQRLNDEAEIDIMIDPE

SEQ ID NO: 4443 - protein, 325 aa, Enterococcus faecium
  misc_feature (B) LOCATION 1...325
  hypothetical: YES
RSILMSETYYEAINWNEIEDIIDKSTWEKLTEQFWLDTRIPLSNDLDDWRTLSQLEKDTVGHVFGGLTLLDTVQSESGMDQLRKDVRTPHEEAVLNNIQFMESVHAKSYSSIFSTLNTKKEIEEIFDWTNTNPYLQKKAERINEIYKHGTPLEKKIASVFLETFLFYSGFYTPLYYLGNNKLANVAEIIKLIIRDESVHGTYIGYKFQLGFNELPEAEQETLKDWMYNLLYELYENEERYTEELYDPIGWTEEVKTFLRYNANKALMNLGMDPLFPDTANDVNPIVMNGISTGTSNHDFFSQVGNGYLLGHVEAMKDDDYLIGLE

SEQ ID NO: 4444 - protein, 224 aa, Enterococcus faecium
  misc_feature (B) LOCATION 1...224
  hypothetical: YES
RRNLMLRTEQLGFWYQDPQDALYKDVELNFEAGKMYAILGASGSGKTTFLSLISGLDAPKEGKVYYQDRSLNKIGLRSYRKNDVSIIFQAYNLLPYLSALDNVIAAMEITKTKQENYRQVALDRLARVGIDEILAKKQVTKLSGGQQQRVAIVRAICCEHQLIVADEPTGNLDETTSQDIVKLFQEIAHEQNRCIIIVTHEIEVAKSCDEVFELKNKKFQKIEV

SEQ ID NO: 4445 - protein, 70 aa, Enterococcus faecium
  misc_feature (B) LOCATION 1...70
  hypothetical: YES
SLFXGIKXLAIKETNRYLRIWVHTLVPPVITTSLYFVIFGXNDRWADRRHGWFFIYGIHRSWFDYDVCYH

SEQ ID NO: 4446 - protein, 361 aa, Enterococcus faecium
  misc_feature (B) LOCATION 1...361
  hypothetical: YES
GGFYVKKTYQKFLWISYIVLFIVGFLVSVSVIVGTLFLLFSDEDLVLKGLMSTLSCVMLLYLCIQINEIMPPHWQEKKKEFKEEIEIKSNDWIEYTWLPLKRNSKRKEFWALQLWPIGKLFIYMASLMVTLIGYLVVVYGVAYYLLSEPKQIAASNIFTAVMTLMCVMCFSIFSYLLVQFIRQNLTMSKLFKSLLDLLILGSMLTTLTDRFEQSEKTVEGIKNFLTTIDQFINGYMYLFEVGFILTLFGCVFIKLIKRSIEKEMVIDLIPTLSGYEYYVDFGKYEELIHTDIVHTSIHEVTVKGIRSTLKDGQETKTIDRRKEVYNFYKVEASLRYGIGKLRLDGSNIQQNKPYVLGKVVI

SEQ ID NO: 4447 - protein, 135 aa, Enterococcus faecium
  misc_feature (B) LOCATION 1...135
  hypothetical: YES
QMILTVTLNPSVDISYPLETLKIDTVNRVKDVSKTAGGKGLNVTRVLYESGDKVTATGFLGGKIGEFIESELEQSPVSPAFYKISGNTRNCIAILHEGNQTEILEQGPTISHEEAEGFLDHYSNLIKQSEVVTIS

SEQ ID NO: 4448 - protein, 245 aa, Enterococcus faecium
  misc_feature (B) LOCATION 1...245
  hypothetical: YES
MKILITAGGTTEKIDQVRAITNHSTGRLGQALADYLAANPDTTIDYVTTKQALKPKRHSNITIYTIESALDLFLQLEELTKKEHYDAIIHSMAVSDFTPAFSFSEEQLAKNLPTSSTQEELDNWFAENEQTDTTVSKISSNTEHLVLVLKKTPKIISYLREWQPKAKIIGFKLLVDVPKESLLAVAKNSLINNKTDFIFANDLTEIHGETHHGYLLSKDGTVEEAQSKSEIAALITEKIRLEESK

SEQ ID NO: 4449 - protein, 68 aa, Enterococcus faecium
  misc_feature (B) LOCATION 1...68
  hypothetical: YES
SMVYRQRSSKLLWMILWLNSRLRHKLFCFFAGMFLFGVILKSFIWFFPWYLYSMAPLRTNQLYYGQII

SEQ ID NO: 4450 - protein, 65 aa, Enterococcus faecium
  misc_feature (B) LOCATION 1...65
  hypothetical: YES
SFVLLNNVRLLFDSSLIHSLYSIVYYKARDAVFKNYLFFAKKEQDEHSIERFILLFLFIFYFDVE

SEQ ID NO: 4451 - protein, 609 aa, Enterococcus faecium
  misc_feature (B) LOCATION 1...609
  hypothetical: YES
KMAYKKGNWKPKTKEQKQKELDDLIKASNSKIEQYQSNPEDMIEFAKFMSKIHNYSPLNLSLIDEGFEGAIAVASYDGWKKLGFQVKAKEKGIGIYAHAPVTVFIDENGEEKTLKEATNEQKEKIKNGELRSKKIKHFKKGYVFDISQTNATEADLPKIFPNRVWNFNIDGELSVSQLEKGVNHLAESMNISIKDMNESGRGEMGSARGEYIQYVDGREEIVLNSRNSRTQNLTTSIHELAHKKLHNKNEHGSSYSTPIKEFQAEMTSFIVCHNYGIDTSDFTIPYIANWTKNNEKIDPKNFRQIMQEVRETSIDFISTIDKKVLEEQQTAFNALKNSFVPNENKEQIQQKSDLEFHNFYDSTINDPDRTIHGSYLEAMVDYYRGKYGENSIELTHSNYDVTAKIGENYVTYYSDTKQFDVCDVYGVVFENPSENKHDRLLLDRSPENCDYVEKFVVESLKACENHELKNDTLKLSEPLRSVVINEAVYNLSENANNYYNEKCWQEEIENQTNINDVKELNSCMTAEDFYESHKQEIENTITDFESVSGTNLRDTIDNESYKEVASVVAYKLVATKVKYEMDEGTFKIPENSNLEKPTVKTAERSFEME

SEQ ID NO: 4452 - protein, 190 aa, Enterococcus faecium
  misc_feature (B) LOCATION 1...190
  hypothetical: YES
FSAYCHSLFLSITCKAGGLNVMKPEYLINADHLTVILCPLEKQDKILEHLKKEVLVANLENFAIVQKDWPMFPYLKLKDHVLLDLPEKGIKQDRLAYQEKLDISSSLLNCAATELTPFDKVKLQLLHALLSKRNNIVIEDTFDELSILEIQELLHLLSYLAHEENQGILLFTHDATIAQSPYIDRLEPAG

SEQ ID NO: 4453 - protein, 66 aa, Enterococcus faecium
  misc_feature (B) LOCATION 1...66
  hypothetical: YES
FYYYNNKPKNGLLTLRIYMFLKLSLPSLIMLKKAVKPKLLTLFIAICTYGHIIVGYLFNIFSTLFI

SEQ ID NO: 4454 - protein, 157 aa, Enterococcus faecium
  misc_feature (B) LOCATION 1...157
  hypothetical: YES
KSYYDMYANGGDEMEKPIEKALDECLFFSVKKLDRMLNKLADEAFRRTGLAPTYGFILLILKEKDGIPQKDIAQMLYSAPSTIARFVEKLEYKGYVKTVSEGRLSLVYLTEQGRQFAKEVDGSWEELHQSYKAVLGNEASKELAQTMNDATDKLQKK

SEQ ID NO: 4455 - protein, 101 aa, Enterococcus faecium
  misc_feature (B) LOCATION 1...101
  hypothetical: YES
DDHYSNLLKYINSHCSTIFKVVYERRIFILMNAGIADMNLIKKTLNDFTSNSISKGTGINLSTIKKLKSGERSVEKLNLLDAIKITEFAMKNGKAEIEIWR

SEQ ID NO: 4456 - protein, 182 aa, Enterococcus faecium
  misc_feature (B) LOCATION 1...182
  hypothetical: YES
LDHYTHCFLAMILKVSAYIQMALLASLFFSLFTILSTMLQSLNHHRFAIRLTVEAIILKVIFQVIGLGLVGGYGMSLSNGLAFGIVFVRGYHFMCKEYRIAPLAKISNFFLKTFRSTLIMLAVCFAVFFLLNQRLSMESKSYAMIYCVAVGSIGGLVFLFSQFGKNGFRMLKNVKHHSRSKE

SEQ ID NO: 4457 - protein, 252 aa, Enterococcus faecium
  misc_feature (B) LOCATION 1...252
  hypothetical: YES
ENNYIFYVFCFIIKKILSFYGGKYMENYLSLLGVLIVILGFAFKLDSILIVMVALVVTALTGGLGIQGMLELLGTSFVNNRGMAIFIIIMLATGTLERNGLKESAASLIKRFKKVSAGMIVDIYGIFRMIFAAFNVSFGGVAGFVRPIILPMALGTIESKGLEVHPKHEEELKGMASAMENVCWFFGQVLFIGGAGALLVQSTLKDLGYDVTLGQLALVEVPVAITALVVASVYFYLKEKKLAKKYYPGKGQ

SEQ ID NO: 4458 - protein, 110 aa, Enterococcus faecium
  misc_feature (B) LOCATION 1...110
  hypothetical: YES
SFCYQIRSMMKEMTVKRKLKRPEILAPAGTLEKLKTAIHYGADAVYIGGNAYGLRSRAGNFTYEEMAEGVAFAKEHDAKVYVAANMVTHEGNEDGAGNFSAVCVMSVFLQ

SEQ ID NO: 4459 - protein, 119 aa, Enterococcus faecium
  misc_feature (B) LOCATION 1...119
  hypothetical: YES
LFCYILAIKDKRGIKMKFKTLLLKFVVLGISAVFILFGVLFYTQIATSEKGFNFDWQTTLFVSVIYFALLLRIVIAYFLLKLLKKIQDYKPFSTPSLKHTKKNRTNPFVYWFPLFWLTS

SEQ ID NO: 4460 - protein, 67 aa, Enterococcus faecium
  misc_feature (B) LOCATION 1...67
  hypothetical: YES
IRCYGRKSGQGLDSTFVNSRISAEQHVDQQKNVVRFLSIFAPPVPQNILPTRYKLIPAHNHLVLFEA

SEQ ID NO: 4461 - protein, 67 aa, Enterococcus faecium
  misc_feature (B) LOCATION 1...67
  hypothetical: YES
GRCYMKKRQKKKNAYKHYIRSIFTGYERMLEDPELEQLTFTYLNEETQLTRDEHQRIHFTTRDLPSK

SEQ ID NO: 4462 - protein, 155 aa, Enterococcus faecium
  misc_feature (B) LOCATION 1...155
  hypothetical: YES
TKRYPTERGLAMNDFNYYKSKEIYREKYYQMPKVFFTNEKYMDLSNDAKIAYMLLKDRFDYSVKNNWVDSDDNIFFIFTVEELMKLLQCREGKVSKIKKELEKAGLLKQKRGRVNKRDGKIESMPNLLYLGKPEVTNQRRLYNIMEGGRQILIPP

SEQ ID NO: 4463 - protein, 212 aa, Enterococcus faecium
  misc_feature (B) LOCATION 1...212
  hypothetical: YES
EQRYSKTNKGGTKMPLLNRGAIANFFGLADEEEYEYQDYPETTKKAVQPTKKNTTQNQSTHSVSAANTHEKQKTATSRPVTHESIQPAEKKKVIELHQSPTKTVAKERTASRTSTQPKANLAGKITVMEPRAYSEAMAIAKRIIAGEATLVNFHLVEEKQARRIVDFLTGTVYALDGDIKRVGDEIFLCTPTGMEIDSSTAQSFADANLFDL

SEQ ID NO: 4464 - protein, 60 aa, Enterococcus faecium
  misc_feature (B) LOCATION 1...60
  hypothetical: YES
PFSLNVVKIPLIRENGQEPKRSAKKTYQAPQAKKVRVTSKKEKFFRTTFENLILIYIRSI

SEQ ID NO: 4465 - protein, 123 aa, Enterococcus faecium
  misc_feature (B) LOCATION 1...123
  hypothetical: YES
EELYMARVKGGTVTRKRRKRVLKLAKGYYGSKHTLFKTAKEQVMNSYNYAYRDRRQKKRDFRKLWIARINAAARMNGLSYSKLMHGLKVAEIDINRKMLADLAVNDAAAFTALADQAKEALAK

SEQ ID NO: 4466 - protein, 360 aa, Enterococcus faecium
  misc_feature (B) LOCATION 1...360
  hypothetical: YES
AMLYYISEGGRKVKVLLYFESEKMLAKSGIGRALDHQKRALTEVGISYTLDEKEDYDILHINTYGINSHNMVNKARREGKKVVYHAHSTEEDFRNSFIGSNQLSPIVKKYLVGLYQKADYLITPTPYSKQLLESYGIRVPIQAISNGIDLEKYHPDPMKEQKFREYFKLSPDQKVIICVGLFFERKGIIDFVEIAKKMPEYTFIWFGHVPMYSIPRNIRKIVKEDHPENVLFPGYIRGEIIEGAYSGADLFFFPSYEETEGIVVLEALASKQNVLVRDIPVYNGWLEDSKNCYMGKTNEEFIRLIQQITNQELPSTTQAGYQTAKERSINKIGEELKNVYESVLNEKVSSKLKKVNQVKD

SEQ ID NO: 4467 - protein, 204 aa, Enterococcus faecium
  misc_feature (B) LOCATION 1...204
  hypothetical: YES
THSLPTFHGLLLVRWELYSVLTSKFYHLSEPDSLVVVDTIIYYPFVKVYDEQILEEERSGKTNDALKEKVAANFNTAKADAVLGKAGVAKEDVAANNNITKETNVLVLCAGGGTSGLLANALNKAAAEYNVPVKAAAGSYGAHREMLPEFDLVILAPQVASNFDDMKAETDKLGIKLAKTEGAQYIKLTRDGQGALAFVQQQFD

SEQ ID NO: 4468 - protein, 130 aa, Enterococcus faecium
  misc_feature (B) LOCATION 1...130
  hypothetical: YES
QSIYKGDISMRLWHEKLISKLPRQQLLGQHRECCALRGNGWGKKHATVDYVFHYSPYRLFQYHQLVMDEMEKRGYSPAPEWKNPMYRGKSCEAFFDLPTVERNVPIYPEHDEVYLAECLANLEQKGIYLT

SEQ ID NO: 4469 - protein, 137 aa, Enterococcus faecium
  misc_feature (B) LOCATION 1...137
  hypothetical: YES
VYIYYNDKGAFTLVNCTDVIRMISSAKKREVATRPDALPRTSVTEIFVELCLLFKIGEGGNKMAKQKIRIRLKAYEHRILDQSADKIVETAKRTGASVSGPIPLPTERSLYTIIRATHKYKDSREQFEMRTHKRLIX

SEQ ID NO: 4470 - protein, 95 aa, Enterococcus faecium
  misc_feature (B) LOCATION 1...95
  hypothetical: YES
YNIYIKKGETKMYNVGDQIDEIVKIGNVKLVKSKYYISETEIIFNTESGCILIWKLPFPKDETTLKKINTLKIRYCIHEIIDKNTYVINQVKVMG

SEQ ID NO: 4471 - protein, 72 aa, Enterococcus faecium
  misc_feature (B) LOCATION 1...72
  hypothetical: YES
PNIYINKDKRILLVINSRTKPTIKITKNNKKLILTKNDVGTVSNKKTLDTKNRIMIKLIILFISFKFNNPFV

SEQ ID NO: 4472 - protein, 65 aa, Enterococcus faecium
  misc_feature (B) LOCATION 1...65
  hypothetical: YES
YLIYVVPEVASSKNKPKFHKNLRSNFRKILSYFLKLITSVTTSHVTNHFFVSFNSIYRTSSHNIG

SEQ ID NO: 4473 - protein, 300 aa, Enterococcus faecium
  misc_feature (B) LOCATION 1...300
  hypothetical: YES
EVIYMQLQINEESLPVYEALASKTRIKIIQLLSKKKMNVKDLAKELGVSSAITTMHVKKLEEANIIKTEKVGQQKISSLRVDKIDISFPEKIFNAFDTKETSIPIGHYTNYAIEPTCGLATIHDFIGKVDEPRYFMDPRRMDARILWFTSGFVEYQAPNFLNTEDTLEMLEVSVEISSEFPFSNDNWPSDITFSLNGVELGTWTSPGDFADIRGKYTPDWYPDNLNQYGLLKTIRITKHLTNMNGEPLSNITINDIPKEQDTWHLRIEVKDDAKHVGGCTLFGKGFGNYDQDIKLKVYYS

SEQ ID NO: 4474 - protein, 90 aa, Enterococcus faecium
  misc_feature (B) LOCATION 1...90
  hypothetical: YES
NSIYPLVFVSDIPFGSSTIEGLASRASWIRPAETAALGYIMNTLANNMNENKAWNIYSINAIKSPTRSSPASICTAPLQMINTITILNKK

SEQ ID NO: 4475 - protein, 99 aa, Enterococcus faecium
  misc_feature (B) LOCATION 1...99
  hypothetical: YES
IRVYESSKMRKSFEQQKKLLHDRYGALSMDDRRQILCKLRKRNILMYRQLERLKHDLLRLESKRVQCELEGNQTQVEVVETKILKKKEQFLKMLTQNKK

SEQ ID NO: 4476 - protein, 74 aa, Enterococcus faecium
  misc_feature (B) LOCATION 1...74
  hypothetical: YES
FQVYGSAYIIKSRYFCHLKWKESKQSKQKISHMLFHLLNEKDIRLLLQKFCPSIQKRGCEKAVLHQVIRTTKLK

SEQ ID NO: 4477 - protein, 221 aa, Enterococcus faecium
  misc_feature (B) LOCATION 1...221
  hypothetical: YES
VEVYMKILTVEDDNMIREGISEYLSEFGYTVIQAKDGREALSKFNSDINLVILDIQIPFINGLEVLKEIRKKSNLPILILTAFSDEEYKIDAFTNLVDGYVEKPFSLPVLKARIDSLIKKNYGHLEKFEYKDLSVNFNSYTAKINGEEIDVNAKELEVLKCLLDNNGQVLTRMQIIDYVWKDSEETPYDRVIDVYIKELRKKLQLDCITTIRNVGYKLERK

SEQ ID NO: 4478 - protein, 109 aa, Enterococcus faecium
  misc_feature (B) LOCATION 1...109
  hypothetical: YES
KLSLPCKQHLKMKRGYKVRWRCSNMSNDIQPEIRFPGFTEAWEQRKFECLLDKKDGVRRGPFGSALKKEFFVSNSNFVVYEQQNAIYDNYETRYKITEKKYNELTRGAS

SEQ ID NO: 4479 - protein, 427 aa, Enterococcus faecium
  misc_feature (B) LOCATION 1...427
  hypothetical: YES
KLSLPCKQHLKMKRGYKARWRCSNMSNNTQPEIRFPGFMEDWEQRKLGELAESFEYGLNASAKKFDGSNKYIRITDIDDISHKFNQSGVTSPDIDFASADNYKLKKGDILFARTGASVGKTYMYRESDGLVYYAGFLIRARIKSKISSEFVFQTTFTDSYNRFIKITSQRSGQPGVNAEEYSNFKIMIPNYEEQNAIGCFFKKIDDTITLHQRKLDLLKETKKGFLQKMFPKNGAKVPEVRFPGFTGDWEERKLGEVVVFLNGRAFKQQELLDSGKYRVLRVGNFNTNDRWYYSNLELEEDKYANKGDLLYLWATSFGPEMWNEERVIYHYHIWKLKFLSKELDKQYLYTWLLTDKEKIKESTNGTTMVHVTKGGIEQRTFQFPPDINEQQKIGAFFKQLDDTIALHQRKLDLLKETKKGFLQKMFV

SEQ ID NO: 4480 - protein, 168 aa, Enterococcus faecium
  misc_feature (B) LOCATION 1...168
  hypothetical: YES
LISLITDQVRNTLLKWRQNLMSEIKGTTNFEKLFSRKLNKILKKKGNFDYLSWAHAWEIMKKNDPQATVTINEYKHYRVVSGTHQDFLVEEYKPFLMDETGTYVSVSVTVKGHTETELFPVLDYRNQPVVKPNAMQINNSLKRCFVKALALHGLGLYVFQGEDIPNTT

SEQ ID NO: 4481 - protein, 264 aa, Enterococcus faecium
  misc_feature (B) LOCATION 1...264
  hypothetical: YES
LISLITDQVRNTLLKWRQNLMSEGTKRNDNKLFNSLYKITVNDVVEKRNKLTYLSWAWAWAEVSKICEEVDYEIYRDPETHRPYLFDEKTGYMVFTSITVNGVKRDMWLPVMDGANKAMKDKPYTYEVNDYQWNNETKKKEIVGKIEKRVEAATMFDINKTIMRCLVKNLAMFGLGLYIFAGEDMPEDVSMLEPATQRSKKLFLDALQLVANKYDKSIDEAIVALTDAASITADDSKWTKRDLGILKRGVNWLEDQYREETKEK

SEQ ID NO: 4482 - protein, 448 aa, Enterococcus faecium
  misc_feature (B) LOCATION 1...448
  hypothetical: YES
VESLLSYFLHTKKSRSERVMRYSTILISTFAALSLSLTINQTVHTEEIETAKWTETKWANVNRITFQDEFSSFNSGVAKLRKGQTATIKAKIDYSGDLAPILQSAVTFENVDPALSIGYDENTLTIQHKQAIFTFTVTLNQDLLKPALFTVKVSDGLPNDHHHLTPYSQRQTIEQDSAIDSGGDLVEEPTDKPENENKPEVPPTENPDGEQKPEIEPGEEPDTETQPEPDNESKPEITPGEKPDVDPEEKPDVTPEPDTDSGNQTVPETNPDTDNETENPEKPEVAPEEKPDVTPEPDTDSGNQTVPETNPDTDNETENPEKLEVDPEEKPDVTPEPDTDARDQGIPEKINKKTIQEDGKKESKKSNLAILKINEEQLNKKSRIFDSAQSAETLKSSKDTTFASPETKNKQLPKSGESQNKVILWSGIILLSIATMLSAKRFKQNRSL

SEQ ID NO: 4483 - protein, 66 aa, Enterococcus faecium
  misc_feature (B) LOCATION 1...66
  hypothetical: YES
TVSYNLTLHLYLDVSFVGMLAPNESFGPALPKNFKRCIRKIAVMLPRALPKMLMIAPVSGPKLKPQ

SEQ ID NO: 4484 - protein, 148 aa, Enterococcus faecium
  misc_feature (B) LOCATION 1...148
  hypothetical: YES
RTDFLQRMDKKTAFQTSSSLDAFYSANHFFGRSGFDFISLCRCFITCLRKHRGGFAMKKRKISYYSGFTLIEMLIVLLIISVLVLLFVPNLSRYRNHVDQESREAIIQLVDTQKELYALQNNGRVPTVEELLNEGYIKREHAEIYQRP

SEQ ID NO: 4485 - protein, 210 aa, Enterococcus faecium
  misc_feature (B) LOCATION 1...210
  hypothetical: YES
VASLSPVSPLKNKSEIADSKRSSPSFLATEIEKTGSFSINFFNFSCSSCAGKSVLFRRMIRFNPLVASNNCSSSAVSGSLWFRTSKIKSASANAFRLLSTPIRSTTSSVSRIPAVSISLSGTPRTLTYSSITSRVVPAISVTIAFSSLNKWFNKLDLPTFGRPMIAVLNPSRRTFPCLDVASSAWILCWIICAFSSNNFVVNSSTSSYSG

SEQ ID NO: 4486 - protein, 133 aa, Enterococcus faecium
  misc_feature (B) LOCATION 1...133
  hypothetical: YES
RNDLMKKIKSYTSIWAVEKVIYAINDFQLPFPVTFNQMAWFVLSLLFVIVFAHVPPLSMIEGAFLKYLGIPVAVTWFMSQKTFDGKKPLGFLRSFISYHLRFKVTFAGKKVKEQKKRWDEPITLVRSVNYVPD

SEQ ID NO: 4487 - protein, 303 aa, Enterococcus faecium
  misc_feature (B) LOCATION 1...303
  hypothetical: YES
NYPLDQYTCKKHFLPNRAAIGFRSRKKISDNLYDVLFKETIEHQTTVRTQSMYLNGIETISSVTPLFSNDRFLGAVATLRNRSEVMKLMEELGGTKQYINSMRAQTHEFMNKLHVISGLIDLKKYEEVTHFIQQLNQNYKKEIGQVSSLIKVPAIAGFLLGKINEAKEQSVEMLLESDSFIPKMEMDDSIHSLLQVLGNLLDNAKEAVLQKHEINGQVRIHLNYDTEAEVFIVTVCDDGVGISGEISEKNIYARFFDQRNQSWVWIESHPFNRQTPRWIFRIFQTNKWRYNRLSRITKKGRSK

SEQ ID NO: 4488 - protein, 104 aa, Enterococcus faecium
  misc_feature (B) LOCATION 1...104
  hypothetical: YES
GSPLFCELVVVNFILQKGLPFLYGFFHLHKIFYTLKNLTTFENFRHKIFTTNDYYISIPTNNPNNTFSFLTPYPASSPASRTFFYQKNLYHPIDSTNQPNAVML

SEQ ID NO: 4489 - protein, 258 aa, Enterococcus faecium
  misc_feature (B) LOCATION 1...258
  hypothetical: YES
GSPLFCELVVVNFILQKGLPFLYGFFHLHKIFYTLDLEFKNKEILKLEKLKYDFFKGASHELKTPLASLKIILENMKYNIGKYKERDIYINECIEIVDSLTKNISQILSVHSIENLNNDEEYLKINDTLEDILKKYEILANQKKITVNNYILDENVYIGKTALKIILSNLISNAVKYTDVNGVINIGIVNDWLYIENSYGNNKISNMDKIFDVKFDLNKENSNGLGLYIVSNILNNYNIEYKVLQDEEFFIFKIKIFS

SEQ ID NO: 4490 - protein, 99 aa, Enterococcus faecium
  misc_feature (B) LOCATION 1...99
  hypothetical: YES
GSPLFCELVVVNFILQKRLPFLYGFFHLHKIFYTLVNHCYIIKCYIIKLLMIFNITSNLKKFEKEKMIMKKKEKESIETLCYSRNIRNLSSWHWYRNRR

SEQ ID NO: 4491 - protein, 181 aa, Enterococcus faecium
  misc_feature (B) LOCATION 1...181
  hypothetical: YES
KIQYMVLNNFLKEGFILSYLIVCLIIIICLHHLFLSKTIPRYSKNKKAEKFCLLLNKFTLIAPILAFIIFSVLLSTTLKGKFMERSSHAMILTFLWLLFTRIYIFLMSLKPPKSISLCLVINGIFLLSLIIFITPLDRYVTYLYNPLEYWTYFIGILEGIIFYIGYFPNKNNNFYFYRNKL

SEQ ID NO: 4492 - protein, 82 aa, Enterococcus faecium
  misc_feature (B) LOCATION 1...82
  hypothetical: YES
IEQYEEGGASSLESQKRGRKISMNSKLNIPKKLKDESLEEEVIRLRAENAYLKKLETLIQEQDLSKKKSRLKQSFSSKKNLN

SEQ ID NO: 4493 - protein, 306 aa, Enterococcus faecium
  misc_feature (B) LOCATION 1...306
  hypothetical: YES
VGKYAFSAIFPTPITPIFIYFPPGSFSYFHLTPFFTKMRYNSIAKVRKLIRRSVLLLKFISWNVNGLRAIVNKNFLEVFHELDADFFCLQETKLQAGQIDLDLPGYYQYWNYAERKGYSGTAIFAKKPALNATYGMGIDIHDTEGRLITLEYSDFFLVTCYTPNSQSELKRLDYRLEWEEAFYNYLENLKKQKPVIVCGDLNVAHQKIDLKNWKTNQKNAGFTPEERAALSRLLDNGFIDTFRYFYPTQEGVYSWWNYRFNSRKNNAGWRIDYFLTSKDLEPGLADAKIHTDIMGSDHCPVELDLK

SEQ ID NO: 4494 - protein, 63 aa, Enterococcus faecium
  misc_feature (B) LOCATION 1...63
  hypothetical: YES
MPKYMIIQKVRVYSRTSKRAIACRRAHWLWLRYSYFISLVLRNSLKERETKVKNTFVSRSKHV

SEQ ID NO: 4495 - protein, 67 aa, Enterococcus faecium
  misc_feature (B) LOCATION 1...67
  hypothetical: YES
GIKYKFKWDRLNKIATIIYMLLVDKFVFNSNWFWIIPLIKVSSKKGAKIPLMKNEINVTNSVTLSFL

SEQ ID NO: 4496 - protein, 312 aa, Enterococcus faecium
  misc_feature (B) LOCATION 1...312
  hypothetical: YES
MKKYLLTATVMIGALLFAACGNTNKEADKKEDLTIVTTFYPMYDFTKEIVGDEGNVKLLIPAGTEPHDFEPSAKERAEISDADVFVYNSSDMEFFVDSLKDSVDSKQTLMIEAAKGIDRLESQEADEHEESEEGHGHSHEYDPHVWLDPVLAIKEVRTIAEELGEKYPDKKETFTKNADAYIKKLEALDQKYSDELKDATNRTFVTQHAAFAYLANQYDLKQVAISGVSPDQEPTPSRLAELKEFVKKNNIKVIYFEENASSKVAETLSNETGVKLEVLNPLESLTNEQIKAGENYISVMEKNLKALKESIN

SEQ ID NO: 4497 - protein, 67 aa, Enterococcus faecium
  misc_feature (B) LOCATION 1...67
  hypothetical: YES
FKKYFHCSNRYYTFSYFLVSAYVSVVAASSPGNVAHDSLLFMGTIRNSIELFNLFFKLSAKKRRPVI

SEQ ID NO: 4498 - protein, 272 aa, Enterococcus faecium
  misc_feature (B) LOCATION 1...272
  hypothetical: YES
VKKYKRLLLMAGIVSLVIVLSGCGTGEVSAQSTGIWDRYIVYYFAEAIKALSFGNAGIGIILFTLIIRVILLPLMHFQTKSMRKTQELQPKLKALQQQYSSRDPETQSKLREEQQRLYAENGVNPYAGCLPLLVQMPILMALWQSISRVPELKQGHFLWLNLGNADPTFILPILAAIFTFASTYLSSMSQIESNASMKIMNFVMPVMILVMGVNLASGLSLYWVVSNAFQVVQTLLINNPFKIRKEREEEARRIRERERALKKAMNPKKKRK

SEQ ID NO: 4499 - protein, 682 aa, Enterococcus faecium
  misc_feature (B) LOCATION 1...682
  hypothetical: YES
REKYKMYLSPREKQLLAEFLSSPSPVSIQKMMNLLKVSKRTIYRELDNLEVSLKSVNASLKKAARGSFVIEASEEVLEQLKENTDGKSNDLSTAKRQHAILAELLLTTEPLSLAHFMESYRISNTTFYADIKQLEESIRQLPLEIIRNQGYEIEGPEKYRRLLTANVLELEINEYELFHSISFDASLNYFFRFVDPQHLSLARKVIGEELIQKKTNLSDRKLEHLVLMLTLTMERVTKNHLLTNETYNSLANKELLQTAKRLFSRIASETKQLYPVNEIVFFAGLLNDFTNSFDQNFFEETFDTQLAYLVKQLIQEVSEETNVHFYEDETLYKMLLTHLSGVFSRAVLQEETLTNPILEKIMVQYEEVANAIRKAVERIFQEKKLSEEEIAYMVLHFANSLERSPKESNISIAGFSPSGLASTSMLELRLKRYFPFIQQIHFYRIADLKKIDLQEEYDVVISTSILPGYGGKYILVSPLLLEDEVKQLKEAFSHIEKKKRQKITYNSNNEWMIEDTYEETMHFMDQINQLLGRFFIQELDNPETISETIRSLFPYFPEGLVTDEEVVHRRLLKRYEQAPIGIPHTNMGLFHTSSSLISKPIFCIFNLKHPLTIEGMDRQPVDLSRMLVMLAPSPIQEKDGILLGKISGAIIMNDLNTEIFRSGNKEIVYQLLAKILIEEIKK

SEQ ID NO: 4500 - protein, 207 aa, Enterococcus faecium
  misc_feature (B) LOCATION 1...207
  hypothetical: YES
TRKYSPCNLRRKYRNNCKGEIKMADAIMTEAKEKMKKAAQNLQRELGQIRAGRANASLLDRITVNYYGAPTPLNQMASIQIPEARVLMITPFDKSILQDVEKAIMASDIGISPTNDGNVIRLVIPQLTEERRKELAKDLKIEAEHAKYAIRNIRRDAIDEYKKQQKNGDITEDDLRGLEKDVQTLTDNSIKEVDKIAADKEKELLEV

SEQ ID NO: 4501 - protein, 414 aa, Enterococcus faecium
  misc_feature (B) LOCATION 1...414
  hypothetical: YES
SRKYVTIIIYQIYNNEVLKLTIITMTKKIEVYVDGSQEERDSFFGFFWKNSREYVKALNMVYKQLMFEELIENSIKELDHEYIKRELSLEERIDNLLSNEVIDQKKLDKTKRELSKLRIAKNKEARDVLTQAIGLKSQTRIRDIAKKLDFDYSDFIDSAKMKASKDFSNDFVGIVTGQRTPRIYRNKNKYGLLPFRGRDIKIHKADKFYISLPKGFRFKVNLGRKPRKARDSALTLERIMDGQYKLNQSNLIFEGKNLFLNLTISFEKDYHKLDFKEGAELTIKFTDLCSGKCLVNNQSVIDFGDSKYISNFKNKIKAMKSREQSRGVFSKGGHGRKRKLDQDRWEAIKKRESNFVKTYNNQCSAKIIQTAIRNKTQIICISEPDKNYGEWAYYQLKEQIINKGKRYGIEVKSE

SEQ ID NO: 4502 - protein, 653 aa, Enterococcus faecium
  misc_feature (B) LOCATION 1...653
  hypothetical: YES
TNPLGELTHKRRLSALGPGGLTRDRAGYEVRDVHYSHYGRMCPIETPEGPNIGLINSLSSYAKVNKFGFIETPYRRVDRETGRVTDQIDYLTADIEDHYIVAQANSPLNEDGTFAQDVVMARAQSENLEVSIDKVDYMDVSPKQVVAVATACIPFLENDDSNRALMGANMQRQAVPLINPQAPWVGTGMEYKSAHDSGAALLCKHDGVVEYVDASEIRVRRDNGALDKYDVTKFRRSNSGTSYNQRPIVHLGEKVEKGDTLADGPSMEQGEMALGQNVLVGFMTWEGYNYEDAIIMSRRLVKDDVYTSIHIEEYESEARDTKLGPEEITREIPNVGEDALKDLDEMGIIRIGAEVQDGDLLVGKVTPKGVTELSAEERLLHAIFGEKAREVRDTSLRVPHGGGGIVHDVKIFTREAGDELSPGVNMLVRVYIVQKRKIHEGDKMAGRHGNKGVVSRIMPEEDMPFLPDGTPIDIMLNPLGVPSRMNIGQVLELHLGMAARQLGIHVATPVFDGASDEDVWETVREAGMASDAKTVLYDGRTGEPFDGRVSVGVMYMIKLAHMVDDKLHARSIGPYSLVTQQPLGGKAQYGGQRFGEMEVWALEAYGAAYTLQEILTYKSDDVVGRVKTYEAIVKGEPIPKPGVPESFRVLVKE

SEQ ID NO: 4503 - protein, 899 aa, Enterococcus faecium
  misc_feature (B) LOCATION 1...899
  hypothetical: YES
KLEYKYRIDILQPIVYYAFRHIKLEEKMKKSAKDRVFDELIRLTGNMSSVTAEKISKNLGISRQNASHYLTRLVEDKKVEKLPGKPVLWKPLDEYAVVDNTEQINEAFHSVVGHDGSLREVIQKCIAAVKYPPNGLSVLINGATGVGKSFLATKIFEYAIHEQIIEKDAPFAILNCADYADNPELLSATLFGYKKGAFTGAEKDTDGLLATANNGYLFLDEVHRLSKENQEKLFLFIDTGNYRPVGENVNWHSAKVRFIFATTEKGENYLLDTFDRRIQISVMLPTFEDRPIRERLELIQLFFQNEADVLQKDIIVSREALSLMLSHPFSGNIGKLKNIIKISCADVYSRTQEEPLTIGKNEILIQLNMLESEVESLPIASLLIKKNQKIKTDRIKPFDYDSILEKITQLINEGNFNENFSSIKNEVQHLVHHIDKDSFLSMSRKLMIQMFRKVWVSVLGKTYGLTTSGPVAEIISRSYVISPSYKTDLTGINRTLAANLPRTTYLCNQFLEHLPPLSEKDENFLRLLIVVTLSDYVDESIELKGLLLAHGDSTASSIQAVVNQLCGNYVFEALDMPVESNVSEIVESTRNFVKRQVNTDSLVLIVDMGSLNQIYTQIKNDLKGELLLLNNLTTSIALDIGLKMTMNAPFKQIAEDAADKYSINVQYFEGFSQSSNIIISCMSGLGISDKLKDVFRHHLSDESIEVFTKDYRELRELIDQNDETYFDKTKLVITTSDLPRSFSIPNINVYDILDGDGAANLEHILSPEMKPAEFNRLIQELVKFFSLEGIADRLNFLNPTIVMSEVETVISKYENYYHFTLNGRVKLNLYMHTALMMERLFLARTEKSEEPNYDLKPDEDEFYYVSRSIFQSMEMKYNFKVNAYELSLLYELLGPYIQK

SEQ ID NO: 4504 - protein, 117 aa, Enterococcus faecium
  misc_feature (B) LOCATION 1...117
  hypothetical: YES
RSDLVIKKMIYFLGSLITVLSSFIYLKKKKQAEKSEGLSKYQGTWFFSDSQQKQQLQITSDYTFLINGQSLGTSVVEIDEYRLVVRDQYGFYLIFSYPEQTLYDESADTSYKLLSEK

SEQ ID NO: 4505 - protein, 81 aa, Enterococcus faecium
  misc_feature (B) LOCATION 1...81
  hypothetical: YES
LKRYLKLLASNILLLRSSLRLVQVGLTMGLTPDLTAIGKLIIIALMYIGRVGVLTVVFSLMTKAQRTQSKYKYPQESVMIG

SEQ ID NO: 4506 - protein, 99 aa, Enterococcus faecium
  misc_feature (B) LOCATION 1...99
  hypothetical: YES
FERYIYIDKTPFAYQIFIATKKRTLIRIRRNLFMNNGTVKWFNADKGFGFITGEDGNDVFAHFSAIQGDGFKTLEEGQAVSYDVEDGQRGPQATNIVKA

SEQ ID NO: 4507 - protein, 242 aa, Enterococcus faecium
  misc_feature (B) LOCATION 1...242
  hypothetical: YES
GKRYIEKRSTEGWTPDVIIGRAERTFSCSVSTLYRRFKTGEFNVLHLPMQGKRKPNGYKEKRGKQAFKRNISERKKDYVVFEEEFGHLEGDTIVGIHHKSAVITLVERLSKAIIALKPEGRKAVDIENSINEWLQSVPKNLFKSITFDCGKEFSNWKSISNTNDIDIYFADPGTPSQRGLNEHSNGLLRKDGLPKEMEFNQVNQGFISSVASKRNHIPRKSLNYQTPLEVFLSYVNGKFCLA

SEQ ID NO: 4508 - protein, 242 aa, Enterococcus faecium
  misc_feature (B) LOCATION 1...242
  hypothetical: YES
GKRYIAKRSTEGWTPDVIIGRAERTFSCSVSTLYRRFKTGEFNVLHLPMQGKRKPNGYKEKRGKQAFKRNISERKKDYVVFEEEFGHLEGDTIVGIHHKSAVITLVERLSKAIIVLKPEGRKAVDIENSINEWLQSVPKNLFKSITFDCGKEFSNWKSISNTNDIDIYFADPGTPSQRGLNEHSNGLLRKDGLPKEMDFNQVNQGFISSVASKRNHIPRKSLNYQTPLEVFLSYVNGKFCLA

SEQ ID NO: 4509 - protein, 303 aa, Enterococcus faecium
  misc_feature (B) LOCATION 1...303
  hypothetical: YES
RRRYMTPTQLKAKVKNISREKEVDPQLVLRHFMMEKFLEKISESPYRENFVLKGGFLIGSKYGIENRTTKDIDTTLREMKVTKETLTTVLNEIFSTPTKEGIQFEIQGMKETREADYYPGFSLRVLAHLENMRPDFKVDVTTGDSIYPATITHSHKLMFEDRTIPLESYPTEQIIAEKLSATFDFLTDNSRGKDFYDLYTIPKMEKIDEKTLKDSVRNTFTRRGKTDPLKIYYEKDMDVLKNSHELKDTWKKYQKSNPYAASITYDETMDSISNLMEKVIHVEEKERKLAYQRHQQMNREMER

SEQ ID NO: 4510 - protein, 86 aa, Enterococcus faecium
  misc_feature (B) LOCATION 1...86
  hypothetical: YES
WRGYGIIPRMPTGLPVPWWTWILPEDIIRLKWRLWPWCRKRYHQASWPVAHGPNGIPLLLAGLPAAGMERNYRWVRVPAQKLLEEX

SEQ ID NO: 4511 - protein, 64 aa, Enterococcus faecium
  misc_feature (B) LOCATION 1...64
  hypothetical: YES
PFLYKREKNNKIVYMNILPFLLSMKKYFNFIFSFQIILLVTSLNYKNRSTASSAALLFFSSFIS

SEQ ID NO: 4512 - protein, 482 aa, Enterococcus faecium
  misc_feature (B) LOCATION 1...482
  hypothetical: YES
FPLYTGRNDYCQEDSTVHVDLFFRRLQRRGQKFAANHFSSIQIIVFYYILMTVLSLVLFYMPIFREPDSHVSFVDMLFMAISTVSVTGLSTFDINSVFNDNGIILLEILFQVGGLGIMMISTAFVIFSKRRITLKQRQLIMTDMNQPRLSGIVRLIRITFAILIWFQLLFGTFFSIYFYYRGYFDRWRDAVFYGFYQAISAVTNSGFDVTGDSIKPFAHDYFFLILIMFLIFVGGIGFPVLMECREWLLYKRSNAKLPFRFSLFTKLAVLAFVILFVSGTVLIYLLEKDHLFQDSNMSVKWINSMFYSITTRNAGLQIHDLGDFQITTLIIFSLLMFIGCSPSSVGGGIRTTTVAIIGLYLYSFLKSEDNINIFGRRIDQDDVRKSVVVFMLSLGMCFFCIVFLSATEEQTLISIIIEVTSAFGTTGLSLGITGDLSVVGKITIATLMFIGRIGMLYTLMLFVPKETRDLGYEYPSEKIIIG

SEQ ID NO: 4513 - protein, 391 aa, Enterococcus faecium
  misc_feature (B) LOCATION 1...391
  hypothetical: YES
FLLYQRKRADSIMARLVKRGNSWQYEISYKKDDGKYTKIRKSGFKTKGEAKDAANELEYNLNKGLKGDRKNLLLSDYFEDWMQLYKEGTVSPITYRKYEDTLMNIKKYMPAVLISDLDRVGYQRFLNKYAKDHVKSTVIKFNNHIRASLKDAVEEGLIPFDPTRKAVIKGKDSLKPKEDKYLDYDQFKSLMKLVEENLSAQYSSPMLVLVAGATGMRFAELLGLTWEDIDFEDQIITINKTWNYKLNEWGKTKNETSNRKISIDKHTIDLLKKFKINQKELFENFEIKNPHNFVFFNLKNGLVSSNAVSKYLRKKLKELGIEKQFTLHGLRHTHASILLYQGVNILSVSKRLGHSSLETTMSTYLHIVRELEDQDKEKINTVFDSLYKNDN

SEQ ID NO: 4514 - protein, 199 aa, Enterococcus faecium
  misc_feature (B) LOCATION 1...199
  hypothetical: YES
QRLYPCYFLRFQLIGRYQIFVIFYSAALHLFLELLDLIFYSLFFHPLELFFCLFFLVFLGLLRPYLVLESHLVFLLDLPLVFLDFQFHYLCLDLFPVLFGFQNPYLVLELHLVFLLGLPLVFLDFQFHYLCLDLFPVLFGFQNPYLVLESHPVFLLGLHLVFLQGLFQVLIHCLALVEFLYRVLLQVLFPVSVLRLDFL

SEQ ID NO: 4515 - protein, 373 aa, Enterococcus faecium
  misc_feature (B) LOCATION 1...373
  hypothetical: YES
VDMYELKQTPRQIVSELDEYIVGQHAAKKSVAVALRNRYRRLQLDEKMQQDITPKNMLMIGPTGVGKTEIARRLAKIVNAPFVKVEATKFTEVGYVGRDVESMVRDLVENAIQIVEKEQYSRVYTSAKKNAEKRLVKILVPGIKKEQKQSTNQFEQMMNLFNASQQNTAEPQEEVTEDIRINRRTVLEQLQKGLLDSREVTIEVEDQKKPAPMMNNGLEQMGIDLNETLGALTPKKKVERTVTVKEALELLIKEESAKLVKDADIHSEAIKLAEESGIIFIDEIDKITSKSQQSGEVSREGVQRDILPIVEGSQVNTKYGIIQTDHVLFIASGALHLSKPSDLIPELQGRSPIRVELDDLTAEDFVKILTDTK

SEQ ID NO: 4516 - protein, 352 aa, Enterococcus faecium
  misc_feature (B) LOCATION 1...352
  hypothetical: YES
KKMYWMNYTKWTYGFVRLKAADSVFISKTNIRREEMKKLVVGILILASFGLAACGNSNNTSQADTKKSSTQTETTLTITDSNGDQIEVPNNPEKVVVFDNGSLDTMDALGVGDKVVGAATSSLPEYLSSYKKVESAGGIKEPDLEKINQLQPDLIIISGRQRDFQKDLSQIAPTIFLSLDAKNPWESFQQNVTALGEIFGKQEEAKTQLEELSSAIDQTKKKAEATDKKALVTLVNEGQLSAYGSGSRFGFIHDLFGFEQADDQIEASTHGQSVSYEYVLEKNPDILFVVDRTKAIGGDDSKDDISANELVAQTNAGKNQQIISLEPDVWYLSGGGLESMKLMIEDVNQAFK

SEQ ID NO: 4517 - protein, 470 aa, Enterococcus faecium
  misc_feature (B) LOCATION 1...470
  hypothetical: YES
GEMYMLKLPEDFIFGGATAAYQVEGATKEGGKGAVAWDDFLEEQGRFSPDPASDFYHQYAKDIELCERFGVNGLRLSIAWSRIFPDGAGKPNPEGIAFYHRVFEECKKRNVTPFVTLHHFDTPKRLFDHGDFLNRETIEAFVSYAIFCFHEFKEVKVWSTFNEIYPVATNQYLLGVFPPGIKYDFTKIVACLHNMMVAHARVVNYFKENELPGEIGVVHSLETKYAATDAPEDKHAAFLDDALSIRFLLDATYLGYYSTETLTALDEICEANQASYHFPEEDFVELKKASTRNDYLGINHYQCHFVKAYDGENAIHHNGTGEKGTSVYKVKGIGERIYKEGIPRTDWDWLIYPEGLYDLLLRIKSDYPHYNKIYITENGMGYKDQFEDGIIMDQPRIDYLRVYLESLSKAITAGVNVKGYFLWSLMDLFSWTNGYNKRYGLFYVDFETQKRYPKESAYWYKLVSETKTII

SEQ ID NO: 4518 - protein, 728 aa, Enterococcus faecium
  misc_feature (B) LOCATION 1...728
  hypothetical: YES
RMVYPTFSYKVQRVHAQSSSNYYGTQFSNTQDRPGNTSLISRIYDAPDQNNLSRRIDSTFIATIGEAMALKERGIEIHGLGIQLQSDPAAGLSKAEVESRMRQMVSSDEKGDLYYESADHATDISEYLAKKAVQISATVSNGQINDPIAEPFIYQPGTLSVKSVGTSPTTVTPSISIEGNTIKSNQIYLGKDQEIQIHYQVRIQTENEDFHPNFWYQMNGRTTFQPNIDTNELAEFGIPSAKAPGVSLHIKKLWEEFDNNLADRPDQVTFEIQREHTTNAAAWKNGYIRIIKPAKDTTNTWERADIDKLSAHSGESYQEILSLPQYNNQGQAFSYQTIKELPVPGYDSQQIDAMTWKNTKQFTPLNLKITKNSSTGEKDLIGAVFKLTGDSIDTLLTDHGDGTYSLPENVKLQKEMTYTLTETKAPEGHGLSKKTTWEIKIASDGTVTIDGKTVTTSDDTIQLTIENPFVEVPVAVRKYAMQGTDKEINLKGAAFSLQKKEANGTYQPIDSQTTNEKGLASFDSLTPGKYRVVETAGPAGYDTSPGNYEFQIDKYGKIIYTGKNTEMTNNVWTLTHQNRLKAFDLTVHKKEDNGQTLKGAKFRLQGPEMDLESPKDGQETDTFLFENLKPGTYTLTETFTPEGYQGLKEPVTIVIHEDGSIQVDGQDHESVLSPGAKNNQISLDITNQAKVPLPETGGIGRLGIYLVGMIGCAFSIWYLFLKKERGGS

SEQ ID NO: 4519 - protein, 373 aa, Enterococcus faecium
  misc_feature (B) LOCATION 1...373
  hypothetical: YES
MRFLHTADWHIGKKLQGYDLIEDQRHVLSSILDIAKEEKVEAIVIAGDLYDRSVPAVDAVELYNELMVDWNLKEKIPIFAISGNHDSSTRLSAGTPWFSYSNYFLRTQLAEAFEPVEFKNVQFFFLPYFEPIAARLYFEDDNIRTIKQAVAKVIDKMQELFDSEKKQVLISHFFVMGSVKSDSETKIEVGGLDSIPGELLTPFDYVALGHLHNQAALRQDNARYSGSPLKFSLSEINQKKGVWIVDLTTGLELNFREIEPLHDIEEITASFKELLDPAFYQSVNRENYIYIYLTDRTIIPNMMNQLRQIYPRILGIERANGRAEQTKRKRKVLEMKDPQKLAEAFFSEMTEEQLTANQEKWLGETLQEIMEME

SEQ ID NO: 4520 - protein, 249 aa, Enterococcus faecium
  misc_feature (B) LOCATION 1...249
  hypothetical: YES
IDALLKWGKRMRLDKFLADMGLGSRKEVKGLIKKGTIEVNGQVVKSDKAQVNEFEDAVTYLGEIITYQKDFYYILHKPAGVISATQDNHDQTVIDLLEDQDYREDLFPVGRLDKDTEGLLILTNDGVFAHQLLSPKKHVEKEYLAEVSGIMTEEDIRLFAEGLIIDGDEQTLPAKLQIDQVDQETETSIIRLILHEGKFHQVKRMVKAVGKEVLYLKRIRMGKFWLPKDLNKGQYRPMTKEELEQVREK

SEQ ID NO: 4521 - protein, 78 aa, Enterococcus faecium
  misc_feature (B) LOCATION 1...78
  hypothetical: YES
RVPYASKTEIFEEMEPSYKMNNKLNQPILISIVTANSDKIFRTLDNFISTVKDETAVKNPKFLTTIHFPSTKKKTNRV

SEQ ID NO: 4522 - protein, 327 aa, Enterococcus faecium
  misc_feature (B) LOCATION 1...327
  hypothetical: YES
IKAYICKANELEIKRRKLMFSFIPNSVLQMSTIFLSIVIEALPFVLLGCLISGALQVFLTPERVKRWLPENRIFSIFTGSILGFFFPSCECGIVPIVHQFVKKGVPVHTAFAFMLTAPIINPIVIFSTFIAFGNSWQMASWRVIGSFFVALVIGVWLAYFQKDAVLKEKITSKVAENHHHHVHEEEQSEKNEPKNQLIHQTGHVLTHSIDEFFDTGRYLIIGGLIAAAMQTYLPTRIMLTLGSTKILAIIIMLLLAFTMSLCSEADAFIGSSLLSLFGTAPVAAFLVFGPMVDIKNLLMMKRYFTGRFILSLIGLIALSVIGFTLFI

SEQ ID NO: 4523 - protein, 360 aa, Enterococcus faecium
  misc_feature (B) LOCATION 1...360
  hypothetical: YES
RSQYVFEKINVKNLLLVCSIYCLIPLTVMGETGWRATTLNYQWPVAFSLLTFYPFFQLLRGEEINRKIYWVSIPLLIFLTNQEQVNACFFVLTSIVSLYLIVNGRYNYKLSVFSIISLAELIFSLTTPGNALRAAHEINKWFPEYKNFNFLNKLDLGISSFGKPFFLDMNILFLLLFFLIFLLTYRKCQNYYVRILTALPFFLNLIIYFGNTMGQSFTYVNGNKRAMIWSSSNLNNLFTELGTKLSLFYPGTWIATLVVLALLLCLIVGIYLSFDNKKTSIFLVILMIMGFCSRLIMGFSPTVWASGMRTYYILYVVIAILVLMAVKELMKSMSVQKNEFMQFGLTVLGICTFIITVINR

SEQ ID NO: 4524 - protein, 60 aa, Enterococcus faecium
  misc_feature (B) LOCATION 1...60
  hypothetical: YES
LAQYVMKDKSLNENLRKTDYSMVVPVSQNVNSLLGINQWAEIVQNVTDIWSRRKSKAVNK

SEQ ID NO: 4525 - protein, 74 aa, Enterococcus faecium
  misc_feature (B) LOCATION 1...74
  hypothetical: YES
HAALEKSFDRRSRRKCKKWKHVIHTVQKISVIYSTEQLRKEFLVEKVFEPGKISLTYTHNDRMIFGGVTLLKKN

SEQ ID NO: 4526 - protein, 189 aa, Enterococcus faecium
  misc_feature (B) LOCATION 1...189
  hypothetical: YES
ERFFYYTADSLTFFFFYSIIDKSIVDESIIRKEEIMSLEEISHLLYQIKLADQKIVQIFEENIGISLTRYEIMMRLKEENPLLQSSLQEKLQIDQGAVTRHLKVLEANGYVSRQRNPQNNREVYVALTEKAQKKIEHCEMDHKDTGSVLSPAFSDVEMKQFLTLLDKLNTQLCNITTETKEVNNNGTKK

SEQ ID NO: 4527 - protein, 117 aa, Enterococcus faecium
  misc_feature (B) LOCATION 1...117
  hypothetical: YES
HQKYRKILGGGLSHCLFFIRRDKMVILDSIKKSMRIDHTIDDDFIQQLIDTAGEYIKSAIDSSATDKDMDNYQQFDLAVSLLTQHWYLNRQEASSERIPVTVQALVQQMRGAYYANH

SEQ ID NO: 4528 - protein, 147 aa, Enterococcus faecium
  misc_feature (B) LOCATION 1...147
  hypothetical: YES
MKKYWKFLLMIGVSTVVMFGMMYLNVYALDHIFFSRTRVFMALMMGAVMAVIMLLFMWKMYENKKINVMILAASLLVFAGSLFMVRSQTTVNDTAWMKAMIPHHSIAILASKRADLKDPEVKKLAEEIIQAQEEEIDKMKKMIKEME

SEQ ID NO: 4529 - protein, 365 aa, Enterococcus faecium
  misc_feature (B) LOCATION 1...365
  hypothetical: YES
KKKYRSFKSRPRREYMNSMANAYAKAGVDVEAGYEVVERIKKHVKKTERLGMMGAIGGFGGCFDLSVFQLKEPVLVSGTDGVGTKLAVAIEADKHDTIGIDCVAMCVNDILAQGAEPLYFLDYLATGKNDPLRLENVVKGVADGCVQGNMALIGGETAEMPGMYSGNDYDLAGFAVGIAEKSQLLTGETINPGDVLLGIASSGIHSNGYSLVRKIFFEQQQFSLSSKLPELKKTLGEELLEPTKIYVSSLLPLIKEKKIKGAAHITGGGFVENIPRMLPESMAAQIKLGSWPILPIFGCLQKYGEIPEMEMYEIFNMGIGMVLAVEESKVKEIVHEIEQAGEKVYEIGKVIAKEKHRVVFIGEER

SEQ ID NO: 4530 - protein, 287 aa, Enterococcus faecium
  misc_feature (B) LOCATION 1...287
  hypothetical: YES
KSEYNEKSLQSKKGSRSQMAEEKPAFKISILASGSSGNSLYIESEKKRLLVDAGLSGKKITSLMAQIDRTPDQLDGILVTHEHRDHIHGVGVLARKYHLDVFANQQTWEAMEPLIGNVPVEQKHLFEMGKVRTFGDIDIESFGVSHDAAAPQFYRFHKENRSFVMLTDTGYCSDYMRGVIENADGYLMESNHDLEMLRMGPYPWNLKQRILGDRGHLSNEDGALVMTDVIGNRTKRIYLGHLSKENNMKELAHLTMENVLKEKDFGVGHDFEIYDTDPDEATELFSI

SEQ ID NO: 4531 - protein, 105 aa, Enterococcus faecium
  misc_feature (B) LOCATION 1...105
  hypothetical: YES
MKEYTLVYSKSFQTSLETIIEEWENELALSPASIKRFVGAIQKALELTKNFPTMHEEVSEIYGMDIPTYRIVIGKSYALFYRIDHEKKEILVGRIFQSKQMKLGF

SEQ ID NO: 4532 - protein, 156 aa, Enterococcus faecium
  misc_feature (B) LOCATION 1...156
  hypothetical: YES
LYRYAXXAHVCGPVDCCPLLESTRCDRGSPRAPQAGRTLVEQLGAVQTPAKGELNVAISSFNYPKEESPALEQIKFAIQEGETLGIVGKTGAGKTTIIKLLMREYDDYQGKIQFGGRSIKEYSLNALLGSIGYVPQDHFLFSMTIRDNIRFSNPKL

SEQ ID NO: 4533 - protein, 254 aa, Enterococcus faecium
  misc_feature (B) LOCATION 1...254
  hypothetical: YES
MQRYFLKESYESKDYFVLEGENYHHIVRVMRMEPEDEVFLAFNDQIAIVAEITEITEEAVYLKEIKKEENQKELPSSITIASGYPKGEKLDWIVQKSTELGAQAFLGFPASASVVKWDAKKRMKRQQRLEKIAQEAAEQSHRQIVPSVELLETKQDLFERLDDYDVVLVAYEESAKQGEKSNAAKILSETKPDSRILAVFGPEGGLSRDEVDYFVEHKGILCGLGPRILRTETAPLYLLSAASYQWELMNPSFS

SEQ ID NO: 4534 - protein, 457 aa, Enterococcus faecium
  misc_feature (B) LOCATION 1...457
  hypothetical: YES
GKRYFLKKESRIMIVVQTLYKMKKKRGMFMENEQSVVLTNWKRNYLFFLSGQFLSGITSMVVQYAIIWYLTRETGSATILSFATLLGMIPMVLLSPFVGPLVDRWDKKALLIVTDIIVAIFALILAVVGTISESFPIWLVFVSLFMRSVAQTFQMPTIQSIMPTIVPSSHITRTNGQLGMVQSANFIIAPALGAALFSVVPVNYLILLDVLGAVFGVGLLIFVKIPKVSPEILEVPLTIFKDAKFGLQQLMDNKGLWYITINGAFVMLLFMPAISLYPLMTLDYFGGSVGQAGAVEVVYAVGMLLGGALISFIGTWKDRMKPIIIAYIIMGLTIGASGLVPNDSQGFLYFLILNAGAGCATPYFNTLLMAMIQQSYESNVLGRVLGNFNSLMNLAGPIGLLFAGPLADRLGVEKMFLFSGIGILLCGIVLFLTSAARNYDKELQKKLVKEHHEQKDE

SEQ ID NO: 4535 - protein, 133 aa, Enterococcus faecium
  misc_feature (B) LOCATION 1...133
  hypothetical: YES
FMRYLSTKEIIKINAKVILRHSPGEMIGVKDANALDMAVKQPSQAVFNQELYPEIYEKAAILAINLAKKHPFHNGNKRTALVAMLLFLQLNNCPVAFSRQEAVDFIIMITTSSLDFDSLKSKITSYLRQTAIK

SEQ ID NO: 4536 - protein, 244 aa, Enterococcus faecium
  misc_feature (B) LOCATION 1...244
  hypothetical: YES
SKGYERRREHMKKKQKQKLLNQFRPSLDGVRGQLFRSLEEESLRRYGLPLQVMLDPKNRQILTIGLAGKTNEDTRINVPIDDNFNTVLKRIRSGENGIFERFRDNLLIEIVSYWNDQRLKNDEPTAQAVATPVTEETVSVPDEKTEKPKADTTENTRSTDTNAALSFADFSKAVAEYPKFYTEQNEHEVVINEKNADEPRKLATISMTTENEFVIEKALERKYKVKLTLIPLIEQFAATAITDR

SEQ ID NO: 4537 - protein, 875 aa, Enterococcus faecium
  misc_feature (B) LOCATION 1...875
  hypothetical: YES
LGGYTCMNIEKMTTTLQEAIAEAQQIAVTRKHQDIDIAHVWKIFLQSNHFGRNFYTDAGLDVESFEHEIDRLLDEYPVVSGGNVQYGQNLSQNFFRLLNEADQIRESFGDEFLSTEVVILALMKLKNYPLTVYLNKNGLSEKELRKNIEEMRGGERVTSQNQEEQYKALEKYGVDLVQQVKSGKMDPIIGRDEEIRDVIRILSRKTKNNPVLIGEPGVGKTAIVEGLAQRIVRKDVPENLKDKTIFSLDMGALIAGAKFRGEFEERLKAVLKEVKKSDGRILLFIDEIHNIVGAGKTEGSMDAGNLLKPMLARGELHLIGATTLDEYRQYMEKDKALERRFQKVLVKEPTVEDTISILRGLKERFEIHHGVNIHDNALVAAATLSDRYITDRFLPDKAIDLIDEASATIRVEMNSMPTELDQVTRRLMQLEIEEAALKKESDDASKKRLKNLQEELAELREEANAMKMQWETEKEEVNSVSAKRAEIDKAKHELEDAENNYDLERAAVLRHGTIPQLEKELKELEAKAKDSEIKMVQESVTENEIAQVVGRLTGIPVTKLVEGEREKLIKLNETLHKRVIGQDEAVDAVSDAVIRSRAGLQDPNRPLGSFLFLGPTGVGKTELAKALAENLFDSEDHMVRIDMSEYMEKHAVSRLVGAPPGYVGYEEGGQLTEAVRRNPYTIVLLDEIEKAHPDVFNILLQVLDDGRLTDSKGRVVDFKNTVLIMTSNIGSQLLLEGVTADGTIPEAVAEQVNTLLRGNFKPEFLNRIDDTILFTPLSLDNVKGIVDKMVAQLAQRLEHQEILLTISDEAKTWIAENAYEPAYGARPLKRFITKEVETPLAKEIVAGHVMPKSKVTITLLDGQLHFKTEELEEIV

SEQ ID NO: 4538 - protein, 247 aa, Enterococcus faecium
  misc_feature (B) LOCATION 1...247
  hypothetical: YES
RTDFITGRMPIIVIIVAGTIGAGKSTLTEMLAQDLETKPFYENVEDNEVLPLFYSNPEKYTFLLQIFFLNKRFLAIKDAFSHDDNVLDRSIYEDSMLFHLNADLGRVSEVEVKQYEGLLETMLKELEEISPQKKPDLLVYIRVSFETMLARIKKRGREYEQLEQDPELYSYYKELNRRYEEWYEQFDICPKIVIDGDKYDFVADPACGEQIVQEIKMRAKKMTEEADAQSIRYTTNNPKAKGIFTTK

SEQ ID NO: 4539 - protein, 533 aa, Enterococcus faecium
  misc_feature (B) LOCATION 1...533
  hypothetical: YES
SLYLPKQLEETNMYKVFIIEDEYLIRNNLREQITVLGSYYPITYVGEAGDGEMALSSIIDLQPDIILTDIQMPFMDGLTFSKEARKLLPWTRLIFISGFDDFDYMKGAIQVQADDYLLKPIKSSELKQAIEKAVTALDLQQKETHTSSDLVFELKKNHFLNGLFKGSLTISETLKLAESFNRSLAGKKMTVLLAANQVSTDFEDYAHLSDYLKFLFRENQQVIFSAVSSRFIKFLIVDSLEENVIETSYQVAQTLVHELEKGQKNNFSVAIGPVAERISELPASFEITQMILETASSLKEQIISYEDLIQEAKLPVDSVFYFDLSLDLSSLSKNEVSKYIEHLTKPQGTPTRTRLYRLFVLTKLLQHVCLKEKKIPQEMVHCTSTSQRLAISADDSLYRSTVYMFISFLTALPSQPSRNKYQPILNHALDFIKENFTDPDMSLTWVAQQVALSPSHFSTIFSQSFNQTFIDYLTEQRIELAKKLLQQSDYRISDIAFEIGYNDPNYFSYLFKKKQGISPKEYRTQLFLKNKNN

SEQ ID NO: 4540 - protein, 442 aa, Enterococcus faecium
  misc_feature (B) LOCATION 1...442
  hypothetical: YES
NRYLGMWSDVVYQMKEEQKMKGKKWLIGSLLVAATGILGACGGGSSAESDSDKEVTLTFWNGFTASDGEILQEIVNEFNKTNDKNIKIEMDIMTWANLNEKLPTAISSKKAPDFIALNYPDFAQYVENGAVQPLDDFWEYDGVDKSDFKETAIELGEVEGKQYFVPMQVQGMYMYWNNDLFKQAGLDTEQPPTTWEELTEMAPKLTDSSKNVSGFVFNKDGTAPLYNWMLANGGKLVNDDYTKSEFASPENLKTLKAIQKMIHVDKTGPESISGAEMDNLMNAGQLAIEINGPWLNNGLKANEIDYNVTTLPQGSDSDKKTAILDGVGYAIPASTDNNKKEAVYEFLKYWNTTEIGKKWSIENGFPAYLDSVAKDEEVKNDPIVSELSKQMDYAEPYLPGFTQISAINNDIINPLIEKLLAGEDPETLMNDADDAINQLLQK

SEQ ID NO: 4541 - protein, 256 aa, Enterococcus faecium
  misc_feature (B) LOCATION 1...256
  hypothetical: YES
ARDFSKQEENRMNDLSEKVIVIMGASSGIGEATTKLLAEKGAKLVIAARREDRLKAIKESLPEAELYIQTADVRDFAQVQAVIDLAMEKFGRIDVLYNNAGIMPTAPLVEGHRDEWQNMLDINIMGVLNGISAVLPIMEKQKSGHIISTDSVAGHVVYPDSAVYCGTKFAVRAIMEGLRQEQRQNNIKSTIISPGAVQTELYQTISDKKAALELHEAQKEWGLTSEDIASAVAFAIETPDRMSVSNMIIRPTTQEV

SEQ ID NO: 4542 - protein, 398 aa, Enterococcus faecium
  misc_feature (B) LOCATION 1...398
  hypothetical: YES
CSDLGGWKMKEKILSYFEIEKLNTTVKREVLAGFTTFISMAYILFVNPTVLGASGMDEGAVFTATALASAIGCVLMGVLARYPIGTAPALGINAFFAYSVCLGMGIPWETALAGVFVASLIFILITIFKLREMIIDAIPADLKYAISGGIGLFIAFLGLSEGGIIVSNESTLVGLGSLNVGSTWLTIFGLVVTAILLVRRVPGGIFIGMAATTILGLVTGLIPMPSEIVAAAPSLKPTFLVALKHVGDINSLQMWVVVLTFLLVTFFDTAGTLVGLANQAGFMKDNKMPRVGKALASDSTAMLAGSLFGTSPVGAFVESSAGIAVGGRSGITAITTGDFLLVRLVLFSITISCYFTSNCTSIDYGRSIDGTIFATNRMGKLRDCDPFILDLDRHAFDL

SEQ ID NO: 4543 - protein, 311 aa, Enterococcus faecium
  misc_feature (B) LOCATION 1...311
  hypothetical: YES
NSHLLKERMIFMNTKDIEYYVQIVKQKNFTKVANYFRVSQPTITYALQRLEKEFDTVLITRDRSHHELIVTPSGKQLFLHAQTILQEISTARAEITQLQKKKLRFGMPPIIGNEYFPKLSSYFIKHELMNQIEITDGGPRDLYGMIRQGRIDLAVLGSTQPIVDQYLETELLLDKRFMIVVPPTHPLSKQDTVSFKDIADEQFVLLNEHYVHPAAFTKLSKQTHTHPKVVYQSNDLTILKSMVRENVGIGFLAEIAVHPEDHLVCLPLSDEVQPRFLISLAKRTQQIVTPLQEQVVQVIHEFVTAQKNSSS

SEQ ID NO: 4544 - protein, 333 aa, Enterococcus faecium
  misc_feature (B) LOCATION 1...333
  hypothetical: YES
FSNLTKTKIFKKEGEKVMMRKWKAVLGSLGILIALFIFGACSTNSKDKDTVASNEKLKVVVTNSILADITENIAKDKIDLHSIVPIGKDPHEYEPLPEDVQKTSKADLIFYNGVNLETGGNAWFTKLVKNANKEENKDYFAASDGIDVIYLEGQSEKGKEDPHAWLNLENGIIYAKNIEKQLAEKDPDNKKFYKENLDKYIEKLDSLDKEAKSKFASIPNDKKMIVTSEGCFKYFSKAYNVPSAYIWEINTEEEGTPDQIKHLVEKLRTTKVPSLFVESSVDDRPMKTVSKDTNIPIYSTIFTDSIAEKGQDGDSYYAMMKWNLDKIAEGLSK

SEQ ID NO: 4545 - protein, 162 aa, Enterococcus faecium
  misc_feature (B) LOCATION 1...162
  hypothetical: YES
LEDFYTMMDYLISQNGGMVFAVLAMATATIFSGIGSAKGVGMTGEAAAALTTSQPEKFGQALILQLLPGTQGLYGFVIAFLIFINLGNDMSVVQGLNFLGASLPIAFTGLFSGIAQGKVAAAGIQILAKKPEHATKGIIFAAMVETYAILGFVISFLLVLNA

SEQ ID NO: 4546 - protein, 210 aa, Enterococcus faecium
  misc_feature (B) LOCATION 1...210
  hypothetical: YES
VFFQIQYKSSTRDGGNNVNGLFITIEGPDGAGKTSILNELYPLLKEVAKTEIIQTREPGGIPIAEEIRAVILDPKNDRMDERTEALLYAAARRQHLVEKVLPALAKGKIVLCDRFVDSSLAYQGAGRRIGVTEIARLNEFATEGTTPDFTLYLDVDSDTGLRRIKKNRQNQIDRLDSEGLEFHQRVRHAYLKLAEENPERIHKVDARKSF

SEQ ID NO: 4547 - protein, 228 aa, Enterococcus faecium
  misc_feature (B) LOCATION 1...228
  hypothetical: YES
IDFHFSKLRYQPDFEHFSDEEFQQIKEHTVLRSYKKGQILFDDGDSRQRLYILTKGLVRLERYDESATYYYYDYVTTNNLFPMSGMFGEETYTYTAQAMTDIETFYLPVSYYEKLARKNPEQLIYMIQKISKVVEIHELRIQIGLTSSAFDRVKQNLFILKEELGVPTEDGHITIPYPITLKELAVNSGTTRETAGQVIKQLRDSGLLDYHKKHFTFCKTATTPALRE

SEQ ID NO: 4548 - protein, 631 aa, Enterococcus faecium
  misc_feature (B) LOCATION 1...631
  hypothetical: YES
YRNLFILLTYSNLWHKVSCQSTTISLFSKRIQLEYQKERGRDKMERTIPKNNISLKARVQKLGSTLSSMVMPNIGALIAWGVLTALFIPDGYLPNEAFATMVSPMLTYLIPLLIGYTGGKVIAGDRGSVVGAIATMGVIVGTDIPMMLGAMIMGPLGGYAIKKFDQLFQKRIKSGFEMLVNNFSAGLIGFGLALLGFSAIGPVVDALTQAMAKGVEIILSAHLIPLTSIFIEPAKILFLNNAINHGILTPLGTEQVAEAGKSILFLLEANPGPGLGVLLAFTLFGKGAAKSSAPGAMIIHFLGGIHEIYFPYVMMKPLLFLSVIGGGMSGSFIFQLMDAGLRAPASPGSIIAILAMTPFNSYLPVILGVIVAAAVSFGISAVILKADAKDTNEDFEKSVQETKAAKQASKGAQGIPQGATFSGVQKIIFACDAGMGSSAMGASILRKKVQEADLPQTVTNQAISQLTDDSNTLIVTQVELQERAKQKAPSARFVSVENFLNSPRYDEIIQELSSKQKTSVSEIENEPAEEFLSANIKQIKEILLVHDDRSGSATMGMTVLKDILDKNHLTIPLRKVNIQDLKDEPDSLIVAKESLAEKVQMAAPQSIHLSVNSMVNPQKYESIAQYLKQTA

SEQ ID NO: 4549 - protein, 65 aa, Enterococcus faecium
  misc_feature (B) LOCATION 1...65
  hypothetical: YES
NLFHRLIGRWSCSIKLLRYFTVRCSVLVYKPTLCNFLKAEPREGALSVTIAFGSPNCLWSRFKKA

SEQ ID NO: 4550 - protein, 306 aa, Enterococcus faecium
  misc_feature (B) LOCATION 1...306
  hypothetical: YES
RGNLKREERLFMSFQIGELFNLDYWQQMFSGDLFSLNFLVNILDILVVWYLVYKLIQLLRGTKAIQLLKGVAIFIVIRIVAEIIGLHTLSWLMNQVITYGVIAAIVIFQPEIRRGLEHLGRSSLFKQSKSEQQEDEKMILSFDKAIQYMSKRKIGALITIERHTGLDEYIETGIALDADITGELLINIFIPNTPLHDGAVIVKEGKIAVASAYLPLSESMLIPKEFGTRHRAAVGISEVSDAITIVVSEETGDVSITLDNELMAGLSQQEYLAILRRELIAEEKTKNKKNVIQSFLDGMTKGGDRK

SEQ ID NO: 4551 - protein, 240 aa, Enterococcus faecium
  misc_feature (B) LOCATION 1...240
  hypothetical: YES
RKFQLLWRTGQRKINHFLCISSYQYIGIVSNNCLSRRNPSMLLGSHVSMSGKEMLLGAAEEAASYGYWTFMIYTGAPQNTRRKAIVEMHIDAGKAYMAEKGLTNIVVHAPYIINLGNTIKPEMFPFAVQFLREEIVRAEALGATQITLHPGAHVGAGTEAGIARIIEGLNEVLTKEQTAQIALETMAGKGTEIGRTFEELAQIIDGVKLNEKLSVTFDTCHTNDAGYNIKEDFFRCNGRV

SEQ ID NO: 4552 - protein, 1297 aa, Enterococcus faecium
  misc_feature (B) LOCATION 1...1297
  hypothetical: YES
LPLQVVVDERIDNQELQENETDTEDSAEIQRSEENEMEKLDEPIVPSGQALQRIQRQLFNGILERLGPTATQDPYEYIYPSGEVENEQHRYPKFTTNDYTKVLGNWTQSNERYQGDKGSPYDGENLIDDSDYTNGGANWRNYDYATNNGSTAGEEDRNVPAQTVQLWGNERNFENSYLDYNGAYIKKWVEPVLPSSTASDLHPEDATTLYNVYLDVIGGEKKEISPIDIVFVLDKSASMSELTAGTNSQTKNAALIEAVNEMSKDLLSDPSLDIRIGMVNFYHNSTAINNHEQISSDIFPLTNDINRLTGSENTALNRTPIGGTPLTLGLKNGYETLYKDNGGENRNPEKILIVVGDGTPTFSYAPIQSSYRTSTNGAWSNWTVMEDKIAEDNDVLFRNFEEFSGNTSNAGFTHPVTYASDFNRPEDEVNVHYRYGEVKEGDNKATHWVGDGSSNNNTNGSPTSQEKSSAINTVAYHHWLKNKYQENPPSIFSIGLGIDGNVSGRQRLDAIGRNVLKNIADLEEDGVTPRYYNANNKNDIVTALEDISSTFKRTIQQATLYDETGFNVSPFGAGRSADIQFYHLDPGENGMKYQEPEIWDEERHGQAPPEVVATPTTYVGRENQAYKFSPISLGEGEMVRIKYQVKLDAGAQDGNFCTVNNMAYIQNLEDYENDITTGRMYFPSSSIRYEHKGRNFQVSKKGQNGEPLAGVEFALYDQNPESGEAEPIETSKTTTDGIAIFETKMPILGDETGAVSDIFWIREIAGPPRYQLVDETYQFQIKKYAANEDEMLGHYELVDEYTSGSRVGGPEGKDPNSYYEGEYHKLSVVQEPNIEGTEYDELYVKLEMRNEFKPIHMNINKLIEGSNMPINGAEFELYETDGNGLEIGYPVAKGLSGVNEVEEEKGRLTFYSVDEDGKYVIVDGEKVIHPIGEPDSFVYKDSEETTNYAEYKIIESQNPEGFKEPDENDTWILRLYDNAIGTIQLKQTGEENWQYLTYTTDEEDRLWVAFTAYNTFDYREIRVRKLDHEGHTLDGAGFDIRKVGDSSFPLYRAYTGNPLEPEESKRLPGIGYFYSRAVGVEKYVDLNYDQPLHLSIGEYEVSESVAPNGYRLSDQVFQFALNEEGKFIIEDTVIEDETAPLPEGYEIIDGVLQVTLEDELAPIDLELLKIDSMNSRRLEGAEFSIEKQNSAGEYEIIEGGLAPDPNDSSLFNASDLLEGVYRIKEVKSPDSYRKLPGYFILEISYREEPDIENDRVVPGKEAGTLKVEISYYPNEEAETPDLQQELEYELLETNRIR

SEQ ID NO: 4553 - protein, 115 aa, Enterococcus faecium
  misc_feature (B) LOCATION 1...115
  hypothetical: YES
AANLQVVYSKEDHTVYFDEENGYELEWLVADSNEKEMEPVLLTFEGAGEYKTFEPSLSETFIFVLEGELELSLGETVYVAKAGQSIYYQATKQHQLRNHLKKRTKVLIVATQSYL

SEQ ID NO: 4554 - protein, 575 aa, Enterococcus faecium
  misc_feature (B) LOCATION 1...575
  hypothetical: YES
SAIQFLFFCKNNLYSFSRSNDESYGKIKLVIYGRKIMENKNNHLSPKPLFLILFILIEVLVVLILPFRFVSASVILLMNLWGVRYWLKMKRWLILNKREKIQQASTVAETNLAYVSEVMPVGVIAYQPSSQKIEWLNPLALKIKDQSGLTEEELLDTFFTAKEKKKNQVYLADKTFQFDMDTVKGVVYFNDITQNQLLKLHQTNSQPVIGILSIDNYADAIDKLDDKEISYLNSFVTTLVSDWMNEYHVFFKRINAERFFFVAQMIDLKKMMDKKFDLLDRFRAEAEKQSSPITLSMGIAYGSRTLDEIGGEAQNNLDVALVRGGDQVVVKEVKEGAKPVYYGGKSAKNVKRTRVRSRAMSTALRRIFDETGDVFIMGHKFPDMDALGSAFGVSCLARFNQKKAYIVINENEIIPDVERCLEEIHKHPELEMQLISPERAIELKKEEDLLVMVDYHKPSLSISQGLYEQFDKIVIIDHHRRGEEFPSKPLLTYIESSASSASELVSELIQYQSSKTNRLDRFEATLLLAGMVVDTNSFNVRTTARTFDVASYVRSCGADASLVQYLLSLDLAGRP

SEQ ID NO: 4555 - protein, 62 aa, Enterococcus faecium
  misc_feature (B) LOCATION 1...62
  hypothetical: YES
FNIHFYSSSIKYPHMLLTQSKDHFSLFEQMLNELKIRLGGYEDTQNLNHLTIPANPNTLRDT

SEQ ID NO: 4556 - protein, 384 aa, Enterococcus faecium
  misc_feature (B) LOCATION 1...384
  hypothetical: YES
TNIQRRYIMKVTLNRASFMQELQTVQRAISSKTTIPILTGVKITLTQEGLTLTGSNADISIETFLSVENEKANMQIESTGSIVLQARFFSEIIRRLPEETFTLEVLENKQVAITSGKANFIVNGLDADNYPHLPVVESHNQMKLPVHVLTKLINETVFAVSQHESRPILTGVHFILSDNSLLAVATDSHRLSQRVIPVEQAADHFDIVIPGKSLIELSRSLTNEEEIVEISIMENQVLFKTETMYFYSRLLEGNYPDTNRLIPSSFNTEVEFSVPSFLAAIERASLLSHEGRNNIVRLSIRPDAVVLYGNSPEIGKVEESLSYTASSGDPLDISFNPDYMKAALRAFGDMSIKVKFISAIRPFTLEPTEDGVQFIQLITPVRTN

SEQ ID NO: 4557 - protein, 150 aa, Enterococcus faecium
  misc_feature (B) LOCATION 1...150
  hypothetical: YES
MSIQNVGRVINMEKETIVEVTKLGFTIQAAVKVIGKDLLITLTGGDTPHIGTVTTFSRDTEMQTVRFPSHDGRFHKDDVLAEKIAVIIKTAVPGSCTITSGIHVDHISNAQINASFPMSEELGYKILDWLEKIDFHIKEPVYYKDGEKPL

SEQ ID NO: 4558 - protein, 73 aa, Enterococcus faecium
  misc_feature (B) LOCATION 1...73
  hypothetical: YES
EEIHENCFSNFCEFQLISEGVASDSAVYTCLERETKVFFTFVPRSVFLCVLLCVVVFFFHFLHTFTFFLVIPR

SEQ ID NO: 4559 - protein, 713 aa, Enterococcus faecium
  misc_feature (B) LOCATION 1...713
  hypothetical: YES
KEIQNMLKKINAVLSLFVCITILFFSTNVINGIKTSEALYKNTAEIHMQYKDDMDFNSYINALYEISTQENINISQYSFTAVNQLTILATNPNANKHWKFSKKNILARNDSKVHYTNNKNSKYQLKLPNNFLNINIYPFSHVENIGLSEILYVQGNSNKLIPVLKKYGTPTISNINQSDTFQINTNIVLVICYLSIFIVITTIIFAFSKMKEITLKKMLGYNSFDTIKDSIKELNLLFCSLIITFILSIFLSIYYSNENFFLSFLLCSIFHFIISFLFIIVTLSIYHLSSIKNYLKNSRPLKLNLCILNICLFLSMILLLIASTKVINIHNEAENNSLKYWERTTNLYKTNITNQLNRNNTVEENNYLKKASKFVYKIQKNYKTFIIAPYNYATIQENNKEFFIGQKVYPNFEDYVSQPAGAGICVDLNYLKYYNPISFEESTDLNLINSDPLTTYILVPKKYKEYAKMIEKNYLEDIQFRLEDSPPQAPYKTPNLKNLKIKLIFVNNNQKYFSFNTLYGKAKDNYTITDPIVRVINPEITESLFWGNILTSDGGLFFDQKHTSNQNFFNQINPYIKEFNLENIINFSYSVFQETGELLSQKKVNKLNAYLQYLLILGLFIIINFQMIFVSFTINSKKIALKKIFGYSPISQVLDLCLLPFTIELFATMCFQLIFSKNTYLYFIIFMIFLINLITSIIIYKKNSFKYFKENIL

SEQ ID NO: 4560 - protein, 85 aa, Enterococcus faecium
  misc_feature (B) LOCATION 1...85
  hypothetical: YES
EGIHENCFSNFCEFQLISEGVAFTSAVCTCLERETKVFFTFVPRSFLCVFHTSLSRSLLLRTNPSLVRKRSEIVGVGPRYSLRRP

SEQ ID NO: 4561 - protein, 198 aa, Enterococcus faecium
  misc_feature (B) LOCATION 1...198
  hypothetical: YES
KMIQAHDIVLFDKHEIEGFTLPEWVVLTEKMFGTVRRASTDHAEILPIGLRGPARNQRWSTEISKHAVKQVIHPWDIIEQESYRQEKIMDYPVYQQFHAARNILSGCKWGIGGSLGFELSTGIPAVKETSDFDLLLYANSPIELPIQVIQSHPAFFEQFDTQVVTRQGGFSLKEYLREPEKKILLKTVEGPKLTKELW

SEQ ID NO: 4562 - protein, 400 aa, Enterococcus faecium
  misc_feature (B) LOCATION 1...400
  hypothetical: YES
LWVHGNINTQVDRASLRENGQKNPVWIHFGGGNLYRGFHAEIAQRLADLGELSTGVIVCETFDEEIIERAYQDFDDLILEVVMPSSGEFVKRILAATADSLYCHPDCSEHFDKMIRHFENPSLQLVTFAITEKGYRLKDTNNKYIGPIAVDIKNGPKKPSHTMSILAALLYKRFLSGAWPIALVSTDNFSQNGSQLRTSLLTIAKEWQKEGYVQNTFIQYLSNEEIVAFPWTMIDRITPNPSLSVSKMLAKEGFSNMSIFQTAKGDNIDPFVNTEDIHYLIMEDHFPNGRPKFEKAGVFLTDRATVDKADTMKVTTCLNPLHTSLAIMGCLLGYRSIAEEMKDPDLSLLVFEIGYNEGLPVVESPGIIDPKIFLEEVITVRFGSSTIFLXYDSGRVPXGK

SEQ ID NO: 4563 - protein, 340 aa, Enterococcus faecium
  misc_feature (B) LOCATION 1...340
  hypothetical: YES
NSSHLSSKYFILIDKLLFLHLEYQSRGEVLVSKIMTAYHKNERLKKIVVILITGLTAAVALNYFLIPANVFSAGMNGIAQIISSLLYEWFHIKIDTGTFIFLLNIPVFVLGFLKVGKRATILSFVNVVCVSVMTMLLPVGQITDNILMNALVGGVLLGLGVGLSLKMGFTTGGMDIISLVLSQTTGKTVGNYMLILNGIIVVIAGFFFNWESALYTIISIYAMTQVIDAIHTSHQKVTAMIVTVKPEEVTEELAKRMVRGMTLLPSVGGYSKKQGNMIMMVITRYEMYDLDQIVHEIDDDAFINILPTHSVFGRFANENEQKMYRTTGVLPEIKNRSQKK

SEQ ID NO: 4564 - protein, 584 aa, Enterococcus faecium
  misc_feature (B) LOCATION 1...584
  hypothetical: YES
LGPQTSQSMKVKVISIDVLVSIAAIGALFIQNYEESAIVTFLFLFGHYLEQRTLNQTRSAIKELTEMAPESALKQMDNGEFEEVDVDDIDEGDILLVKTGAKVPVDGIVLTGEGHINEASITGEAVPVNKQADAEVFAGTILENGTIQIRADRVGEDTTFGKIIELVEEAQDSKSEAERFIDRFSKYYTPAVLVLAIVVWAFSQNIELAITILVLGCPGALVIGVPVSNVAGIGNGARNGVLLKGSEVIQDFSKVDTIVFDKTGTLTVGNPEVAETEVYGDNVEKAYSYLASVETESDHPLAKAVLQHTGKVELFPVEDTDVVKGGGIVAQVDGHRIAVGNVALMEKENVQLSKKAQKDVKQFEKNGNSLVLTAVDGELKILMGIRDQIRPGVKQDLQELKNLGVKDLVVLSGDNQGTVDRIARELNLTEAHGHMLPEDKAAYIEKLQQKGHTVAFVGDGVNDSPSLALADIGIAMGSGTDVAIETSDVVLMNSNFSNLPHALGLVKATANNMKQNIVISIGVVLVLLTSVFFSEWMNMSIGMLVHEGSILVVIFNGMRLMKYKLKGRKEQKEVSAPAEKVKIS

SEQ ID NO: 4565 - protein, 60 aa, Enterococcus faecium
  misc_feature (B) LOCATION 1...60
  hypothetical: YES
EETQENCFLNFCEFQLISEGVASASAVYTCLERETKVFFTFVPRSFLQINNVLEVVSSFT

SEQ ID NO: 4566 - protein, 60 aa, Enterococcus faecium
  misc_feature (B) LOCATION 1...60
  hypothetical: YES
MADLGHLLDLANCEEAFGSIQANVTPAYQFQLFHQKYGLIQCQLCIGAITNNHYASHLTA

SEQ ID NO: 4567 - protein, 191 aa, Enterococcus faecium
  misc_feature (B) LOCATION 1...191
  hypothetical: YES
APAQSEVTGRAWLLHNLFGFAPSVTSLLFNLPLLLISLFLFGKHAFLRTIVGTFALVFFLHLWESLHIHFAVYSLLINSLMTGILSGIGCGLVFRFGGSTGGTDIIYQAIEKYFHIKIGKSLFLITFGILVVSLLYLDLTHFLYTLLSCSILSYTLNKVKYLEIGSVLPQLEAKQTTETFEPLDPLEQLEH

SEQ ID NO: 4568 - protein, 248 aa, Enterococcus faecium
  misc_feature (B) LOCATION 1...248
  hypothetical: YES
LCAHMLRIGRCEFVRSVCIATFNGGRYLREQLDSILSQLSAEDEVVISDDGSVDDTWDILTEYAEKDKRIQLFSGPRQGLIANFGYAIQQTKGDLIFLADQDDVWLETKVKKITDYFEQNPDQLVVVSDLIIVDSELQEIHDSYFSFRNSKEGWLNNVIRSHYIGAGMAFRFSLKPDILPIPSEVPMHDMWIGLLGGKKTGFLREPLTLYRRHDLNASEIETHSKLRQKISWRVHLITALIKRKWFKR

SEQ ID NO: 4569 - protein, 173 aa, Enterococcus faecium
  misc_feature (B) LOCATION 1...173
  hypothetical: YES
RAAQSENRRRRILGGRKMIVLTRVDHRLLHGQVAFSWTQTIGADCILIANDDVPTNEIRKTTIKLAKPQGVKLVIKSIDDSIAALKSGVTDKYKLFIVVESIEDAYKLAEAYPEIKTINLGGIKAKPGTRSIGKAVNILPEEEERLKRLIDKQIEVEIRQVPADKKVDVREVL

SEQ ID NO: 4570 - protein, 380 aa, Enterococcus faecium
  misc_feature (B) LOCATION 1...380
  hypothetical: YES
GFYQGLQSGSQRIIFYDMCRHFNDSKKIMSREPNKNGAQCLPKNNRHTRSFFMKLHPMWEKYPALSKELTETLKRMEETVRLKNKPVEQAIKETIHAGGKLLRPAYQLLFSQFGPEQDRDKAIALAASIEMLHTATLIHDDIVDEADLRRGQPNIRSQFGNVVSVYAGDYLFVCCFKLLSDYSTSLKSLQLNSRSMEKVLNGELGQMDDRYNYELSVKEYLENISGKTAELFQLSCSVGAFESGTSERFAKKAGDIGLSIGMAFQIIDDILDYTKESQEIGKPVLEDMRQGVYSLPLIYSLQKNKPKLLPYLEKKAAMTEEDVDAVRKIVEHTGGVEEARKLAASYTEKALKEIKKLPATSLRTKENLFSLTQLILDRKD

SEQ ID NO: 4571 - protein, 81 aa, Enterococcus faecium
  misc_feature (B) LOCATION 1...81
  hypothetical: YES
SIYHTIIKKEVLLMKAIHISLLFFASALILFAIHLCSQPYINNNGILVEPAFFCLPLGFLSLLASAGFGFVAFFKRSKQQI

SEQ ID NO: 4572 - protein, 112 aa, Enterococcus faecium
  misc_feature (B) LOCATION 1...112
  hypothetical: YES
DTYQRRCETVMFVKKGDKVKVITGKDKNKEGVVLAAFPKKDKVIVEGVNVVKKHQKPSQAAPQGGIVEMEAPIHVSNVMVVDSTGVAGRVGYKEVDGKKVRVSKKTGEVLDK

SEQ ID NO: 4573 - protein, 69 aa, Enterococcus faecium
  misc_feature (B) LOCATION 1...69
  hypothetical: YES
QRYQTNIPDIYAVGDAIVVKQQITGKEALNSLASPPNRQGRQVGGHDFPDFLERNSSGIGTTNYSKLLE

SEQ ID NO: 4574 - protein, 73 aa, Enterococcus faecium
  misc_feature (B) LOCATION 1...73
  hypothetical: YES
QEYQAVGATGGVVIGPIEEAQSFRGSQNTGIKAELIRKFRPNKKEISCQAMAREIAPAEKPQKKALRALEWAG

SEQ ID NO: 4575 - protein, 64 aa, Enterococcus faecium
  misc_feature (B) LOCATION 1...64
  hypothetical: YES
AFHQSPIRPEHSPDADRACHGGEKQNPQVQYQQECAGNRRFRQRQDPLPHQAEPHANERQLYYY

SEQ ID NO: 4576 - protein, 76 aa, Enterococcus faecium
  misc_feature (B) LOCATION 1...76
  hypothetical: YES
SVHQILGNILNEGVDWATTGQDADEGDGSDDHVIDHPSPIMEGNHHFFIAFTGSFIQRRCEDIHKDVFQEHNNNGS

SEQ ID NO: 4577 - protein, 64 aa, Enterococcus faecium
  misc_feature (B) LOCATION 1...64
  hypothetical: YES
KSHHFEFASLRTNGFLESFWLAFVDSTNFANDQEKNEYKATSYFLKERDFQADILNLSWTKRFQ

SEQ ID NO: 4578 - protein, 86 aa, Enterococcus faecium
  misc_feature (B) LOCATION 1...86
  hypothetical: YES
SGHHLIDELTSALDPVSTGKIESMLLELRERYTMIIVTHNMSQASRISDKTAFFLDGHLIEYNDTKKIFMNPEKQETEDYISGRFG

SEQ ID NO: 4579 - protein, 73 aa, Enterococcus faecium
  misc_feature (B) LOCATION 1...73
  hypothetical: YES
IFNHEGGKRMSEEIRENIHDVNLTSEMKDSFIDYAMSVIVARALPDVRDGLKPVHRRILYGMNELGVTPDKAQ

SEQ ID NO: 4580 - protein, 289 aa, Enterococcus faecium
  misc_feature (B) LOCATION 1...289
  hypothetical: YES
IYNQRIGDMDEMKLIGIDLDGTLLNSDQSISQKNARTMKHLPEDCFPFICSGREVEDINNILKKSGLRIPAVGLNGSVGFDGEKKIFESSFDKNDVKKIDSVLSKFPTKIYTNLGSYESQNYKNKMKKIFHEVGSEFSIKELNYELEYEKSICSIPYNNIEEIIEKDAISIYKFFIFIPNRQLKANIFNHLKKMLNVSVTESAPVNIEIVPQNVSKGVVFDRLESIYNLKKPLRIAIGDSLNDLSMFESADISFAMGNSHQEIMKKADYVTVSNDKDGVSQAFERILTI

SEQ ID NO: 4581 - protein, 264 aa, Enterococcus faecium
  misc_feature (B) LOCATION 1...264
  hypothetical: YES
AANQIGGEEMAQIISVANQKGGVGKTTTTVNLGACLASLGKKVLLVDMDAQGNATSGVGIRKPDVTRDIYDVLVNELPIDEATLITEHENLSIVPATLQLAGAEIELTSMMARESRLKGSLAEVSSQYDYILIDCPPSLGHLTINSFTASDSILIPVQCEYYALEGLSQLLNTVRLVQKHFNPELEIEGVLLTMYDARTNLGNEVVEEVRKYFREKVYETIIPRNIRLSEAPSHGKPIIDYDPRSRGAEVYQALAKEVVSREEK

SEQ ID NO: 4582 - protein, 165 aa, Enterococcus faecium
  misc_feature (B) LOCATION 1...165
  hypothetical: YES
MNNQITLAYLDYDDLDALQVVSVVSFYESFIDGADPLDMQGYLQTQLTTEILAVELAQSTSKFIGIKDHQILIGYMKVNDEKDAIEIQRLYLLKDYQNKGLGQRLLDEANRYAKTKQKRYLRLTVYEKNHAGIRFYERHGFKKIGIKHFPLGKQDRICPILEKEI

SEQ ID NO: 4583 - protein, 165 aa, Enterococcus faecium
  misc_feature (B) LOCATION 1...165
  hypothetical: YES
MNNQITLAYLDYDDLDALQVVSVVSFYESFIDGADPLDMQGYLQTQLTTEILAVELAQSTSNLLGIKDHQILIGNMKVNDEKDAIEIQRLYLLKDYQDKGLGQRLLDEANRYAKTKQKRYLRLTVYEKNHAGIRFYERHGFKKIGIKHFPLGKQDRICPILEKEI

SEQ ID NO: 4584 - protein, 271 aa, Enterococcus faecium
  misc_feature (B) LOCATION 1...271
  hypothetical: YES
ISNQRDQIKPENNQKVKYWRVKMTEHRSYYAIIPANVRYDKRLKPNTKLLYGEITALCNERGFCWAGNEYFADLYGVNKETISRWVSDLIKFGYLNREIIYKEGTNQIINRYLRINQYPIDEKRNTPIDEKVKDNNTSINNTFNNTKEYIRELPPSKKSKAKPVRHKYGEYKNVLLSDEQMEKLKTEFPNDYQERIERLSEYCESSGKTYKNYLATIRSWARKEKSEPKNASSGYKRTGRREKLPEWAIDQEAYLKKKALERANRQSKAPF

SEQ ID NO: 4585 - protein, 109 aa, Enterococcus faecium
  misc_feature (B) LOCATION 1...109
  hypothetical: YES
VPNQVHYLLFLCCFRCSCFLCYSHYSCFLCYFHYSYSPYCFRCSCFLCYFHYSYSPYCFRCSCFLCYFHCSYSLYCFHRSCFLYCFHYLCYPYCLAVQQLSNCLVSNSP

SEQ ID NO: 4586 - protein, 292 aa, Enterococcus faecium
  misc_feature (B) LOCATION 1...292
  hypothetical: YES
NKNQGADNHMFLLTGGNGQLGTELRHLLDEKNLPYVSTDAKDLDITDAEKTMAYITELKPDVIFHCAAYTAVDKAEEEAKELDEKINVDGTRNVALAAKAVNAQFVYISTDYVFDGKNKNVEYEVDDQTNPLNEYGRTKLLGEKAVEEILEDYYIIRTSWVFGIYGHNFVFTMQRLAETRDKLTVVNDQFGRPTWTRTLAEFMVYVIEEKAPFGIYHLSNENSCSWYEFAKEILKDTDVEVAPVTSEEFPQKATRPQYSVMSLKKTEALGFVIPTWQEALAQMLEAAKKMNK

SEQ ID NO: 4587 - protein, 313 aa, Enterococcus faecium
  misc_feature (B) LOCATION 1...313
  hypothetical: YES
AMNQEINLAQMQPIVYQQLQRSFEHGRIAHAYLFEGEKGTGKHEVGIWLAQHLFCTQMKDNLPCGKCNNCQRIEKKEHPDVLVIEPEGQTIKVDQIRRLQTEFSRSGYESRKKVFLIKEAEKMNSSAANSLLKFLEEPPGDFLAVLETDAVGRILPTIQSRCQVLHFQELSKEALIHRLQEEQIPLEKAKLLAFLTNSLGKAVEISQDEWFNDAKDLIYQWFVYLQKQDTQAFIYVQKKLVKSFKEKTQQFTGLSVLMFYYQEAQRQAVANGEYGKVKQINQIIERILIAEQKLRSNVSFQAVAEQFVLHTIF

SEQ ID NO: 4588 - protein, 239 aa, Enterococcus faecium
  misc_feature (B) LOCATION 1...239
  hypothetical: YES
TMNQLDQRPIIALDFSTRQEVEDFLRFFPKEEKLFVKIGMELFYQEGPEIVRYLKEAGHNVFLDLKLHDIPNTVEKAMRGLAKLGVDLTCVHAAGGIRMMEAAMRGLEEGTPEGGKRPLLLAITQLTSTSEEEMHADQLIEVSLEKSVIHYASCAKKAGLDGVVSSAWEVEAIKEMAGDEFVCLTPGIRPEGTVAGDQTRVVTPSQAKKIGSTFIVIGRPITQSTNPYKAYQTIQTEWS

SEQ ID NO: 4589 - protein, 111 aa, Enterococcus faecium
  misc_feature (B) LOCATION 1...111
  hypothetical: YES
LKNHHQLHNLQQQKNQQHLNLQQKNQQRLNLQQQKNQQQRLNLQQQKNQQQCLNLQQQKNQQQCLNLQQQKNQQHLRLQHHQQIKVLIQETAQEVVLRLQRQHQHLNNQNL

SEQ ID NO: 4590 - protein, 132 aa, Enterococcus faecium
  misc_feature (B) LOCATION 1...132
  hypothetical: YES
FRNQSVRNQCIILIYKRRSVKLVKMSDEALKIIEESQNREKLKQVIDLIEERLVEHAIVPTELQWTILINHLNEMLKRSQRKETIPVVDRDLFKEVSKEAITISDEIVRSIGNLTDDEIYVLSIHFETAKNN

SEQ ID NO: 4591 - protein, 76 aa, Enterococcus faecium
  misc_feature (B) LOCATION 1...76
  hypothetical: YES
IIDHSCIDHDFIRNKLYFRTDRNIFFHVICTCTDCRLSLLFIESYCQAVDESKNQKNMGCRNCAAPFSCSNYLDFT

SEQ ID NO: 4592 - protein, 70 aa, Enterococcus faecium
  misc_feature (B) LOCATION 1...70
  hypothetical: YES
SYDQHPFSRSYGVILPSSLTRVLSLTLGFSPRLPVSVCGTGRCFLTRSFSRQCDIRNFGTIISLPITACP

SEQ ID NO: 4593 - protein, 70 aa, Enterococcus faecium; identical to SEQ ID NO: 4592
  misc_feature (B) LOCATION 1...70
  hypothetical: YES

SEQ ID NO: 4594 - protein, 316 aa, Enterococcus faecium
  misc_feature (B) LOCATION 1...316
  hypothetical: YES
NVDHMIGLSSLSFFYMERKRCMTEPIKNLCKRATAAALVLISLFALSGCQTTKINTTEVSDKEKTAESSKVIEKTTIPTLFFHGYSGTENSFKGMLRRLEKNQQAVKELVLTVGTDGQIQATGDLSGKADNPMVQVLFEDNKNNEWNQAEWIKTCLLYLKENYGINKVNIVGHSMGGVSALRYLGTYGQDTSLPQVQTLTAIGAPFNDFVDDSAQSLTDELAKGPAVVSNRYQDYQQMIGNIPITTRFFLIAGQLDETDLSDGTVPLNSALAVYALLKQRGNEIEEKVVTGENASHSMLHENQEVDQLVSRFIWKE

SEQ ID NO: 4595 - protein, 498 aa, Enterococcus faecium
  misc_feature (B) LOCATION 1...498
  hypothetical: YES
RSDQNRNCSSKKVLGGCNRMSYEVKSLNEECGIFGVWGHPDAASVAYFGLHSLQHRGQEGAGIVSNDRGKLKGHRDLGLLSEVFKDQRKLQQLTGEAAIGHVRYATAGNGSVDNIQPFLFKFHDQSIGLAHNGNLINARSLRKELEENGAIFHSNSDTEILMHLIRRSEETDFLNKLKSALNEVKGGFAYLLMTETAMIAALDPNGFRPLAIGQMKNGAYVIASETCALEVIGARFIRDVQPGEIVIINDEGIQIDCFTKDTQLFICSMEYIYFARPDSNIAGINVHTARKNMGRNLAKESPVKADMVVGVPNSSLSAASGYAEASGIPYEIGLVKNQYIARTFIQPTPELREQGVRMKLSAVRGVVEGKKVIMVDDSIVRGTTSRRIVHLLKEAGAKEVHVRIASPPLKYPCFYGIDIQTRKELIAANHTIDEIKECIGADSLGFLSEEGLIESIGLEKDAPYSGLCMAYFNGDYPTPLYDYEEKYQESLKEKVSFF

SEQ ID NO: 4596 - protein, 68 aa, Enterococcus faecium
  misc_feature (B) LOCATION 1...68
  hypothetical: YES
WQDQGVSVANLPLFQLEKPQQEEVCVLVTDAGEIRLRLFPDQAPLAVANWRSLAEQGVYDNTPFGSCH

SEQ ID NO: 4597 - protein, 152 aa, Enterococcus faecium
  misc_feature (B) LOCATION 1...152
  hypothetical: YES
SWCHWRCLISLEICLKKRRHYMVLWVINIILLLIVLAIIFWEVYLRVMAKRSATTLTEEEFREGMRKAQVIDVREKDVFDAGHILGARNIPYTVLKDSLGSIRKDQPIYIYDQKKSLSIRTANKLRKAGYKEIYLLKGGYDGWSGKIKSKKV

SEQ ID NO: 4598 - protein, 272 aa, Enterococcus faecium
  misc_feature (B) LOCATION 1...272
  hypothetical: YES
LRCHMRKEIKNAKRIIVKVGTSTLIYPNGNINLAAIDQLAFVLSDLRNRGKEVILVSSGAVGVGMHKLHLSERPTLIPEQQAAAAVGQAELMNIYNQRFSVYNQQTAQILVTRDVVDYPESRKNVRNTLEQLLIMDTIPIVNENDTVAVDELDHLTKFGDNDQLSAIMAKLVAADLLIVLSDIDGCYSDNPTTNPEAQMYRYIDKIDEKILAQAGGAGSTFGTGGMQSKLKAASRIFEANSAMILANGKNPAIIFDILAGKEVGTLFKEDLK

SEQ ID NO: 4599 - protein, 80 aa, Enterococcus faecium
  misc_feature (B) LOCATION 1...80
  hypothetical: YES
LFRHTIWFYFFIFSFFIGPVCSNPEFSDFMHFLCSDLNFYRISCRTDHGSMQRLVHISFWHGNIILKSAGHWFPFCVDCS

SEQ ID NO: 4600 - protein, 74 aa, Enterococcus faecium
  misc_feature (B) LOCATION 1...74
  hypothetical: YES
PVRQVTQIFFPILKQKHGIISCGVNNRYGHTHSEVLETLEENQIKTWRTDQQGMITYRWHPVCHPHGLVETMID

SEQ ID NO: 4601 - protein, 214 aa, Enterococcus faecium
  misc_feature (B) LOCATION 1...214
  hypothetical: YES
LHSHTFAKKEGKRMNKKLAQYKRLLALSQAGLYYGKDVFDKERFEEIRTISLELISEIGKETFEEIKALTTIGEGHPTPKVDVRAYIKKDGKVLLIEDKRTKEWSLPGGFAEIGLSPEENVRKEVYEETGLTVETTQLRAVFDTNKQKDIPQLFQYYKLVFACAIHGEEAKFIENNETSNMGFFSIEELPKLSEKRTTKKQLLILENKNQIYCD

SEQ ID NO: 4602 - protein, 93 aa, Enterococcus faecium
  misc_feature (B) LOCATION 1...93
  hypothetical: YES
TLSQLLCLLQQITMIVLRLLLIRHKLYKYFTDNKPDLNDYDISFAFFKMICSGYLLKATSRSIRQLDGSGTIDFYRVSSQGIVTETDSLGEPF

SEQ ID NO: 4603 - protein, 417 aa, Enterococcus faecium
  misc_feature (B) LOCATION 1...417
  hypothetical: YES
KGGHLLEKFLDMSLVQRIVVGILVGILFGIFFPTWTFISILGTLFVSCLKAIAPILVFFLTMASIAKHKIGNKTFVKPILILYLVGTLLSALVAVIVSSIFTVPITLQETVSEKAPQSLESVLSTMLTNVTQNPVQSLIDANYLGVLFWAVLLGLAFRARSESTKELVDQISIALSQVVQVIIAFAPIGILGLVYQSIATTGIAGLAEYLQLLLVLIGTMLFVALVVYPFLTFLFIKENPYPLIFFCLKESALPAFFTRSSAANIPINMMLAERLKLTKESYSISIPLGATINMGGAAITISLMTLTAVHSLGIEAPFVLKVLLCILSALAACGASGVAGGSLLLIPLACSLFGISNDVAMQIVGIGFIIGVIQDSMETALNSSSDLLFTAIGELGARKRSGEKIKLKDCLDGLSER

SEQ ID NO: 4604 - protein, 760 aa, Enterococcus faecium
  misc_feature (B) LOCATION 1...760
  hypothetical: YES
IGGHLMMNFKQLLLHVNARPFIDQARFGIEREGQRVDLAGNLAKTDHPAIFGDRSYHPYIQTDFSETQTEMITPVTDSIPELFQYLAAVYDVTARSIPKEEMIWPLSMPPALPEKDEEIIIAKLKNFEDVLYRRYLAKEYGKRKQMVSGIHFNFEFGDELLRTLFSHQEEFQDFSEFKTELYLKTARNFMRYRWMITYLFGASPMSEKNYFLDESHPQEPVRSIRNSALGYTNHPNVKVSYASMKQYLADIERMIEEGKLSEEKEFYTPLRFRGGKKVADLATTGVRYIELRNIDLNPYARLGINPEQVRFLQLFLMYMLWTEEKEDCDQWVAEGTTRNNKVALEQPSDQTEFHQEGREILEGMKQMLVELDWLDSLYLVEEALTQMDHPEQTLAAKLYQEAQLSSQQEVAVALGHQYYKESHERPYQLAGFREMELSTQIFMFDAIQKGVQVKVLDESDQFLRLQFQDHVEYVKNANMTSKDSYIVPLIMENKTVTKKVLKEAGFRVPGGAEFSSMEEAVKAYPRFAEQAFVIKPKSTNYGLGITIFKEGASLEDYQAGLAIAFREDSSVLVEEFMPGTEYRFFVIDGEVQAIMLRVPANVIGDSIRTVKELVEEKNSDPLRGTNHRAPLELIQLGELEQLMLKEQGLTIESVPQANQIVYLRENSNISTGGDSIDMTDEFSEAYKKIAVSAVEALGAKISGIDLIIPDKEIDPTTDKKAYGIIEANFNPAMHMHVYPFAGKGRRLTMNVLKLLYPEVF

SEQ ID NO: 4605 - protein, 219 aa, Enterococcus faecium
  misc_feature (B) LOCATION 1...219
  hypothetical: YES
SVGQKVHPIGMRVGIIRDWDAKWYAEKEYAEFLHEDLRIRKFISTKLADAAVSTVEIERATGRVNISIHTAKPGMVIGKGGSEVESLRKELNKLTGKRIHINIVEIKKPDLDAKLVGEGIARQLENRVAFRRAQKQAIQRSMRAGAQGIKTQVSGRLNGADIARSEGYSEGTVPLHTLRADIDYAWEEADTTYGKLGVKVWIYRGEILPTKKNTEKGGK

SEQ ID NO: 4606 - protein, 67 aa, Enterococcus faecium
  misc_feature (B) LOCATION 1...67
  hypothetical: YES
IFFQFAAGGGFILGGFLREGAFFFIQGGKSFSLNGNKGKYVPQYAFPENQVMVFDPGQGILPPLLIL

SEQ ID NO: 4607 - protein, 264 aa, Enterococcus faecium
  misc_feature (B) LOCATION 1...264
  hypothetical: YES
TVFQQDHNGYSHQDPGILTHLAEKKAEFIREYLPADANTLLAVMDKAFRSSEKINLIISSKHPRAQFYSAEEAAVLVNEGLKIIDWASTAKEEEPELVIAAAGTESNLEALAAVTLLLEEFPKLKIRFINVVDLLKLRHPSQDPRGLSDEEFDQYFTKDKPILFAFHGYETLVRTIFFDRHNHHLMIHGYKENGDITTPFDMRVVNELDRYHLAKDAALKIKGSQAEDFAKKMDQKLQEHQNYIRENGIDLPEVLDWKWKNLDQ

SEQ ID NO: 4608 - protein, 269 aa, Enterococcus faecium
  misc_feature (B) LOCATION 1...269
  hypothetical: YES
PKFHKRGDCMKPNPSEAGKRIKQLRLSCGFTMEELGRKIDNSPRATISNWERGTNLPNPQKLKLLSTITNSTIDWIKWGTLEEYITSYLIDIGYELYIKDFPEIPHKVFKDIQERYSNTFSLNKDYELLNPIIKNIFTKYYSKDFEDYRDIEVKPDPKKVGRKIRSIRKKLGLTMQEFGYEVSNSPRSTVSTWEHGGNLPNKAKLKKIADIANCSVEDLLFDEGFISEKSQVKLINELKEENSKLKEKIKYYECLFDGIESLLNSRKNS

SEQ ID NO: 4609 - protein, 263 aa, Enterococcus faecium
  misc_feature (B) LOCATION 1...263
  hypothetical: YES
TMFQMLLRVVGSIIFRYTLEEVNNVPKYEEIANILRERIRSKEYPLDSFLPNQVDLVKEFGASRMTIKKAINILAMEGLVYSQRGSGTKILNHPFMQKDTSPANEYEGLSLQMKRRHRSLKSQIIHFDVEFPNQYIQERLMIDAEQPVYNIHRLRILDGEPYVLEHTFMPVHLVPGLKKEHLLASIYDHLHQELNVHFAGAYRAISADKSDEYDQQYLNCAENDPVLEVQQVVYLKDGQPIEYSSSRNRFDVRNYSVLDVRST

SEQ ID NO: 4610 - protein, 352 aa, Enterococcus faecium
  misc_feature (B) LOCATION 1...352
  hypothetical: YES
SKLQLASKNSSLFLRSEKNQKNFCNYCFRCKKDCNRQRRLHQFIFCVKVFFIGISRRNMMDIHKFEVFLDLAETMNFTKTADRQFTTQGNISKQILSLETELDVKLFERAHRKIELTEAGSLLLPYVKNVVEQYHAMQEVLETYTKDNNLSLNILTIPTMINYKGFSKITEFLKRHPEFTVQLKEVESVELTYNDANEHSDTIHFARSFQAPPSSIEWLPTETDDFVAVLPKNHPLASKKKLDLSELKKENFLLLGPTTNLYQPVLDLCREAGFEPKISYKGARIDLIINMIANDMGIAIVMEKTVKNLLKENTVILPISPTTESYLAFTRKVGEHSLASDTFWEYLNQEEN

SEQ ID NO: 4611 - protein, 154 aa, Enterococcus faecium
  misc_feature (B) LOCATION 1...154
  hypothetical: YES
GVIQMKVIFLQDVKGKGKKGDIKEVPAGYAQNYLIKNNLAKEATKSSISQLAGQKKAQEKHEAEILEEAKKLKEFLEKEDTVVELKAKAGEDSRLFGSIPSKQIAEGLNKQYKIKLDKRKIELENPIRSLGYTNVPVKLHHEVTATIKVHVVQE

SEQ ID NO: 4612 - protein, 203 aa, Enterococcus faecium
  misc_feature (B) LOCATION 1...203
  hypothetical: YES
LAVQPFVLLFRIRWKTKMKMIVGLGNPGTKYQYTKHNIGFMVVDKIAREHQATFKKNPFEAEVAEFFHNGEKILLVKPQTFMNESGRAVGPLMTYFGIYPEELVVIYDDLDLAVGKIRLRQKGSAGGHNGIKSIISHLNTNVFDRIKVGIGRPEGKKTVVQHVLSPFSKENQPLIEESMCQSVKAVEYLIEGHSFVDAMNRFN

SEQ ID NO: 4613 - protein, 190 aa, Enterococcus faecium
  misc_feature (B) LOCATION 1...190
  hypothetical: YES
KKCLYDKDGELELSETAYHFLGGLLKHARAYTAVCNPTVNSYKRLVPGYEAPVYVAWSGRNRSPLVRVPESRGLSTRLELRSVDPSANPYLAMAVLLQAGLDGIRNQITPPAAVDRNIYVMDEEEREAAHIQDLPSTIHNAIKELRKDNVMIDALGQHIFSNFVEAKRLEWAAFRQTVSEWEREQYLELY

SEQ ID NO: 4614 - protein, 62 aa, Enterococcus faecium
  misc_feature (B) LOCATION 1...62
  hypothetical: YES
RLSHKCKKKTSANVPTIVRRKACFPKRNNEISNKGKLKSSEVTEGANPKRLCKSQALPVTSL

SEQ ID NO: 4615 - protein, 391 aa, Enterococcus faecium
  misc_feature (B) LOCATION 1...391
  hypothetical: YES
LLSQFLVQSRGYFQGKNDLRPYGTSLIIEQAVRVIVILAGTYYLRVLTDGTILEAVLISTVASFFGGLAAIIHMYIVGRRKDFFELKDFLISSRYFERENRSASVSIIRETLPFIFVGSVITIVQMIDQVTMKPLLHFFRPEIADQQLEFLFSRASVNPNKLTLILISMVGTVAISSLPILSTMKKKDRIQIEKTVGDSFSIALLILLPSLTGMSLLAGPLYTLFFGYDPESVGIYPNGFASFFVFLFIHDPIYDASIFESPSFCDPINCRSNYPESHLPSNRIRISWRIRDELIKWLSIRYCLCSRLSLYVQRIPNSTFSKDQQFFLKNFPLHPDYACSMFCRFLFAESAIVNGIKKLCNDLLCGCRKYWRLSIFIFSIRKKWVSNVEKC

SEQ ID NO: 4616 - protein, 496 aa, Enterococcus faecium
  misc_feature (B) LOCATION 1...496
  hypothetical: YES
LTSQPEIIDWRSIMTKNLSIKQIFAQANKAMLLFAVIPLLLSILLYSQQLLIYQQTIANIQKADAIALKVDQKVLESMWDLISGQVTVDEFNEENILEELRNDIREIKNNTNTLKEISTLDVSLRTIDTLEDYQNELINNILAKDFMDTNEEIINQVDSVTQLLSDILQDFVRVEIDLASKKNTTLVRSLILLTIVELGVLSTIFFYAKKNRRFLERKVQEPINQLIEMSEQLSSGNLGFRLTLPETLELQTLTASMNKMAEDLNQSLRENALKQYHLAQSEVRVLQAQITPHFIYNSLDAIISLIEQDCFEEALTMTHALSGFFRTSLSKGQDWIPLEKEISHINDYLVILKIRYGHMLDYKIDIPETLFPVSILKMILQPLIENAVYHGTKYVRHKGFIRITTCKIDEMIQFKVIDNGIGIPAEKLAEIRKELAKGIDSDFSIGYGLYNVNKRLLLYYGNDQKPITIDSKYREGTTVTLMIPLSPKTIGGNKHV

SEQ ID NO: 4617 - protein, 179 aa, Enterococcus faecium
  misc_feature (B) LOCATION 1...179
  hypothetical: YES
RPPQLWSLQVSLIPKIFLEEVITVRFSNPNILNMPQRIATDTSQKVAIRYGETIKKYMEIEVKDPQTLVFIPLTLAAWLRYLIGIDDQGKPFIPSPDPLLTDFQHKLSDIQLGTQDTSHIHEKMAPILSNKEIFGVDLYQAELGRKIEEMFIKMVAGPNAVRKTLQDYLQEHGGNLSWK

SEQ ID NO: 4618 - protein, 90 aa, Enterococcus faecium
  misc_feature (B) LOCATION 1...90
  hypothetical: YES
PAPHQRFWIIFFRVCLAKSRKCKISFGSLFVKTTSAESIAISVPAPIAIPIEARAKLGASLIPSPTMITFFPWSRYFWTTASLSSGNKPP

SEQ ID NO: 4619 - protein, 343 aa, Enterococcus faecium
  misc_feature (B) LOCATION 1...343
  hypothetical: YES
PPPQPLCEYVKLVVLHSGRNGNGKAIIVKNGKKETIVRFEQYNHMPLVMRLKKQRYTCKNCRTHWTAQSYFVQPRHSIANHVRYKIASLLTEKVSLSFIAKSCQVSLTTVIRTLKEFKSYLPKQSKKILPRVLMVDEFRSHASIEDKMSFICADGETGKLIDVLPTRKLPRLTSYFLGCTNPEEVEFLVTDMNAAYFQLTKRVLPNAKVVIDRFHIVKHMNQAFNELRIREMNELRKAGQKSQAEKLKKNWRFLLKNRANINHYEYKTWKSFRAPKYPFLTEAMMIDRLLEFSPPLKEAYPFFHELVEAFRDKDPDLFFSLLAELPETLDDSFREKLQKPSDL

SEQ ID NO: 4620 - protein, 108 aa, Enterococcus faecium
  misc_feature (B) LOCATION 1...108
  hypothetical: YES
EECLYMIRNPYLPLTETTFYILLVLTTPAHGYAIIQEIDKLSEGSVKVAAGTMYGAIENLLKLNWIEEIPSREKRRRVYKITDLGEEVLRLEIERLGSLIKLSSDFGY

SEQ ID NO: 4621 - protein, 158 aa, Enterococcus faecium
  misc_feature (B) LOCATION 1...158
  hypothetical: YES
GIAQYGYSRGHFVQDGKLIKVLDASHHKPGKGNTVMRMKLKDVRSGATYDTTFRPDSVGEKAHIDTKPVQYLYTMDDTAFFMDLETYEQYEIPVETVEEEMKYILENMEVKIQFFGSEVIGVQLPTTVVLRVVETQPSIKGATVTGSGKPATNGNWPK

SEQ ID NO: 4622 - protein, 66 aa, Enterococcus faecium
  misc_feature (B) LOCATION 1...66
  hypothetical: YES
QRAHFWHKYKTNPCTAKDTGVIYTFLTGIEPATYRLGGDCSILLSYRNNFNKSIVACLFFTCKLIC

SEQ ID NO: 4623 - protein, 441 aa, Enterococcus faecium
  misc_feature (B) LOCATION 1...441
  hypothetical: YES
FGYQFIGGFKMSHTQLIKDTLNILDLNIYFEENCLTKEKYKGQICLIYKGTLLYKPEECSHCLCVVPSRIIRWGTTTVRLLLNDVSEYRTYLELKKQRFKCKSCQRTFVADTSVAEKHCFISQKVRWSVIARLKENTSMTEIARQKNISTSSVYRVMKRFYRPLNPFKQTLPKVLCFDEFKSVRSVASAMSFIMMDGQSHALLDIVENRRLPYLERYFSRFSLATREAVQLIVIDMYAPYVSLVKKLFPNAQLIIDRFHIVQHIGRTFLNHRVKETTVRLKGNSHSQRGLGKKLKRYWKLLQKEEAKLNYEKRVWRASFKDYLTESEIADRLLAACPNLRQGYQLYQDILYAVKKRDQSLFEDCLTRDISGLPETYTTTLRTFKKFLPQIQNALHYSYSNGPLECLNNHIKVLKRNAYGFRNFYNFKLRIMIRHGKTFLTK

SEQ ID NO: 4624 - protein, 147 aa, Enterococcus faecium
  misc_feature (B) LOCATION 1...147
  hypothetical: YES
FGYQFIGGFKMSHTQLIKDTLNILDLNIYFEENCLTKEKYKGQICLIYKGTLLYKPEECSHCLCVVPSRIIRWGTTTVRLLLNDVSEYRTYLELKKQRFKCKSCQRTFVADTSVAEKHCFISQKVRWSVIARLKENTCHDGNRSSEK

SEQ ID NO: 4625 - protein, 441 aa, Enterococcus faecium; identical to SEQ ID NO: 4623
  misc_feature (B) LOCATION 1...441
  hypothetical: YES

SEQ ID NO: 4626 - protein, 307 aa, Enterococcus faecium
  misc_feature (B) LOCATION 1...307
  hypothetical: YES
FGYQFIGGFKMSHTQLIKDTLNILDLNIYFEENCLTKEKYKGQICLIYKGTLLYKPEECSHCLCVVPSRIIRWGTTTVRLLLNDVSEYRTYLELKKQRFKCKSCQRTFVADTSVAEKHCFISQKVRWSVIARLKENTSMTEIARQKNISTSSVYRVMKRFYRPLNPFKQTLPKVLCFDEFKSVRSVASAMSFIMMDGQSHALLDIVENRRLPYLERYFSRFSLATREAVQLIVIDMYAPYVSLVKKLFPNAQLIIDRFHIVQHIGRTFLNHRVKETTVRLKHYFNWHTSFKIFFFLKRFKFCHFGID

SEQ ID NO: 4627 - protein, 393 aa, Enterococcus faecium
  misc_feature (B) LOCATION 1...393
  hypothetical: YES
FGYQFIGGFKMSHTQLIKDTLNILDLNIYFEENCLTKEKYKGQICLIYKGTLLYKPEECSHCLCVVPSRIIRWGTTTVRLLLNDVSEYRTYLELKKQRFKCKSCQRTFVADTSVAEKHCFISQKVRWSVIARLKENTSMTEIARQKNISTSSVYRVMKRFYRPLNPFKQTLPKVLCFDEFKSVRSVASAMSFIMMDGQSHALLDIVENRRLPYLERYFSRFSLATREAVQLIVIDMYAPYVSLVKKLFPNAQLIIDRFHIVQHIGRTFLNHRVKETTVRLKGNSHSQRGLGKKLKRYWKLLQKEEAKLNYEKRVWRASFKDYLTESEIADRLLAACPNLRQGYQLYQDILYAVKKRDQSLFEDCLTRDISGLPETYTTTLRTFKKFLPSSPRG

SEQ ID NO: 4628 - protein, 62 aa, Enterococcus faecium
  misc_feature (B) LOCATION 1...62
  hypothetical: YES
CFHQIFLLGCGVMKQIHLQKKIHREFTKIMNNYVNLPKFFSKIKGSSWCYRLFKVGKKITSF

SEQ ID NO: 4629 - protein, 471 aa, Enterococcus faecium
  misc_feature (B) LOCATION 1...471
  hypothetical: YES
RTNQTRDDAGLGASKADYPDSKTITAKVSEEDKAQHTNKIDQTYVDYVTDIDPNLSNNIGFTRTTGINLLRDVNGKVQPVSFSNQNPDTESLSLSSTMSAMTGVGVSSFPTQLDTSKENFLKDNYSLLAGSYPASATDVVLIVDGNNNTNINALKNLGFDVKEDEKLDFDDIVGTTFKLVNNNTYYTKLPTGNFIPNTDYDAMYQNASDELKISGILRVKSSSTMNLLSPGIAYSDQLTTQIVNENKESEIVKAQRDSGVNVLTTEKVDENAKQTLLSYLGGDSFPSSIMIYPNNFEDKEKILDYLDDYNKGKSDEDKIIYTDLAGTMTELTGGLMDAITYVLIAFAGISLVTSMIMISIITYTSVIERTKEIGVLKALGARKKDITRVFDAETCILGISSGILGVFIAWLATFPINSILYNMTDLKNVAQLNPVHAIILVIVSTILTMLGGHLPARMAAKKDAAIALRAE

SEQ ID NO: 4630 - protein, 61 aa, Enterococcus faecium
  misc_feature (B) LOCATION 1...61
  hypothetical: YES
GGNQEEKLNDYLYLIPWYINHFLYRLIMTWIKIKRHYVLIVGFRVTEWHSSPTYRGWATSA

SEQ ID NO: 4631 - protein, 850 aa, Enterococcus faecium
  misc_feature (B) LOCATION 1...850
  hypothetical: YES
GENHKGVSNMKIETRQQLLAVLSNNETGLTTAEVAQQIDLSRSATSLYLNELLQEGTVKQTGTKPVYWLPASAASETTDDVFKAFIGSQGSAREAIKKCIAAVMYPPLGLPLLIHGPSGVGKSFLAKLIYDYLKQNNAKGAEKFFVFNCADYANNPELLSSILFGHTKGAFTGAEGERKGLLAQADQGVLFLDEVHRLSKENQEKLFQFMDSGNFRPIGEDEKLQHSQVRLLFATTETPEEVLLPTFYRRISVIIDLPSFHERPIYERFELIKYLFLQEAKRIKRDLAISQELLDYLSERAYPGNVGSLANEIRMYCAGALQKNPTAETIALILGNERPSLELHFDQINEAFAPDDLQTQQVQLQQLLASDQTLLQIQEELASLHHHLRHEAGSVCTTALGERVTASIQEQNRRVLGDLPLTEEATATVSCFLDFTKNQLPMTLWENLQYRLLKEQPRTYHLAQLLTKELPLELIPAAKCLLAILLIGSVNEEIRYHALLVAHGERTASSIQGVANKMCGEYLFDAINMPLTSSVHDIVAQVKNWLSERETGDGVIMLVDMGSLTQLYKSLKPQIMGELLVINNLTTSFALEIGQQLLNGSRFHTIAKAAEENFVTNVQYFEGFSVEKNIIISSISGRDVSKKLRGICQQYVKPDIKLIILNYNELSAAIDRAADETEYLKETSLILTTSYLDTDVAVPTLNLLDVLDDNAEQQLEQSFHHLIHPNNVKPMLNEFIHFFSKEGLSEKLEFLNPDVIIRQVEDTTDKCERRFGLQLNAKMKFNLTMHLALMVERTILGGADYPLPEELSSLKLNDKPFEANIKTILYNLEQFYRITISDWELYVLYEILGG

SEQ ID NO: 4632 - protein, 609 aa, Enterococcus faecium
  misc_feature (B) LOCATION 1...609
  hypothetical: YES
TMNQRFEYNFEDVEPKLLKKGKGLKKKNKYTLKQAEALVGWIQHNWSDKTTITLICSDTEEGTKYAFDGIEITPFSIGGQEKLLFPDIEGQILQAPDSMISDPNKLILDINDQYKHEPDVAEPTKESKSKLNLKLPSVVLPFAKKKNKLMNELIEPEETDIYEEELEEQEEIEELVVSSEETEEVEEIETVSENEEETEEIFDFEDEEEVENVQKGDLSTSSQNGLEAVNDPQVPPYISSQTPNYSPQYQAPNVLQPLRKHETVQLVTLKEYCDLGEEIETSISQMVEKLKPESLFKFIGIPSTGLTNTRIDEYRSNHAMLRLAEVKFENLREHYSRQIISFKAEALDRLRTAVDIAWKKPYDLDVKKNKAEELSKMEAEAEAKLNEFVKRQENNVNDKIKKFEIEQEIDLKNFIARQEADKAVFIATEKDRTQNLIDSKAESINADLLETKDKFIDEEMYKMKIEMNKNLFDGKQKIKSELATELAKANDNVWENALKFIQEIQDEIEAKTPIWAAEIKEFNSLEEQEHERMKQTKELQLKEESIEIKRLEAEMNLKRMEELDHENKMLKIKLETALSKNELLAMEQDTKQVVNGSNRVGALNLFSKR

SEQ ID NO: 4633 - protein, 376 aa, Enterococcus faecium
  misc_feature (B) LOCATION 1...376
  hypothetical: YES
HVDHGKTTLTAAITTVLSKKNGGQAMAYDQIDGAPEERERGITISTAHVEYETDTRHYAHVDCPGHADYVKNMITGAAQMDGAILVVSAADGPMPQTREHILLSRQVGVPYIVVFLNKVDMVDDEELLELVEMEVRDLLTEYEFPGDDVPVVAGSALKALEGDASYEEKILELMAAVDEYIPTPERDNDKPFMMPVEDVFSITGRGTVATGRVERGQVRVGDEVEVVGIAEETSKTTVTGVEMFRKLLDYAEAGDNIGALLRGVAREDIQRGQVLAKPGTITPHTKFSAEVYVLTKEEGGRHTPFFTNYRPQFYFRTTDVTGVVELPEGTEMVMPGDNVTMEVELIHPIAIENGTKFSIREGGRTVGAGVVTEIKA

SEQ ID NO: 4634 - protein, 137 aa, Enterococcus faecium
  misc_feature (B) LOCATION 1...137
  hypothetical: YES
DLDQFRELDRAQIGRVAHVVALVKKVERSWNGFKDAQTHWVVLNGSRLPRFNFLERVSRINCGCPHQLDFKSGDQQLSTLVKGLFDFVFRNLSPIHLSKLSLVIVQNLLEFFSKESGFPGVLSERLSILIRSVETCQ

SEQ ID NO: 4635 - protein, 89 aa, Enterococcus faecium
  misc_feature (B) LOCATION 1...89
  hypothetical: YES
NFCHLKRKVTDRNKNLLNVVMICYISFLILGLPQAVFPEMFSGDWGIVSYSILTLIAMVLGTSFYNAFVSKHVEEYEVLMYLKEKKTSN

SEQ ID NO: 4636 - protein, 239 aa, Enterococcus faecium
  misc_feature (B) LOCATION 1...239
  hypothetical: YES
KTSQALAYASALKQSTKKDGYFEIKDPLFTDETFITFDFGHLVELAEPGHYDEKWQNWKLESLPIFPDRYDFEVAKDKGKQFKIVAELLKKANTIIVATDSDREGENIAWSIIHKANAFSKDKTFKRLWINSLEKDVIRSGFQNLQPGMNYYPFYQEAQTRQIADWLIGMNASPLYTLNLQQKGVQGTFSLGRVQTPTLYLIFQRQEASIKVKQGPFKGVLSHTQRFKTQEELFCFCFF

SEQ ID NO: 4637 - protein, 282 aa, Enterococcus faecium
  misc_feature (B) LOCATION 1...282
  hypothetical: YES
LVSHHILLRGKSKMTKSNYKLTKEDFKQINRRSLFTFQLGWNYERMQGSGYLYTILPQLRKIHGDNTPELKEMMKTHTQFFNTSNFFNTIITGIDLAMEEKEGIASKETVSGLKAGLMGSFAAIGDSVFAALIPTIFGALAANMATDGNPIGVFIWIFAQIVVMVFRWKQLEFAYKEGISLVTTMQSRLTALTDAATLLGVFMVGALVATMINVKFSWAPTIGDVTLNMQNYIDMILPKILPAGIVGGVYWLLGKKNMTPTRAIFIVLIVCVALSALGVISK

SEQ ID NO: 4638 - protein, 528 aa, Enterococcus faecium
  misc_feature (B) LOCATION 1...528
  hypothetical: YES
TRSHALCECADIRTGNDRKKRQNRCRCRCVERCSRRRYSGRSTSKSRSNQRRKSEEIRMIKIYNTLTRKKEEFIPIQKGHVGMYVCGPTVYNYIHIGNARSTIAFDTIRRYFEYRGYKVDFVSNFTDVDDKIIRTANELGITAPEVADRFIRAFEEDTKALNVEPATLHPRVMDHMPDILAFIQVLVEKGYAYESSGDVYYRTRKFENYGKLSDQSIDELEVGASQRTGEEQQQKEDPLDFALWKQAKPGEISWDSPWGKGRPGWHIECSVMATKHLGETIDIHGGGQDLEFPHHENEIAQSEAKTGKKFANYWMHNGYVTIGEDDEKMSKSLGNFITVHEMIKNVDPQVLRFFMATTQYRRPIRYSETTMKEAATNLQRLKNTFDNLKFRQETASENLADDADKIALLENLEQRFIEEMDDDFNAANGITVVYELAKWLNTYLDQPKVSAAVLAQGEALFSQWLSIFGILFTAEELLDEEIEQLIEERNQARSNRDFVRSDEIRDLLKEKGILLEDTPQGTRWRREA

SEQ ID NO: 4639 - protein, 67 aa, Enterococcus faecium
  misc_feature (B) LOCATION 1...67
  hypothetical: YES
LKGHPAPDPGRKTQQPGQAAACGIGQQGKAGRQASQDRPADHPLPGNVPGRYLYRGRPLFHQANPVL

SEQ ID NO: 4640 - protein, 65 aa, Enterococcus faecium
  misc_feature (B) LOCATION 1...65
  hypothetical: YES
RGSLTLTVSSCRRSSHPRRLIVKDNRNSIRKEVLHLIKFVKKTVAIPKFEKCYFEVEGYYISTVD

SEQ ID NO: 4641 - protein, 61 aa, Enterococcus faecium
  misc_feature (B) LOCATION 1...61
  hypothetical: YES
RGSLTLTVSSCRRSSHPRRLIVKDNRNSIRKEVLHLIKFVKKTVAIPMRKSMECAASGIEA

SEQ ID NO: 4642 - protein, 61 aa, Enterococcus faecium; identical to SEQ ID NO: 4641
  misc_feature (B) LOCATION 1...61
  hypothetical: YES

SEQ ID NO: 4643 - protein, 61 aa, Enterococcus faecium
  misc_feature (B) LOCATION 1...61
  hypothetical: YES
QKLQAIDGLTVYGPQDPNFRTGVVAFNLDGLHPHDVATALDMEGVAVRGRSSLCATAIEVP

SEQ ID NO: 4644 - protein, 287 aa, Enterococcus faecium
  misc_feature (B) LOCATION 1...287
  hypothetical: YES
RELQFIPNMYVEKLYEMILIVKYRVEVLFMVTRIFILDDSLVFEKMLVEILEESRILLSPWKFEIVQGLNVIQFVEFIKNNEIYSSDIFFLDIDLNAYYSGIELGEMLREKNEKCKIVYLTSHPNKAITVINRKITPSGYLIKEFTYEKNKKSIQSYLLKEKENYPVQHATKKRWTTVRYGNSDHYIHYDEILYLMSMPGYKNKIGLVLKDEEILVNGTIKKYKKSLEYEYLCKDLKAYIINTENITSISRVNEIVTFANGEQLEMGKRSIDKLKNFMQEKIENESF

SEQ ID NO: 4645 - protein, 175 aa, Enterococcus faecium
  misc_feature (B) LOCATION 1...175
  hypothetical: YES
NFLQIHFCQNEFLHYQIVLVVIGKILLILFAVVSKKFLFVLPFLALPFLKILYGLVLSLSKKLFHLYYLKLLKIRYLKSYYFHLTKLLKTRHLKSYYFHLMKLLKTRHLKSYYFHLMKLLKTRHLKSYYFHLMKLSKVHYSLLLHRNYSFQSSRFFLLQFCMLNFRLPTHGKVLL

SEQ ID NO: 4646 - protein, 200 aa, Enterococcus faecium
  misc_feature (B) LOCATION 1...200
  hypothetical: YES
NTLHTSLQISKRSNWKENLMLEKDIERILISQEEIQVRCKELGKELTEIYQNTNPLVVGVLKGAVPFMADIVRSIDTYLELDFMDVSSYGNATVSSGEVKIVKDLDTNVEGRDLLIVEDIIDSGRTRAYLVDLFKYRKAKSVKIVTLLDKREGRVVNIEADYVGFNVPNEFVVGYGLDYAEAYRNLPYIGVLKRSVYQSN

SEQ ID NO: 4647 - protein, 145 aa, Enterococcus faecium
  misc_feature (B) LOCATION 1...145
  hypothetical: YES
KRLHKVIYVAFFLDGSDVMLRDMPKMILLMFVGFFLILVIAYYSLNGYTQDSSVKGMQETLRTTAIANRDDSIRVEKGRFALIKSDFEKDFKEKFGKSKNLNNETADYKFDYLTDGKDGIKAIKVKVESGSKEYQATCILNVAND

SEQ ID NO: 4648 - protein, 109 aa, Enterococcus faecium
  misc_feature (B) LOCATION 1...109
  hypothetical: YES
QLIQNVILLVHYRKILELYFSGISQRTISLTVGSSRHTIREVTSRADRKGVTELTADMSDTWLQEYLFPEKQTTARGYLPVDWEYVHKELMKKNMTLKLLHREYGVHGT

SEQ ID NO: 4649 - protein, 131 aa, Enterococcus faecium
  misc_feature (B) LOCATION 1...131
  hypothetical: YES
GLIHITSIIKGRIKMKQTTNLTEVQDILQQSSVAVIYLSMPNCSVCHAVRPRLEELLTHYDIPALHLDAFETPEVASKFEVLTAPVVLIFHQGKEVFRQARFIDFKKIRYLLDELTAEDDSLSYEEIFRTK

SEQ ID NO: 4650 - protein, 64 aa, Enterococcus faecium
  misc_feature (B) LOCATION 1...64
  hypothetical: YES
QGVHDTDCVVLSGPSPAGIHGPRPPEDGPHHFFIFRAHIFSHLTHAKKSSSSSSFVIGAPLLPE

SEQ ID NO: 4651 - protein, 251 aa, Enterococcus faecium
  misc_feature (B) LOCATION 1...251
  hypothetical: YES
YQVHSRYHPHLIELDFSSPYYVVVGQLSDNQQLCQERINPLLELLERVFSYYGQALLTVHRQQIIILVNRISRASLLSLLDKIQTKFNKMYQLQLNFGIGSLCYTEQETPQSFLHAKQVCEWIAFHQSVNEIRFFEDLDLGIVLPAIPSDQRTLYVKRILKSLTEEEVHLFKKTLACFSKNNGSIKNCSEELFIHKNTLQYRLNKFHSLTGYTPRNYDDYHILKLAFLLGTNMTTTKKPGEHMIVRLVFNY

SEQ ID NO: 4652 - protein, 123 aa, Enterococcus faecium
  misc_feature (B) LOCATION 1...123
  hypothetical: YES
ELSQLLGKEVTKDIEELKDVLKESLFSGIEWIVVSLGRNGAFAKHGDVFYKVDIPDIPVVNPVGSGDSTVAGIASALNSKKSDADLLKHAMTLGMLNAQETMTGHVNMTNYETLNSQIGVKEV

SEQ ID NO: 4653 - protein, 317 aa, Enterococcus faecium
  misc_feature (B) LOCATION 1...317
  hypothetical: YES
VKSQDYFIKREKAWQEQQIKDDKKRMNEIKKRLQYAQDAIQKEIDAQWDSFSNGQKITRSEAMKRADEMDVKAFARKAKKYVKEKDFSPTANKELKLYNLTMRVNRLELLKANIGLELIATFNDMDKYFSGELTSAGLKELQRQAGILEMTIAKSGYAKLVEQVINSSFRADGFATFSERLWMYQAELKADLDKLLVRSVTMGRNPKQLAPELSKFLTEEGRENTKFNTQRLMVTETTRVQTGIQEQSYRDADIDQFVFISEPTACRYCLPLNGKVFDLKDMSPGVNCAPMHPFCRCSTAPYVDREAFEKSLKERGL

SEQ ID NO: 4654 - protein, 63 aa, Enterococcus faecium
  misc_feature (B) LOCATION 1...63
  hypothetical: YES
FRSHGLVKKKEAALTNVDLMVERLVLADNTYMNLNDQQINGLGVAQIEQLMFPYRKLHELAAW

SEQ ID NO: 4655 - protein, 240 aa, Enterococcus faecium
  misc_feature (B) LOCATION 1...240
  hypothetical: YES
MIPQFFRVNQSNAHSDHVCYATREEVETTSSFKQSLNGSWRFCYSPNPSVRPKTFYKKDFDACSFDEITVPSHIELANYDKIHYINTMYPWEGHVFRRPPFTTSPEKEAEGIFSAAKDNPVGSYLTTFRLEEGLKGKQISIHFAGVEQAMFIWLNGHFIGYAEDSFTPSEFDLTPYLEEENILAVEVYKRSTAAFLEDQDFFRFFGIFRDVFLVRSSDNTHLEDLWIKPRLDDKCQNGTT

SEQ ID NO: 4656 - protein, 272 aa, Enterococcus faecium
  misc_feature (B) LOCATION 1...272
  hypothetical: YES
YNTQTTRNRKSKSQNSFRTGKNACQQTKTAAIKEPATDSKRNRIRSIKSSWLLYTYKLMLYYIYKFIRIQRREKMTKAMVYKLLEEFNGTLALKDAKKAGISPVTIKRMVDRGELDREYPGFFTLPGQFPDELFMAQKKYERGIISHITALDLYDLTDMIPRQIDLTVPYGYHVSEKGLKEFAVELHYTKAEWYELGKIEIKSRYGNPIIAYDPERTLCDIWNPWYTVEDEIKVKAIKNYMESDRKNLRKLNEYRRILPTDKTMRSYIMALN

SEQ ID NO: 4657 - protein, 263 aa, Enterococcus faecium
  misc_feature (B) LOCATION 1...263
  hypothetical: YES
KRTHFSHVICVLFLFFMCYSFSNSKAKGDVMKRTRVLYLEVADKIKEDIFSGKYPVGSMLPTESELEELFQVSKITVRKAIELLASDEYVAKKSGRGTTVLSNRPYNRLSKAASFTQILENSRYEVRKETLDLQLVHIKKEDPLFSFFGEQAVCFKRLYYLNNQPYIYFVHYLPQEMMQFSREEFGKESLYRLLTKKGYTIDSFSDDFSAVFLTEEEQGILKTDAQIGIKRIRKSSTQIGEMIEYSEAVYHTELHPYHIDYET

SEQ ID NO: 4658 - protein, 281 aa, Enterococcus faecium
  misc_feature (B) LOCATION 1...281
  hypothetical: YES
RRTHKLRLKHFLITGIGLMLTGGLLAGATYTLGAQKSLTWDNGPRLIDMVTETKKIKDANKIVIHAENQTVSVIRGLDFEIKTTYDKTEKPEIKEKNGVLTVNAVKKSTGAIISLEDTSAQITIVVPADHELSELTIEGNNSAIDINEVSIKKVNTKTHDGWVSFNEFTGGTITAKDELGSLRLDEANVDNLIVTGENSNFHLEDSLISKEGKVILNGGNLSLHEMENSGYTIQTSGESYIEKDYQPITNTLLEQGQKKLKITAKDTSINITTDQEDNETD

SEQ ID NO: 4659 - protein, 127 aa, Enterococcus faecium
  misc_feature (B) LOCATION 1...127
  hypothetical: YES
PTAHWTYRCGICRMITNSFPCRRWTLREINQKSCRSRTPTIRRRITSRSPPPARHSPRRPPRRLHPPRLRQRHRPPAQPHPRLHRPPIRQQRLPQNRLPARAAQSPPLRQAQPRTKKRTPRPAIRSL

SEQ ID NO: 4660 - protein, 648 aa, Enterococcus faecium
  misc_feature (B) LOCATION 1...648
  hypothetical: YES
QGGLITMTNQKKAFAATIGCLLFMIFGFIFDRFSLTITPLFYISAIIIGGYKQTSEGLKELWNDRTLNVDLLMALAAIGACLIGNYFEGAMLTFIFCLSGALEEYTTNKSQKEITALMNLQPQKAQLLKENGQMQEVDVSQLKVDNLVFVAKGAAVPIDGFLESTQATIDESALSGESVPVEKYLGDEMYAGTLNQGNPITIRVTKTSSETVFAKIIQLVEEAQNTPTQTASFIERIENNYVKLILLAVPLMILLPHFFLGWSWDESFYRGMVLLVVASPCALVASATPASLAALSNSAKNGILIKGGIHLEKLSELKAIAFDKTGTLTKGKPVVTDSFFFDEKDLAQQLLVAMEQKTTHPLAHAILQYFDCTIPEEIQYLPIEEITGFGLQTTYLGAQWKVGKHAYDPETMIISKEIAEMIERLENQGKTVIYLSKDQQLIAVLGLLDIPKANTQQVISYFKSQNIHTSMITGDHSGTAKAIAEQVGIEHYYASCTPEEKTQLVKKENELYQVNAMVGDGVNDAPALAAASLGVAMGQGTDAAMDIADIVLMKSDLNKFVYSHRLSLKMRRIIKQNIIFSILVILLLIASNFLQFLNLPLGVVGHEGSTILVILNGLRLLRPLPDLSDSSKKCKSCPLYKARLSSVK

SEQ ID NO: 4661 - protein, 285 aa, Enterococcus faecium
  misc_feature (B) LOCATION 1...285
  hypothetical: YES
TLGLGQYWKFRRFIMKRKHLFHSFVFLMTGLVTLAFGHVAQADNTTTAESSTSETMQKIEPKKDVYVIASDSAFAPFEFQNAKGEYEGIDVKLMENIAKLQGFNIRMDYRGFSAALQALESGQADGMIAGMTVTDERKKSYDFSDSYFDSGIQLAVKKGDTSIKSYEDLKGKTVGAKVGTESAEFLSDHESEYGYSIKYFDAADQLYDGLKVGAIDAMMDDYPVIGYAIKQGQELETPIKKESGGKYAFAVKKGQNPELLNMFREYKIFCVNEKIHTKKEVPSVE

SEQ ID NO: 4662 - protein, 322 aa, Enterococcus faecium
  misc_feature (B) LOCATION 1...322
  hypothetical: YES
SDQQEIWKEFFMMIIEIDKLVKRYGDFVALNHFDLQVQEGEVLGLLGPNGSGKSTAINCMLSLLNYDKGTIKLFGTTMTPENYAVKAMIGVVPQDVAVFDELSVQENIDYFCGLYVSEKEKRKALIEEVIQLVGLEKYVSFRPGELSGGLKRRLNIACGIAHKPRLIFLDEPTVAVDPQSRNKILESIKELNRQGATIVYTTHYMEEVEILCDQIVIMDQGQVIAKGTKESLKDMVRTADRLTIDIPLLPENVLSAIQRTIASDGIAYKKGQLQVTTTELNTVLLPILTILQEEKISYGKIATKEASLNDVFLEITGKDLRD

SEQ ID NO: 4663 - protein, 127 aa, Enterococcus faecium
  misc_feature (B) LOCATION 1...127
  hypothetical: YES
NSQHILTNKVKYFFLNERNIDMITFERIKELAKKQGKSLNKVEEDLGYGKNVLYRLKNSNPSTERLQEIADYFDVSVDYLLGREEKEAPKHVDLSEDDTVFSFDGKEISKETMRKAIAIAKALEENE

SEQ ID NO: 4664 - protein, 164 aa, Enterococcus faecium
  misc_feature (B) LOCATION 1...164
  hypothetical: YES
NNQQSKNFLKTKRKRMNKELSRHEIREMALQALFPLDFNADLTKEDAIFNAIELDHRDMINEDESEFVPVYLDTLVGGVCAKKDELDKVIEKHLKNNWHINRISKMDLVILRIAIFEMTYVTDVPAAVALNEAIELAKTFSDDRSRKFVNGVLSNVLKELEAGA

SEQ ID NO: 4665 - protein, 243 aa, Enterococcus faecium
  misc_feature (B) LOCATION 1...243
  hypothetical: YES
PKQHFTQPPARFSEATLIRALEENGVGRPSTYAPTLDTIQRRYYVKLTQKRFEPTELGEIVNSLICEFFPQIVDIHFTAEMEGDLDKIEEGTEAWVKVVDRFYKPFEKELTNAEEKIEKIQIKDEPAGFDCDVCGHPMVIKLGKYGKFYACSNFPDCRNTKPIVKEIGVTCPVCHEGQVIERKSKKNRLFYGCSRFPECEFTSWDKPVGRNCPKCDGYLVEKKVKGGKQVVCVNGDYEEDIQK

SEQ ID NO: 4666 - protein, 119 aa, Enterococcus faecium
  misc_feature (B) LOCATION 1...119
  hypothetical: YES
RMQQANLSNIRLYLRCVYASPKLAEVGVTKSHASSSDQVVEMDLTSWFTYHRVNEPVAKAELTFDQQNYLIGAAVISEQADELIDDLTLVINQKLTKKELDSYIMGYRTLASDLSYLLK

SEQ ID NO: 4667 - protein, 260 aa, Enterococcus faecium
  misc_feature (B) LOCATION 1...260
  hypothetical: YES
KKGLHMNKKRRLEKILDMLKIDGTITIKEIIDELDISDMTARRDLDALEADGLLTRTHGGAQLLSSKKPLEKTHIEKKSLNTKEKIDIAKKACSLIKDGDTIFIGPGTTLEQLALELKGRKGYKIRVITNSLPVFLILNDSETIDLLLLGGEYREITGAFVGSMASTNLKAIRFAKAFVSANAVTHNSIATYSDKEGVIQQLALNNAVEKFLLVDSTKFDRYDFFNFYNLDQLDTIITDNQISPQHLEEFSQYTTILKAD

SEQ ID NO: 4668 - protein, 63 aa, Enterococcus faecium
  misc_feature (B) LOCATION 1...63
  hypothetical: YES
SAKQNGTYIDQNSSWHQKTPLFFYEAKKIRKISVIIAFAARKIVTDREDYTNSFFVLKYSLLE

SEQ ID NO: 4669 - protein, 116 aa, Enterococcus faecium
  misc_feature (B) LOCATION 1...116
  hypothetical: YES
NNKHMKAARIGICGESWNPMISTPRSANNTINTAILSFKEIFLFIVDLLFQMKRPCHEKTIHLAGPPTKSATKRRLKDLFFYFSSKLFSTSIPQRLFLEVIDDQWNNEHDHCDSCY

SEQ ID NO: 4670 - protein, 86 aa, Enterococcus faecium
  misc_feature (B) LOCATION 1...86
  hypothetical: YES
QIKQFSARIFSFFCLKNIKIFYIKTVQKSLAQSSIKITLLSFLKSFFQIKRKRYSKSIFHDPYGIRTRVTAVKGRCLNRLTNGPIK

SEQ ID NO: 4671 - protein, 300 aa, Enterococcus faecium
  misc_feature (B) LOCATION 1...300
  hypothetical: YES
SSKQRSEFATPHMNQVKTYIPTFDFSYFTTVSMLVFAVGGAEKISPYVNSTRNPAKEFPKGMIFLAAMVGICAVLGSVAMGMLFASDNIPKDLMANGAYSAFQILGNYYGIGNSLMIIYALTNMIGQISALAFSIDAPLKILLADADPEFVPNWLRKRSHKGTLVNGYLLTGILVGIIILLPIFGIKDMNELLKWLTNLNSVVMPMRYLWVFLAYMMLNKAYKKFNSEYKFVKNPKIGFIFRAWCFAFTGFACILGMVPKINYTADPKAWWSQLFTNITTPIVLDLIKHDLAGHRSSRTK

SEQ ID NO: 4672 - protein, 400 aa, Enterococcus faecium
  misc_feature (B) LOCATION 1...400
  hypothetical: YES
RQKHTQEDFYMTQVHFTLKSEEIQSIIEYSVKDDVSKNILTTVFNQLMENQRTEYIQAKEYERTENRQSQRNGYYERSFTTRVGTLELKVPRTRDGHFSPTVFERYQRNEKALMASMLEMYVSGVSTRKVSKIVEELCGKSVSKSFVSSLTEQLEPMVNEWQNRLLSEKNYPYLMTDVLYIKVREENRVLSKSCHIAIGITKDGDREIIGFMIQSGESEETWTTFFEYLKERGLQGTELVISDAHKGLVSAIRKSFTNVSWQRCQVHFLRNIFTTIPKKNSKSFREAVKGIFKFTDINLAREAKNRLIHDYIDQPKYSKACASLDDGFEDAFQYTVQGNSHNRLKSTNLIERLNQEVRRREKIIRIFPNQTSANRLIGAVLMDLHDEWIYSSRKYINFDK

SEQ ID NO: 4673 - protein, 400 aa, Enterococcus faecium; identical to SEQ ID NO: 4672
  misc_feature (B) LOCATION 1...400
  hypothetical: YES

SEQ ID NO: 4674 - protein, 149 aa, Enterococcus faecium
  misc_feature (B) LOCATION 1...149
  hypothetical: YES
RQKHTQEDFYMTQVHFTLKSEEIQSIIEYSVKDDVSKNILTTVFNQLMENQRTEYIQAKEYERTENRQSQRNGYYERSFTTRVGTLELKVPRTRDGHFSPTVFERYQRNEKALMASMLEMYVSGVSTRKVSKIVEEFVVNPSLSPSFLA

SEQ ID NO: 4675 - protein, 400 aa, Enterococcus faecium
  misc_feature (B) LOCATION 1...400
  hypothetical: YES
RQKHTQEDFYMTQVHFTLKSEEIQSIIEYSVKDDVSKNILTTVFNQLMENQRTEYIQAKEYERTENRQSQRNGYYERSFTTRVGTLELKVPRTRDGHFSPTVFERYQRNEKALMASMLEMYVSGVSTRKVSKIVEELCGKSVSKSFVSSLTEQLEPMVNEWQPFLLSEKNYPYLMTDVLYIKVREENRVLSKSCHIAIGITIDGDREIIGFMIQSGESEETWTTFFEYLKERGLQGTELVISDAHKGLVSAIRKSFTNVSWQRCQVHFLRNIFTTIPKKNSKSFREAVKGIFKFTDINLAREAKNRLIHDYIDQPKYSKACASLDDGFEDAFQYTVQGNSHNRLKSTNLIERLNQEVRRREKIIRIFPNQTSANRLIGAVLMDLHDEWIYSSRKYINFDK

SEQ ID NO: 4676 - protein, 277 aa, Enterococcus faecium
  misc_feature (B) LOCATION 1...277
  hypothetical: YES
RQKHTQEDFYMTQVHFTLKSEEIQSIIEYSVKDDVSKNILTTVFNQLMENQRTEYIQAKEYERTENRQSQRNGYYERSFTTRVGTLELKVPRTRDGHFSPTVFERYQRNEKALMASMLEMYVSGVSTRKVSKIVEELCGKSVSKSFVSSLTEQLEPMVNEWQNRLLSEKNYPYLMTDVLYIKVREENRVLSKSCHIAIGITKDGDREIIGFMIQSGESEETWTTFFEYLKERGLQGTELVISDAHKGLVSAIRKSFTNVSWQRCQVHFLRKYLYHHS

SEQ ID NO: 4677 - protein, 358 aa, Enterococcus faecium
  misc_feature (B) LOCATION 1...358
  hypothetical: YES
MEKQKRLKNSRYITGFDGLRSLAVVGVIFYHLLPTSMKGGYLGVPIFFVVSGYLITDLLRQEWEQNGKINIWQFYVRRMKRLYPALVFMLVTASAYITLFQRGLLNNLRGVVVSSLLYVNNWWQINNGLSYFDRFANESPFTHIWSLAVEGQNYLVWPILFVLLMVFVRKRKWIFYTVLGTSFLSAILMMILYTPGGDPTRVYYGTDTRLFSIWLGSALAFVWPSTRLKKNIPKQAKNILNIAGGISLLALILCFFFLDDHYNFIYYGGMLLVSLLCVVLVAVTAHPGASLNRWLTNPVFTWIGKRSYGIYLYQFPVMNFYEAKVTDIADHVLLHTFSGNHIDSNHPVNFLIDMWSVR

SEQ ID NO: 4678 - protein, 112 aa, Enterococcus faecium
  misc_feature (B) LOCATION 1...112
  hypothetical: YES
GGKQMAEKINSETLQVTSFDIIFHSGNARTLIHEAFRSMRKEMFEEVEEKLRQANEEILHAHQSQTQLLKEYASGTKIEMEIIMVHAQDHLMTTMTLLEVAQEMNYLYQKNK

SEQ ID NO: 4679 - protein, 879 aa, Enterococcus faecium
  misc_feature (B) LOCATION 1...879
  hypothetical: YES
ELKQHQNLYYRRRRRLPMQPEEMPYFVGTVAAIFFQNPSNFYKVLLVHISETTADYREKEIVVTGSFGDIQENETYRFYGELVDHPKYGRQLKLERYEQEKPTTANGIVAYLSSEKFPGIGKKTAEKIVELLGEDAIEKIIADPSVLKQISGLTKPKREMLAETIRLNHGMDQVIMGLNRYGFGSQLAFSIYQAYKNESLDIIEENPYQLVEDIEGIGFKRADNLAEQIGIAADSPRRIRAAILHQIFQHAVQTGDTYVPAETLLQQTIRILETSRPIEIQPDQVATVIIQLVEEGKIQQEETNLYENSLYFSEWGIGNSIQRLLSRKKEIHYPEKEVQKNIRRIEKIFGIQYGPSQEQAIAEAIRSPLFILTGGPGTGKTTVINGIVNLFAELNGLELDPSKYTQEIFPILLAAPTGRAAKRMNETTGLPASTIHRLLGLNGREKTPSVSTKELEGGLLIVDEMSMVDTWLANTLFKAIPTNMQVILVGDKDQLPSVGPGQVLHDLLEIEQIPKMELNQIYRQGDGSSIIPLAHEIKEGRLPKDFTKNQKDRSYFRSDAYQIEPLISKIVEKAKNKGFRAQDIQVLAPMYRGPAGIDALNKMMQEIFNPGKPGKKEVHWNDTVYRIGDKVLQLVNTPELNVFNGDMGEITGIILAKDSEDKVDELVIQFDANEVTYKRNEWNKITLSYCCSIHKSQGSEFKMVILPMVHQYQRMLQRNLLYTAVTRSKELLILLGEEQAYVTCVANESASRMTTLKSRIMDNDKMNITLRTKLAAYEDSLVGNDPFEDGNYTKEPRVVKEKLPVEDDSGTNETKNQVMETVEPDLFSSFVGEEKKEEVEPAVSKDFVLTAEVIDNQLVDPMIGMENSSPYDFIPAKNA

SEQ ID NO: 4680 - protein, 66 aa, Enterococcus faecium
  misc_feature (B) LOCATION 1...66
  hypothetical: YES
IMKHLKILSIKETQLIYGGTTHSGKYYGNGVYCTKNKCTVDWAKATTCIAGMSIGGFLGGAIPGKC

SEQ ID NO: 4681 - protein, 304 aa, Enterococcus faecium
  misc_feature (B) LOCATION 1...304
  hypothetical: YES
KQKHLIYFEEEPIYMKKKVSIGERSFTLFNNTFLILLALICIVPFLNIIATSFASTQEVVAKKFILFPTTFSLDAYRYILSTPTIFRALAVSIGVTGVGTIVSMCATSLMAYGLSRKYLFGRGFVNFLVVFSMLFSGGMIPTFLVVRSLGLVNSYWAMILPVAVNAMNMIIMRNFFQALPDSLEESAKMDGCTDFGVFFKIMLPLALPSIATISLFYAVTYWNTYMTAILYINDSSKWPIQILLRQIVIVSSGMQAESSAVDVIPPAQTVKMAVIVIATVPMLIVYPFVQKYFVKGALVGSVKG

SEQ ID NO: 4682 - protein, 590 aa, Enterococcus faecium
  misc_feature (B) LOCATION 1...590
  hypothetical: YES
WEKQTICLPIQKKVSSEKMKHFLAYYQLANDYDRRNELHAQPLQPIIEKVESLQSFDELNKQFPEWLLDTLPLPFNLDVDADMKNAQTNAFFAYPPSLFLPDKTYYASDHPNGAQLIGVFFDMAVQLLELAGKEKSQAEAITEQAVQFDKLIAPHVKSAEENADYSKMYNPQSFDTFIKYTDKLDLKKLVTGLIGTTPDKVIVTDPVYFDHLNDILTEAHFPLFKSWMIIKTVRSLSGYLSEEFRQVSGIYSRVLSGTDEAMPQKKAAYYLASGQFDQVVGDYYGKKYFGEAAKKDVEQMVKKMIAVYKKRLEENDWLGDATKEKAVIKLNNLGIQVGYPDKIPALFDQFKTVPADQGGTLLSNTLVFSKLTLKDRFSKWNKPVDRSEWEMSADTVNAYYHPFRNVIVFPAAILQAPFYSLEQSSSANYGGIGAVIAHEISHAFDNNGALFDEYGNLNNWWTEEDLTQFQNKAQAMIEEFDGLPFADGKVNGKLTVSENIADAGGLSCALEAAKTESDLSIEEFFVNWATIWRTKAKKEYQQLLLQIDVHAPAKLRANVQPKNLDEFYETFGITEQDAMYLAPEKRVRIW

SEQ ID NO: 4683 - protein, 606 aa, Enterococcus faecium
  misc_feature (B) LOCATION 1...606
  hypothetical: YES
FWKQNREVRSDEWLVQTPFYLSQAEEDFSLVNEDYSLNGQNMIIAYNSPVKDITVIGKPFNWGFFFLGRDRGLSFYWAMKLVVMVLLGFEVLMILTKRKKALSLIGAFALTFSPAVQWWFMQHVGDLIFFTLGLMIAFYHYFYNHDKKWLRTLMMLLVVIFGIGFILVIYPAHQVMLAYLLIFYFVGLLIYYSKKVSWDLLDVVLIGGAVLFIGGVMVHFWLTSKDALLASLNTLYPGKRVSTGGKWTIGEFFSFLTNWKIPFEDINYSNNSEVALFYHFFPTVFLASPFVLFGKKDSEQKLLGRILMIFCLFSIFWITVGLPKWLAEITLLSYVPPLRAILTFSFAACLLSIWFIAYIWREDVIPIWYKFILLAVNAWSYFYAITHSKMDNYFSDFETIAVAVLGTVILAFALFGWRRLFYLAFVALVIVSGFFVNPVVEGTGAIFEKTLAKEIQKIDQQDPGKVWLSEDELYNFTPTLGVKSFNTVRFYPDIAAWKKIDPKEEYEKYYNRYAHTRAFIAKEDTKFILDRPDMFSVTLNFEDAEKLGIDYVISKRPLTDYNQLYEAQFTQLYGPDKDGYMIFKVEYPDYPDVPQTQTQENQLVVQ

SEQ ID NO: 4684 - protein, 239 aa, Enterococcus faecium
  misc_feature (B) LOCATION 1...239
  hypothetical: YES
IWKHTDMKSKKWRKYNMKFAVIVFPGSNCDADMLWAVREIMGADAEFVRHDESSLEGFDGVLLPGGFSYGDYLRCGAIARFSTIMEEVIRFAEEGKPVFGTCNGFQILTEAGLLPGVLRRNESLHFICKTVPLKVNPKTAFTSEYEADEIIYLPVAHGEGNYFCDEETLQELKKNNQIAFTYNDNINGSVENIAGITNKAGNVLGMMPHPERAVEDLLGSEDGKRFFASILKNFGKVTV

SEQ ID NO: 4685 - protein, 144 aa, Enterococcus faecium
  misc_feature (B) LOCATION 1...144
  hypothetical: YES
CFEHKNLRSIWQKENKFISLYSPLWLEKMQTAKSTVYSATKFAVLGFSNALRLELKPLGVAVTTVNPGPIETNFFDKADPSGSYLEKVGQIVLEPAKLAKMIVRNMRHPKREINRPFILEVASKFYTLFPTIGDYLASGIFNKK

SEQ ID NO: 4686 - protein, 99 aa, Enterococcus faecium
  misc_feature (B) LOCATION 1...99
  hypothetical: YES
CFEHTRGDEFRPYELIPVTKGRGKNTFDKWFNNLKNELKELPNVRQIGISHADAKELAQEFKEGLQELFPDMHIPVLHTNPVIATHTGKDAFAIMYYVD

SEQ ID NO: 4687 - protein, 86 aa, Enterococcus faecium
  misc_feature (B) LOCATION 1...86
  hypothetical: YES
MIEQENRNFLETQGEYRQINNSHFVICEDVQIAFKMALKYGKSIRKKIIREKKSKKIGFWELSLRDGLNFIFCTEDYYEKYKCTLS

SEQ ID NO: 4688 - protein, 398 aa, Enterococcus faecium
  misc_feature (B) LOCATION 1...398
  hypothetical: YES
KKEQKNLQGRTHVKQSKQKQSRRLLFRLFLLICIVVGLLIALYPFYVDSLNSFIDQKRIEQVQKRTAAEIEVQRKKMEEKNQRLTDQGFNPGTDPFNEKNRNESTTSSQLEEWLIGSINIPKIQLNISLYDRLNGRILENGAGVLQGTSFPLGGNSTHSVISAHSGLPNRRLFTELDRLENGDTFILTVLGEKLAYQVKNIQVVLPDDTSVLTISEGEDLVTLLTCTPYMINTHRLLVTGHRIPYNESVKKEEGKGNQERTMRQWFILAGTIIAVVILLVFIGRLIYQYRLSKKVLDFSFIISDSSGKPVNGSSFILKHKKKTLTRNGVPFSVQSDHHGKVKLDQLPGGTYRIVSADDPKVAVSFGIRKVKQEKIYFFEGRKLVKELQKNGFYFKINE

SEQ ID NO: 4689 - protein, 62 aa, Enterococcus faecium
  misc_feature (B) LOCATION 1...62
  hypothetical: YES
FGEQRMMMPKEIYSDALRGARNQLKMAKRTYEIRPTIENERRVKAIRRRCSIYGELQKEDSK

SEQ ID NO: 4690 - protein, 452 aa, Enterococcus faecium
  misc_feature (B) LOCATION 1...452
  hypothetical: YES
GGEQMAHIHFDYSKVAPFVNEHELGYMQSQVTAAHNELREGTGAGSDFRGWIDLPTNYDKEEFARIKEAAKKIQSDSEVLVVIGIGGSYLGARAAIDFLNHTFFNLLDSDTRKAPQIFFAGNSISSTYIADLIEVIGDRDFSVNVISKSGTTTEPAIAFRVFKELLVKKYGQEEANKRIYATTDKAKGAVKVEADAEGWETFVIPDDIGGRFSVLTAVGLLPIAVSGADIDALMQGAADASKAYSSDKLEENEAYQYAAMRNILYRKGKVTELLINYEPGMQYFSEWWKQLYGESEGKDQKGIYPSSANFSTDLHSLGQFIQEGRRNIFETVVKVEKPRKSITIPEQAEDLDGLGYLQGKEVDFVNTKAFEGTLLAHTDGDVPNLLVKIPEMDAYTLGYTMYFFEIAVGISGYLNGINPFDQPGVEAYKKNMFALLGKPGFEDLAKELNERL

SEQ ID NO: 4691 - protein, 316 aa, Enterococcus faecium
  misc_feature (B) LOCATION 1...316
  hypothetical: YES
KMEHQEKIAVLIPCYNEEATISTVIADFKRELPEADIYVYDNNSTDRTYELAVQGGAIVKKEPRQGKGNVIRQMFFDIDADYYLMVDGDDTYPAEAVHGLLEKLRSGEADMVIGDRLSNGTYFDENKRPFHDFGNNLVRNTITRMYKTKILDVMTGYRGFNRIFVKSFPIMSSGFQIETELTIHALDKKFKFVEIPIDYRDRPEGSESKLNTFSDGFKVIMMIIKMFKDYKPLLFFGIWTIFFFLFGLVTGIPVIREYMLTSFITRIPSAILSTGLMTLALLSLVTGLILDTVVTNAKKEYELNLYHVYHEYHSRK

SEQ ID NO: 4692 - protein, 321 aa, Enterococcus faecium
  misc_feature (B) LOCATION 1...321
  hypothetical: YES
MMEHEMTIDEAAKRAEELRTRLNQWSREYYVEDKPTVEDYVYDKEYAELVAIEEQYPDLITSDSPTQRVGGKVLEGFEKVTHDIPLYSLNDVFSKEELIAFDQRVQKAVGRVVDYCCELKIDGLSVSLRYEDGNFVRGATRGDGTVGENITENLKTVRSVPIKLKEPMNIEVRGECFMPKRSFVQLNQDREAEGKDIFANPRNAAAGSLRQLDSKITAKRNLDTFLYTVADFGPMQAKTQYDALEELEKIGFHTNREKRLCHSIDEVWSYIEEYHDKRVDLPYEIDGIVIKVNEFSLQDQLGFTIKAPRWGSSLQVSARRS

SEQ ID NO: 4693 - protein, 351 aa, Enterococcus faecium
  misc_feature (B) LOCATION 1...351
  hypothetical: YES
KMEQFSKERLLVQMLVSFGEIVFTTSMTGYQETITDQSFNGQIITFTYPMVGNYGVNRDDYESISPTCKGVVVKEHARVASNWRNQMTLDSFLKQKGIPGISGIDTRALTRKIREVGTMKASIVDAGDSFEHAFDQLKATVLATNQVQQVSTNKPYPSPGTGRKVIVIDFGLKHSILRELSKRNCNLTVLPYNTDAETILALSPDGVMLTNGPGDPKDVPEAIEMIKKIQGKVPIFGICLGHQLFALANGADTYKMKFGHRGLNHPVREVATGRIDFTSQNHGYAVDEATIDPEKLIVTHVEVNDGTVEGVKHRDYPAFSVQFHPDAAPGPHDALHLFDEFMEMMDAGKEQ

SEQ ID NO: 4694 - protein, 71 aa, Enterococcus faecium
  misc_feature (B) LOCATION 1...71
  hypothetical: YES
KQEHTRLKNVPRSAAAELKQGVKKNRVVHVKNKPPPKRAGGGVTLEQHTFFNYKFPKKSPLTRKPVWSKKC

SEQ ID NO: 4695 - protein, 117 aa, Enterococcus faecium
  misc_feature (B) LOCATION 1...117
  hypothetical: YES
REEQLMQYLEAKIPIPEGYVIISQVDYEELKKADDTGRWMTLPEVLERINRKYDWFTSRVLKNPRYRNIIDIEKNKNGFVYYPVEGRDTYLFLRSKTLEFLETNFSEILRRQADGKI

SEQ ID NO: 4696 - protein, 60 aa, Enterococcus faecium
  misc_feature (B) LOCATION 1...60
  hypothetical: YES
INRQQRMIDNKNNLEGVEIHILILNISAAVYRSLIKTMREISSLAFYFVEVLFPNLSTLP

SEQ ID NO: 4697 - protein, 68 aa, Enterococcus faecium
  misc_feature (B) LOCATION 1...68
  hypothetical: YES
VKRQLLSLMLAVVFLFTIIIAEKVIQSFKVIYSIYKSKSVSGYFNLTSEIIIFSSSMFSGYSGSNTLL

SEQ ID NO: 4698 - protein, 333 aa, Enterococcus faecium
  misc_feature (B) LOCATION 1...333
  hypothetical: YES
AFGHWMEQGSLVKSAQDAYLQSIDLAVEAEKIGVDGAFFRVHHFAPQIGSPFPLLAAIGAKTSKIEIGTGLIDMRYENPYYMAENAGLTDIITQGRVQLGVGRGSPEQVLDGWKYFGYDYSEEEIKEVTRERTLEFLELLEGKPFEEPNPQPMFPQGSGKLRIEPYSEGLRQRIWWGAGSQQTAIWAAQHGMNLQSSTLVNYESHEPFHIQQANQLRAYKEAWKQAGHDFEPRTLVTRSIQPITTDLDRRLFGQDGSPQQDAVGYLAYHRNPTIFGKTFAGEPDQLIKELAEDEAIKEADTVLVTIPNTLGVEYNMHLLETIVKDIAPELGWR

SEQ ID NO: 4699 - protein, 140 aa, Enterococcus faecium
  misc_feature (B) LOCATION 1...140
  hypothetical: YES
VEGQALNIISEVLNMEKLVQVIKLRPGEAVLIVVEDTPAPCPYGMCSMGATPDPDDEHFPHGILLCLDDAAQEGAMCYVTIFDGSGKPITVEVSREIYQVFADYEREMERQRKEEYRHQGLLPLPFVSVRRRLLTTQLRT

SEQ ID NO: 4700 - protein, 121 aa, Enterococcus faecium
  misc_feature (B) LOCATION 1...121
  hypothetical: YES
KEGHEMSVQKTIQQKVIVSGKGETKQHAFASALAEIQNKIMEQSNVLLRIEPVNVDILKAVENKYTERFLFFFFPRQRISYEVELSVTVAVTEIKLADISFSQQMTEDPNGIAIPFVTKKI

SEQ ID NO: 4701 - protein, 249 aa, Enterococcus faecium
  misc_feature (B) LOCATION 1...249
  hypothetical: YES
ERGQSLKSIKRIRMGESYMEIMLDTANTKSIYSCQQFLNLTGVTTNPTILKKEGASNFFSHMKEIKKIIGQIPIHIQTIGRTEEEMIEDARVIIEELGKDTFIKVPVNQAGLQAIKKLKKEGYLITGTAIYTELQGYLAINNGADYIAPYYNRMQNQGIDAMKVIDSLRTEIERTQRPTKILAASFKNCEQVTTAIRSGAHAITLGKELLDQVLEMPSIDKAVRGFQEDWVQTFQAETIGELKKVADYF

SEQ ID NO: 4702 - protein, 335 aa, Enterococcus faecium
  misc_feature (B) LOCATION 1...335
  hypothetical: YES
SFLQLWFPHIPAWVFVFMLAVLTTIINLYSVRLFAETEYWLAFAKISVIILLIIFATYLVGQQMLGTGVFPTLQQLTDHGGFTPHGMKGIISSLLVVIYSYGGSELIAITVSEADDPKRAIPKAIKGVMGRIISFYIIPLFLLLILFPWNTLAGTNVSPFVMVFEKMNIPFAADIVNFVIVLALFSSINSGVYASSRILFFRLKDRKGSSRKLAVLNKHQVPQRAVLFCTSVLYLGVALSYFVGDKLFGYLAGSLSYTVLLIWIIISAASFVLALRKGTLWDKGISFFALAVLGLIFLGILFTNSIGVTVLTGLLYLFIYFSYQKKNDAFVLTNE

SEQ ID NO: 4703 - protein, 66 aa, Enterococcus faecium
  misc_feature (B) LOCATION 1...66
  hypothetical: YES
INLQKPGACGTAAVISPIGGIYHNNNLHVFYSETEVGPVTKRLYDELTGIQFGDIEAPEGWIEVVE

SEQ ID NO: 4704 - protein, 70 aa, Enterococcus faecium
  misc_feature (B) LOCATION 1...70
  hypothetical: YES
ISLHGKKSQVRGMSFAINMSRWEKSDASKRKGAKKETTPVDVVSLIANKCMNYLVIMEKSCFVYLFCMKK

SEQ ID NO: 4705 - protein, 274 aa, Enterococcus faecium
  misc_feature (B) LOCATION 1...274
  hypothetical: YES
MSLQTEIINELGVKPTIDPKEEIRKSIDFMKAYLKKYPFLKTFVLGISGGQDSTLAGRLAQLTMEEMREETKDENYQFIAVRLPYGEQADEEDAKAALDFIQPDVSLRVNIKPAVDAQVQVLSEAGVGISDFNKGNIKARQRMITQYAVAGERAGAVLGTDHAAENITGFFTKFGDGGADILPLFRLDKRQGKQLLQALNAPEKLYTKIPTADLEDGKPMIADEVALGVTYNEIDDYLEGKEVPAQAQEKIEAWWNKTQHKRHLPISVLDDFWK

SEQ ID NO: 4706 - protein, 952 aa, Enterococcus faecium
  misc_feature (B) LOCATION 1...952
  hypothetical: YES
PLLQEKEQVLKVEQQCFAVKDGVSLPEDKLPVLKAKDGYTDAKWPEEATQPITADDTEFVSSATKLDDKSDADKYNPEGQKVTTELNKEPDAFEGIKNKEDLPKDTKYTWKEKVDVSAAGNKKGTVVVTYPDGSSDEVEVDVIVTDNRSDADKYEPTVEGEKVEVGGTVDLTDNVTNLPTLPEGTTVTDVTPGGTIDTNTPGNYEGVIEVTYPDGTKDTVKVPVEVTDNRSDADKYEPTVEGEKVEVGGTVDLTDNVTNLPTLPEGTTVTDVTPGGTIDTNTPGNYEGVIEVTYPDGTKDTVKVPVEVTDNRSDADKYTPLVEGEKVEVGGTVDLTDNVTNLPTLPEGTTVTDVTPGGTIDTNTPGNYEGVIEVTYPDGTKDTVKVPVEVTDNRSDADKYTPMVEGEKVEVGGTVDLTDNVTNLPTLPEGTTVTDVTPGGTIDTNTPGNYEGVIEVTYPDGTKDTVKVPVEVTDNRSDADKYEPTVEGEKVEVGGTVDLTDNVTNLPALPEGTTVTDVTPGGTIDTNTPGNYEGVIEVTYPDGTKDTVKVPVEVTDNRSDADKYEPTVGGEKVEIGGTVHLTDNVTNLPALPEGTTVTDVTPGGTIDTNTPGNYEGVIEVTYPDGTKDTVKVPVEVTDNRSNADKYNPEGQKVTTDLNKEPDASEGIKNKEDLPKGTTYAWKEKVDVSTAGNKKGTIVVTYPDGSSDEVEVDVTVTDTRSDADKYNPEGQKVTTDLNKEPDASEGIKNKEDLPKGTTYTWKEKVDVSTAGNKKGTVVVTYPDGSKEEVEVTISVVDKKAPNKPQVDPITEGDQIVTGKTEPNAEVTVTLPDGSQHHGTADKNGNFTVKVPKLEAGTKVIVTATDESGNTSEPTNVVVSSNKKDSGKNGSKGSKTDNQGSNSNQDKNRGKSQSSKVFPKTGESDSNIFTISGGLILLGTLGLLGYKNRKKENE

SEQ ID NO: 4707 - protein, 349 aa, Enterococcus faecium
  misc_feature (B) LOCATION 1...349
  hypothetical: YES
NLLQLTKCLTFRRKNMIFVPNENHDPRINLAIEQYLLQEMPLDEPILLFYINEPSIIIGRNQNTLEEINRDYVEENGIHVVRRLSGGGAVYHDFGNLNFSFIMPDDGDSFRDFAKVTQPIIQALHELGVAGAELKGRNDLVIDGMKFSGNAMYATNGRMFAHGTIMFDSDINEVVNALKVKKDKIESKGIKSIRSRVTNIKPFLPEEKQKMTTEEFRQEILLKIFGVESVEEVKTYELTDEDWKKINRISEEYYRNWDWNYGKSPDFNFSRQKRFSIGSIEVHLNVSEGMIKEAKIFGDFFGLGDISDVEKKLVGQKYDKASLSKIVSQIDVKKYFGAIEPEELLTLLY

SEQ ID NO: 4708 - protein, 67 aa, Enterococcus faecium
  misc_feature (B) LOCATION 1...67
  hypothetical: YES
NQLQTIVQGWLHFRRVYQELQYSIGMYDRDYELIPERPPVLIIFVEYIFFIKLPPLIIFYTIEFYTI

SEQ ID NO: 4709 - protein, 67 aa, Enterococcus faecium; identical to SEQ ID NO: 4708
  misc_feature (B) LOCATION 1...67
  hypothetical: YES

SEQ ID NO: 4710 - protein, 149 aa, Enterococcus faecium
  misc_feature (B) LOCATION 1...149
  hypothetical: YES
LIMQILEDIKIYWKRIIGYTLVLLVVNLFLSMIALVFVNQRKDNVTELVTFISFFISGIFAPFFEETLMRGIIQNQLELKTNLSTRSIYIIVAILFSLSHLNLYFIPYFMTSLILSFVYDNSDKRLIVPVTIHCFYNLIVILLSVVFYT

SEQ ID NO: 4711 - protein, 489 aa, Enterococcus faecium
  misc_feature (B) LOCATION 1...489
  hypothetical: YES
KRMQGVIAMMSKNNTNGRNQFAMLTIDDLVPQDHLVRKIDAALDFEFIYPIVEATYSDLGRPSIDPVILIKLVFIQYLFGIRSMRQTIKEVDTNVAYRWFLGYSFEEKIPHFSTFGKNYVRRFRETTVFEDIFAYILEQAVKAGFVTEDNLYLDSTHIKANANKHKFTKEMTHDEAKAYQDELEDEINRQRIEAGKRPFTLDLEKEVKLKERKISKADPESGYYVKGEREKQFAYSVHTSCDDNGFILSTIITPGNIYDSQVAFQLVKQSKRLFPEINCVVADAGYKTPKFVHFLTHLNLRPCLPYSRPKGKKGLLSKNEFLYDEYFDCYICPQDQMLAFSTVTREGYREYKSNPKECVNCPLLNQCTISKNHQRVITRHVWGDLMDEVEHLRLTDLNKSIYKKRKQTIERIFADAKEKHGMRWTKYRGLEKVATHTMLVFAAMNLKKLATWLWKGKEPLFFCSKIRNEVDKKLFQARVTSLEQLLSTV

SEQ ID NO: 4712 - protein, 141 aa, Enterococcus faecium
  misc_feature (B) LOCATION 1...141
  hypothetical: YES
KRMQGVIAMMSKNNTNGRNQFAMLTIDDLVPQDHLVRKIDAALDFEFIYPIVEATYSDLGRPSIDPVILIKLVSIQYLFGIRSMRQTIKEVDTNVAYRWFLGYSFEEKIPHFSTFGKNXVRQIKETTVFEEXFAYILETSN

SEQ ID NO: 4713 - protein, 125 aa, Enterococcus faecium
  misc_feature (B) LOCATION 1...125
  hypothetical: YES
WSMQHKVIEAQTLANVYLALDNDLEILPVINKIDLPAADPERVRQEIEDVIGIDASEAVLASAKSGIGIEDILEQIVEYVPAPSGDLDAPLKALIFDSIYDSYRGVVSKCPDHGRYGQTRRQNQT

SEQ ID NO: 4714 - protein, 399 aa, Enterococcus faecium
  misc_feature (B) LOCATION 1...399
  hypothetical: YES
KGVQLMDVLTHKCPNCGGPLTFDPKDQKFHCEYCLNIYTEEEVSQYEQKQKEARMAGEESKEEPSPTEDFTFTAQEQLADMNEAERKAVDEAGGFSDTADESADNTAAMDLFLCPNCGAEIVTDATTAATYCYYCHNPVVLSGRLSGEFLPNKVLPFAVEKEEAINRFLAWTKKKWFVPKAFFNKDQIDKLTGVYFPYWATDAEVDGAMQANGTVIRIWRIGDIEYTETKQFAVSRAGKLSFKELVKNALSKNTQQKMVEGVQPFPLDKAIDFKSQYLAGFQAEKRDIEYEAIKSQIQSELKDYSEKLLKDTANGYTTLTSVRTSASITNEVNNYVLLPVWLVTYRSNDSSKKVYYYAMNGQTGKVSGVLPISQKKLGLTALGIFAGLAILFLIGGYLI

SEQ ID NO: 4715 - protein, 174 aa, Enterococcus faecium
  misc_feature (B) LOCATION 1...174
  hypothetical: YES
KSSQIEDHYQYFGWRCRGDTNMMGRISKAMLAVYSGIAAFLIILFSLFTYFYASNQSHWWGELLRARLLYVPLIFHLMAISLGVGLIVFLLLSLIQKAKYGKIEEKLRALSSGNYESKLLHQPIPSASDDLYIKDIDMEITKIKEKMIEVSSELQIMTSRPQYVDGQTKEEILK

SEQ ID NO: 4716 - protein, 339 aa, Enterococcus faecium
  misc_feature (B) LOCATION 1...339
  hypothetical: YES
KLSHPLDGSKLFCSNPDIQSANPVRYKIASLLTEKISLSFIAKSCQVSLTTVIRTLKEFKTYLPKLSKKIPPRVLMVDEFRSHASIEDKMSFICADGETGKLIDVLPTRKLLRLTSYLLGCTNPEEVEFLVTDMNAAYFQLTKRVVPNAKVVIDRFHIVKHMNQAFNELRIREMNELRKAGQKSQAEKLKKNWRFLLKNRANINHYEYKTWKSFRAPKYPFLTEAMMIDRLLEFSPPLKEAYPFFHELVEAFRDKDPDLFFSLLAELPETLDDSFREKLQNLLTYEEGITNAMIYPYSNGKIEAKNTHIKTMKRVSYGFKSFENMRIRIFLINQLINVR

SEQ ID NO: 4717 - protein, 230 aa, Enterococcus faecium
  misc_feature (B) LOCATION 1...230
  hypothetical: YES
AAQQFTSVIRSTDDRRSQPMKMASIVITMLSDPKEWSLFELVKEAGGKTGAAVTHWYSELYNQAPYNRLVDRIQHQEERLIQHGIFYSEDTYPDSHLFADAHYLVNQYQPDFLVVHSMNIDDVGHKFTADSHEYAAAVNQADRLLAIYYPEWLQKGYQVVVTADHGMDAHGLHGGSLAAHREVPFYLISNKRQKLKEQTVPQLLAAPLFCWLLGIAPSEKMQDIQELMRG

SEQ ID NO: 4718 - protein, 76 aa, Enterococcus faecium
  misc_feature (B) LOCATION 1...76
  hypothetical: YES
GDQQKEEKMVTNMVIFLTVLVYGVNFLVYMYLKINHIKDYVEKIAIYFGTNMTLLFTSSIFLFFGKIVEDGILVFE

SEQ ID NO: 4719 - protein, 297 aa, Enterococcus faecium
  misc_feature (B) LOCATION 1...297
  hypothetical: YES
EEQQVKVKKAVIPAAGLGTRFLPATKAMAKEMLPIVDKPTIQFIVEEALDSGIEDILIVTGKEKRPIEDHFDANIELENNLREKEKTELLALVEETTQVNLHFIRQSHPRGLGDAVLQAKAFIGNEPFVVMLGDDLMKDDIPLTQQLMMDYEETQASAVAVMRVPENETSKYGIIDPKTDSEKGRCRVKGFVEKPEMGKAPSNLAIIGRYLLTPKIFEILETQEPGAGNEIQLTDALQTLNQTEAVYAREFKGKRYDVGDKLGYMKTNIEYGLQHSEIGTSLSAYIIQLSKKLRTES

SEQ ID NO: 4720 - protein, 85 aa, Enterococcus faecium
  misc_feature (B) LOCATION 1...85
  hypothetical: YES
GGQQMIKKLVQFSMDLYDIESGATLSVESDHLIINFGGKRQIILWVVDDVLFPEIVHDFEESKAVEFEIVKKVMELIEKYEEDSE

SEQ ID NO: 4721 - protein, 192 aa, Enterococcus faecium
  misc_feature (B) LOCATION 1...192
  hypothetical: YES
PMQQFFHQHGSEILSKGFEHLYISGLALIIGIIIAVPLGVLLTRFPKAATIVIGLTSALQTIPSLALLALMIPLFGVGKLPAIIALFIYSLLPILRNTYIGMKNVDWNYRDVAKGMGMTEFQSIFSVELPIAIPTIMAGNGLGPVYVIAWATLASYIGAGGLGDLIFSGLNNYPTRSHFGRYDPCNNFSTIG

SEQ ID NO: 4722 - protein, 555 aa, Enterococcus faecium
  misc_feature (B) LOCATION 1...555
  hypothetical: YES
MIKQKIETSIYRRKIMEQKWWHHSVVYQIYPRSFQDSNQDGIGDLRGIISRLDYLAYLGIDAIWLSPVYESPNDDNGYDISNYQAIMAEFGTMEEMEELIEEAKKRNIRIIMDLVVNHTSDEHPWFIEARKNKENPYRDYYIWRDPVNGKEPNRLRSIFSGSAWQLDEKTGQYFLHLYSKRQPDLNWKNKQVRQEIYQMMNFWIDKGIGGFRMDVIDMIGKEPDKEITSNGPKLHEYLQEMNQATFGDKNLMTVGETWGATTEIAKLYSNPKRNELSMVFQFEHIGLDQQEGKDKWDLKPLSISELKKVLSKWQTSLGDEGWNSLFWNNHDLPRIVSRWGNDDVYRKESAKMFAILLHMMKGTPYIYQGEELGMTNCPIDDIAEAKDIETINMYNERISSGFTKEEILESIKAKGRDNARTPMQWNAREHAGFTTGIPWLRVNPNYKEINAEEALADQDSVFYMYKKLIDLRRKHDIIVWGDYELVEKTPEHVFAYSRIYEDQQWLVICNMSSEKQTFTIPREALRVIVSNYPLKQLPDGKVDLRPYEAFVLEVK

SEQ ID NO: 4723 - protein, 319 aa, Enterococcus faecium
  misc_feature (B) LOCATION 1...319
  hypothetical: YES
EDKHMLNKTLQKLQEKLGKAALPFLLFLFFIIICGVTFSSVKQKANDFREGQVAEESIRANKTIENTEETEQKRKLAAEAVTPEYTYQKDLADDQNNRIKQLFELIDKTNDAINKSYDEKIDKAKEDENIPKPTTEERIAALKKNFENVNAENVAFYQKLPNNFYSTIFEMTETEIHTVRDESLKLIDEQMSKQVRESELEAFKQEAEEQIQYLNVTPAQQQMIRYLVDQGIVVNDVLNEKKTEELKQSAREAVQPVMIFQGEIIVRESNQIDASAMKKLELLGLTNRTTSICPLIAMVLAVLLQIGVLIYNSLQFQDA

SEQ ID NO: 4724 - protein, 111 aa, Enterococcus faecium
  misc_feature (B) LOCATION 1...111
  hypothetical: YES
KNKQLYLILKRKVRKKMNKEYFVQQDAFLEDYKSASKKLTINIDELADQVLSQLNETQEEYYTMPANDAKDNVSHRFPFSRRIYSDENDGTLNTEYTYEGQPYVLETDDDL

SEQ ID NO: 4725 - protein, 60 aa, Enterococcus faecium
  misc_feature (B) LOCATION 1...60
  hypothetical: YES
NDKHAKAKETAKTIVGGGSGYDHYLFSTSYYTSISSIFWLRIREFVTKVMSQTFFFVIFS

SEQ ID NO: 4726 - protein, 623 aa, Enterococcus faecium
  misc_feature (B) LOCATION 1...623
  hypothetical: YES
RSKHLKRYISRLSTKQKKILKGTAAIISIFFLVVFSNLFLQWCQNDLSVDLALKFAFSWHTEKFFLACLVLLIILIFLIALAGSVPLGSLTYVVAIGVLGFANYMKMSYRQEPIYPDDLKMITEIGLLKDMTGTMLFTVILAAAGTVIGLFCWYMFRSLKKGRRFQLIRLTTLLVAIGLLGYISNFNNPDNLLRKAYNKTALWIPYSQKMNYYNTGFIGGFLYNLKVEPMDEPEGYSKEKIKEITEKYQKLADEKNKTVEEESPNIVFVMSESFSDPSRLNGVEVSGEPLADYYEVADQTYSGNMLSQNYGGGTANIEFEALTGFSMALFNAQLTTPYTMLVPKMDQLPSIVSALNAQSYQTTAIHPYNTSMYKREDVYQTLGFDQFISERTMTYTDTIENNPYISDESAYKEVMTLLKEEKTPQFIHLVTMQTHMPYDGKYDNLDYPAKTSDGSGTLDLENYLQDISYSSTALKQFTEELKNLSRRTLVVFWGDHLPGIYSDTIQAKNDKQTLHETQFLMFDSKGELEKQTTHDAITSPFYFAANLMEQTNQTTNGFYQLLLSLEQELPAFERELYYQNGQWYKEAQFNRSQQEIYDEYQLIQYDIVAGKQYSLADGFFEHE

SEQ ID NO: 4727 - protein, 99 aa, Enterococcus faecium
  misc_feature (B) LOCATION 1...99
  hypothetical: YES
SAKQKTQILPNFKSKGDFMDPIERLNSLSEEVTQTFHSDFVFLIDAEKIQHFPARNWTHDQIIEELKKRFDHSLMVKPWHEHEVIYSPELPVFALIPKK

SEQ ID NO: 4728 - protein, 79 aa, Enterococcus faecium
  misc_feature (B) LOCATION 1...79
  hypothetical: YES
KLKQSTLIKTNKKGMRAMTEAVKELKKMYPDVLNMTVDDFHEALKNAESEEERTFYLTLSSFVTRVDQKKVINQKDFKI

SEQ ID NO: 4729 - protein, 324 aa, Enterococcus faecium
  misc_feature (B) LOCATION 1...324
  hypothetical: YES
QKKQRRLTSVSFSYKIRKDTKNYWHIWKQPFQKMTKNNLQQSQIIEGGVPLPNRTGLALGTFYQTDTHAYIPLPGPPNELKPMFVEQVRPLLEERFPSEEKLISKVLRFYGIGESRLVTELKDLIETQINPTIAPYAKPNEVTLRLTVKTNDVQAGNQALLALEEKIQERVGEYFYGYGDDNSLAKVVVELLKENKQTVTAAESLTAGAFQAALGDIAGVSEVFPGGFVTYSLQTKAGFLEIDPELLAEYGTVSKECVEQMAIQAREIARTDYSVAFTGVAGPDTLEGQSAGTVWIAISSKDGVVSEKYHFARELKSRSPRNGG

SEQ ID NO: 4730 - protein, 226 aa, Enterococcus faecium
  misc_feature (B) LOCATION 1...226
  hypothetical: YES
NVEQTFSSKVKDKETKDRTSKQLPDVKTDDWKLVLVGPDHKLEKEIDESTQLASLSNGYLIDKRIAPEYEAFAKAAEAAGFPLVMVSAYRSVSSQQQVFEQNVQDVMSRQGVSEEEATKITKETITEPGYSEHHTGLAVDVVDQNWYNSYPSTVLDASYGDQPGAKWIADNAAQYGFIVRYPKGHEDITKITYEPWHLRYVGKENAEYITKHQLTLEEYLNELNEK

SEQ ID NO: 4731 - protein, 73 aa, Enterococcus faecium
  misc_feature (B) LOCATION 1...73
  hypothetical: YES
NLEHDMEKQTRSARRKEKPKANQADSNLVLDLFLKLRYLIGVLVIVVIVTFNLNGSSLGVWDKYVSQREEGKK

SEQ ID NO: 4732 - protein, 81 aa, Enterococcus faecium
  misc_feature (B) LOCATION 1...81
  hypothetical: YES
LFWQKEGGKNGNFISNGFRISRSTTKVIKSNIDLGAYNHIVGAAVWCMNGNMYDVSVYSNHETCIEIIVLGIAISHGERDF

SEQ ID NO: 4733 - protein, 96 aa, Enterococcus faecium
  misc_feature (B) LOCATION 1...96
  hypothetical: YES
GVRHMEIKEEKNRLALFNDEQQEIGEMTWSDAGPDIMIIDHTFVDPAYRGQKLAEKLVYTGVELARRDGKKIIPLCPYAKKEFEKKPEYQDVLRQS

SEQ ID NO: 4734 - protein, 204 aa, Enterococcus faecium
  misc_feature (B) LOCATION 1...204
  hypothetical: YES
GDRHLADNEFEYKAVGVRYTRSESITFQGKQNWIAYKKKGYQIKDWGGGSGNWIAYKKTKIELEVDDGNWVDVTSLVRDYYQRQKITKSLIDKFVQDLASNNVNYEILLKAQGNLEKKKQDDERNKIAAEKAKKDALNYESTKKALEKLVLNIENVLSQVSAGTKEELGQLIVEIKGSEVTADNYSNYHRLAVSLIVKERESRR

SEQ ID NO: 4735 - protein, 358 aa, Enterococcus faecium
  misc_feature (B) LOCATION 1...358
  hypothetical: YES
GFFKKGAEKMFTMQDYIYEEKEVLSTILKKNDFSTREHMKKTVNLLILATGSSYNACLAAKPALESYGDLTVDIQEPFYFFNYGKLSPSIDTVIAVSQSGKSASTVEAVKMIQKQGLPVVAITNDVQSPLALEAAQIIDLGAGVESVGFVTKGYSATVLQLLLLGIGIGISKNKISKKIEQDYMQQLRKIINHLPAIIQKTEEFFDGYQSLFRLAQRFVTIGYGPNWGTAKEAETKLTETIRVPSQGFELEAYMHGPYLEADASHLLFFIEGESVNKERSQKLQRYMSRYVGETLTITTKKARNEKTLGLAIECDEYLSVLALVVPFQLFAYKTAVAKGIDLNKKIFEDFDTVLKSKL

SEQ ID NO: 4736 - protein, 302 aa, Enterococcus faecium
  misc_feature (B) LOCATION 1...302
  hypothetical: YES
TVFNKERMGNFLKKQLLIMCLSACAILLFSGCSKSNETIATFKGGTLTVQDFYDNPKVKSNNQTLLKKMIVFKAFDDVYGKEISSKEVTKEYNEQIKKLGPNYKEQLKAVGQTEETYKKLFKQMLAFQYGLKANVKLTDKDLDTAWKEFYPEVSTQIILFSTKEEADKAKKEANEGENFSKLVQAYGKNKTLKETDGKMNFDSTNPEIPTEVKKAAFKLKNGEVSDIIPVTDPTTYQQSYYLVKMVKKQDKGSNKDKYKSELEKIATEAKTLDTEFMDKTIRKVMKKDNVTIKDPYVKNIFK

SEQ ID NO: 4737 - protein, 250 aa, Enterococcus faecium
  misc_feature (B) LOCATION 1...250
  hypothetical: YES
EAFKLSVIPNYYKNRVCLNVLAHSVENAKACYEAAEGHVVLGVLSKNYASDEAAIEDMKRYQDATNNALSVGLGAGDPNQSQMVSRLSGVLQPQHVNQVFTGVGTSRALLGQNDTVINGLVSPTGKIGYVNIATGPLSSQAPAAEVPIETAIQMLQDMGGTSIKYFPMKGLAHREEFKAVAEACAKYEFYLEPTGGIDLSNFEEILKIAIDAGVKKVIPHVYSSIIDKETGDTRIGDVKILLSMVKKIIH

SEQ ID NO: 4738 - protein, 102 aa, Enterococcus faecium
  misc_feature (B) LOCATION 1...102
  hypothetical: YES
NYFNISTSDLIKEKYLMKKIDLINMIGMLIGILVNIVIFTDWLGVLFSNLIPILIIGICGIILSILELFESRNTMNRIFACIILIVNLLPMVYFTFLYFALG

SEQ ID NO: 4739 - protein, 396 aa, Enterococcus faecium
  misc_feature (B) LOCATION 1...396
  hypothetical: YES
VYFKKIAFYKGVFYLKIAILSPAFSMGGASIVASKIAKGLIDSGHEVFFVSYLESEKPQVESKYYDLYEKKIFLFKNFSRFHKILEYRLFGGFVPSRYIKKEKEQLKKVLKKEKPDVIIFNTFIPSVLFSEFLKYEFPTVKLITWMHSDPDYSLNHIAKFYKKEYRKSFERVDSIVCLSQDTKEKLSLYNNHIKVIYNPLTLSGSSLISNLDKKIISFTARYDINIKGFDYLCEVAKNLPVGWAIRIAGDGTEEERKELKRLIEKNGVLDKIICAGALFGDELINHYIESSIFISTSRSEGLPLVLIEAMTYGLPVISFDHGGAKEILQDGNYGILIKNFDVQDMNNEIEKLSNNRLLMEKYQKFSLERAKDFNEKKIIGEWQTLLNELGNEDVRN

SEQ ID NO: 4740 - protein, 471 aa, Enterococcus faecium
  misc_feature (B) LOCATION 1...471
  hypothetical: YES
NDFKRIFKEVSSMEKIKVVIVGASHGGHQSILELLTRYGENVDITLFEAGDYISFMSCGMELYLEDKVTDVNDVRNFRPENFPQSNVHILNNHEVKTIDADKKTVTVTSASDNETKEYPYDKLILSSGVKPNNLPVPGADLENVYLMRGYNWATKIKEKLNDPAIKKIAVVGAGYIGIEAAEASRKAGKEVVLLDVIDRPLGTYLDAEMTDILEQHLNENGIEVLTNAKIEAFTGNGKVEAIKTSEKEIPADLVIQAAGVKANTEWLKGIVDLDERGWIQTNEYLQTNLPDVYAVGDATLAYSIPARKKMPIALATVARREARYVVKHLFEEVPNKPFGGVVGSSALSVFDYHFAASGLNSFTAAKAGVDVRVSYYEDTLRPKYVPEEQGNPKVSIQLFSDPMTHQLLGGAVLSTYDVTGQGNVLALAIQNKLTLEELAEADFFFQPGFDRQWSMLNLAAQQALGEEPFVE

SEQ ID NO: 4741 - protein, 563 aa, Enterococcus faecium
  misc_feature (B) LOCATION 1...563
  hypothetical: YES
WSFNMKLSIKNNETGVFAIGGLGEIGKNTYGVQFQDEIILIDAGIKFPEDDLLGIDYVIPDYSYIIQNLHKVKALVITHGHEDHIGGIPYLLKQANIPIYAGPLALALITNKLDEHGLLRDAELHEINEDTIIRFRKTSVSFFRTTHSIPDALGIVVKTPSGNIVATGDFKFDFTPVGEPANLHKMARIGEEGVLCLLSDSTNAEIPTFTKSEKTIGHSILKIFSKIEGRIIFASFASNIFRLQQAADAAVATGRKIAVFGRSMENAIVNGQRLGYIKVPDGTFVDAHEINRLPANETMILCTGSQGEAMAALSRIANGTHRQIQIQPDDTVIFSSSPIPGNTTSVNHLINLLSEAGAEVIHGKINNIHTSGHGGQEEQKLMLRLMKPKYFIPVHGEFRMLKVHASLAQDVGVPAENCFIMENGDVLALTSDSARPAGHFVAGDVYIDGSGIGDIGNVVLRDRHLLSEEGLVLAVATVDIKKKEILAGPDILSRGFVYMRESGEMINEAQRILFHALRECLNGPDCSEYKLKEAMTGALQPFLFERTERHPMILPMVMTPDEE

SEQ ID NO: 4742 - protein, 378 aa, Enterococcus faecium
  misc_feature (B) LOCATION 1...378
  hypothetical: YES
GGFKAMTISGRTFIQKFESYCPQWLAEEGDPVGLHIGTLDKPIQRVMMTLDVRPEVVEEAIKKKIDLLIAKHPPIFRPVKRLVTDQPQEKMYADLLKHDIAVYAAHTNMDIIWDGLNDWFCELLGIEVESYLVKTHEIHYKKLAVYVPVDHAQKMREVLAAAGAGTQGDYTGTSFTSIGHGRFTPEAGAQPAIGKVGKTEQVQEAKVEVILPETIEKQVIQAMRSAHPYEEPAYDLFAIDEPVEMFGLGRVGELPQEIFIEAFVEQVKEAFQLDGLRIVQPKNAKSSVKRIAICGGSGEKFYPQAIAQRADVYITGDIYYHTAHDMQSAGLIAIDPGHYIESLCKQRFIEKFESWKQEENWDINFFVSETNTNPFQFN

SEQ ID NO: 4743 - protein, 154 aa, Enterococcus faecium
  misc_feature (B) LOCATION 1...154
  hypothetical: YES
KLFKLLLFVGIMESADYMKRGDAMDIKKMKERQEQIRNFSIIAHIDHGKSTLADRILEMTHTVTSREMQDQLLDSMDLERERGITIKLNAVELNYTAKNGETYIFHLIDTPGHVDFTYEVSRSLAACEGAVLVVDAAQGNRSTNIGQCLFSVRQ

SEQ ID NO: 4744 - protein, 289 aa, Enterococcus faecium
  misc_feature (B) LOCATION 1...289
  hypothetical: YES
GIFKHRKMRKGYNAMNRKRLTQRFPFLLPMRQAQRKICFYAGMRFDGCCYAQTIGEKTLPYLLFETDCALYNHNTGFDMIYQENKVFNLKLAAKTLNGLLIKPGETFSFWRLVRHADKDTPYKDGLTVANGKLTTMSGGGMCQMSNLLFWVFLHTPLTIIQRSGHVVKEFPEPNSDEIKGVDATISEGWIDLKVRNDTDCTYQIWVTLDDEKIIGQVFADKQPQALYKIANGSIQYVRESGGIYEYAKVERMQVALGTGEIIDCKLLYTNKCKICYPLPESVDIQEANQ

SEQ ID NO: 4745 - protein, 67 aa, Enterococcus faecium
  misc_feature (B) LOCATION 1...67
  hypothetical: YES
MAFNGVSRGTMTNFRCSFIVTSAARAIRLSPKPTEIPATVFILAGTMIIPSVKNDPLATAAPKSLFE

SEQ ID NO: 4746 - protein, 68 aa, Enterococcus faecium
  misc_feature (B) LOCATION 1...68
  hypothetical: YES
FEFNLSSLLELFFPITDNSMGLKPNIPREIEPSTNTVFFNIGYTSTFFNATTCIHILNTSLQFIKCLN

SEQ ID NO: 4747 - protein, 502 aa, Enterococcus faecium
  misc_feature (B) LOCATION 1...502
  hypothetical: YES
PEFNQEQAVKVRSSPFIVHKGWSGHFFCAQNEKGSEKMAEITLEFDTIAAISTPPGEGAISIVRLSGDQAVQLADKVYQSGNKRLSEVPSHTIHYGHIVDPKSNQLVDEVMVSVMRAPKTFTREDVVEINCHGGIVVVNQILQLLLREGARLAEPGEFTKRAFLNGRVDLSQAESVMDLIRAKTDKAMGLALNQLDGNLSALIRSLRQEILETLAQVEVNIDYPEYDDVEELTTKLLLEKAQMIQQRIQALLATSKQGKVLREGLSTAIIGRPNVGKSSLLNHLLREEKAIVTDIAGTTRDVIEEYVNVRGVPLKLIDTAGIRETEDVVERIGVERSRKALAEADLILLVLNQSEPLTAEDEQLLEATSGLKRIILLNKTDLPAQLEQEKLKKLIENEPVFSISVAKNDGLDRLESAISDLFFSGETGERDATYVSNTRHIALLEKASLSLEEVIAGIDSGMPVDLVQIDMTRCWDYLGEVVGDSVQDELITQLFSQFCLGK

SEQ ID NO: 4748 - protein, 82 aa, Enterococcus faecium
  misc_feature (B) LOCATION 1...82
  hypothetical: YES
EEFKMGFIWALIVGGIIGAIAGAITNKGSSMGIIANIIAGLVGSAIDQALLGTWGTNNCRNGYHSIIDRCNHFSISRFILCT

SEQ ID NO: 4749 - protein, 390 aa, Enterococcus faecium
  misc_feature (B) LOCATION 1...390
  hypothetical: YES
EGFNMAKGKHQKKQQISLSFLAVLLLAVSFFSTGIITGWQLTKQPQPQIYKTEPAQLASNLTSNEQMLASKIDQLLQKSDYIGSIYVRKNNRVILEKGYGYANLRIKESNSPSLYYQIGSIQKAMTALLILKQIQSGKITFDTKLSEFYPQIPGSQQISIKNMLYMRSGLHRTASPKKPMSDSEIIQFALHHLKFTGYDTYHYEPLNYTLLTGVLIKLMNQPYETLLKKEIIRPLHLEHTDFYENVKNSPQHAVSYQMSATDDYSKALVEPETDIRNELGTGNISMSVYDLNKFFTSVLSGDIIPKELLFSLWQNNGDKHPYSGGVYSGNDYILAQGNINRFHAVAAMKKDTKDAIVMESNIQSDKNIKLPATDLRNQIYELMEGVNLKS

SEQ ID NO: 4750 - protein, 70 aa, Enterococcus faecium
  misc_feature (B) LOCATION 1...70
  hypothetical: YES
TPFKEEVVSLPFNSESQGAISKNSFSCLLTIVTCDRGVGRRTPFIRKKELRQDFCHSSFFFLLCYTRCKK

SEQ ID NO: 4751 - protein, 62 aa, Enterococcus faecium
  misc_feature (B) LOCATION 1...62
  hypothetical: YES
TPFKKEVVSLPFHSESQRAISKNSFSCLLNIVSCDRGVVRRTPFTRGCDLFLVTTSFFIYSI

SEQ ID NO: 4752 - protein, 730 aa, Enterococcus faecium
  misc_feature (B) LOCATION 1...730
  hypothetical: YES
MSLKNKIRRFMEKKNLNPMNNRKKVGIILFATSIGLFFLFAVRFSYIVIGGHVAGTSLAEKTKQLYQGSEVVKAKRGTIYDRNGVALAEDASSYSIKAILSKTYTSGDKKLYVEEKNFDKIAEILHKNLSIDKKDALNILEDGAKKELYQVEFGSYGKNISQETKQNIEADMKKEGVAGLYFVDHQARMYPNGVFSSHFIGYAVPDKDENGLVGKLGLESAYNDILSGKDGKIIYQKDNFQNPLPGTVAEEEKAVDGQDIYTTLDSRLQSYLETLMDQVNEEYQPEELTAVLMKAKTGEILAMGQRPTFNPETMEGLTGKDAIWRNFLVQDSYEPGSTMKVFTTAAAIEEGEFNENETFQSGKIQVEDATINDHDFGEKGVLTMRQALSWSSNVGMVILEQRLGGRWYNYLQKLGFGQSTHSGLDDEVNGALPTLNIVDRAMSAYGQAVGVTNFQMMKAFTSIANNGTMIQPRYISKVVDPQTGEERTTQTEVLGQPFSKETTEKVREYMRDVVESENYGSAYGVYSVPGYNVSAKTGTAQIASDTGGYQTGDTAYLYSIVEMVPSEDPDYVLYLTMKHPKTYDRMALAKIANPLMKRAMDFKETEEDSDTETKTEKVSVADYRNLEADVAAADAQKSGLQPVVIGNGKKVQKQSTANGDQLISGEKLILYTGGDKLMPDVTGWSKADIMKLGKILGIEVSFDGDGYCVKQELAPYEKITEDKLSFTLEE

SEQ ID NO: 4753 - protein, 270 aa, Enterococcus faecium
  misc_feature (B) LOCATION 1...270
  hypothetical: YES
IILKLEVKTMLKKERLLTIVEMVNKKGILTVNEIINQLDVSDMTVRRDLDELEKSGKLLRVHGGAQSLSYTLDQELSHTEKATLQIQEKKEIAATAASLIHEGETIFLGPGTTIELLATHLLNKKIRIITNNYPVFDILAQADGPEILLIGGDFRKNTGAFVGPITNDNLRRLKFTKAFISSNGVHNEAISTYSTEEGEAQQIALNNSRKKYLLVDNKKFNRDDFYVFYNLHDFDLLITDRQISREVQEHYAQYVDLQIADSTENTTIGA

SEQ ID NO: 4754 - protein, 176 aa, Enterococcus faecium
  misc_feature (B) LOCATION 1...176
  hypothetical: YES
RLCFNLAANFAGIPLAFSFIILLGNVXVLKMILPFLADFNLYSWWGLTITYTYFQIPLGVLFLYPSMKEVKKEWLESAQLLGASSAYAWFKVALPFLRPSIASTFVILFANGMGTYETAYALTSSNVNLLTIRIAALVSGDVFAKPNLGSALAVALSVLLVTAMLIIQKKGKVVQT

SEQ ID NO: 4755 - protein, 138 aa, Enterococcus faecium
  misc_feature (B) LOCATION 1...138
  hypothetical: YES
PPLKINRKFFGGDETEGAVRKRDFFELYHERRAKMFKNELSQNRYREKLRRSLISQLESQKTNIEPFLDNVDRYISLWETAISLEEDISENGIRLENGKKNESVALLVSVNKQMGLMLDKLAITPELVGEANESIPEL

SEQ ID NO: 4756 - protein, 159 aa, Enterococcus faecium
  misc_feature (B) LOCATION 1...159
  hypothetical: YES
NLLKSYYNIFVNDFNKMIGEKMMDQKAFIESIDSTIDRLKKEIRFYNRVIGIGNIIKIVLSASIPILIDQASEHRSLLLIVSIASAIITIIQSGMSAFNYQDKVQTSTELLMKIEKEKLLYITKTSPYNKTDEENFHLIVTTLQTELIDIISDFNQVNN

SEQ ID NO: 4757 - protein, 77 aa, Enterococcus faecium
  misc_feature (B) LOCATION 1...77
  hypothetical: YES
RQLNWDKTRYSLFRLYHIKKSEGTIMKRNLIIGSILIGGIFGLLPLIAKIAIFAGLALYLFTAYDEYDYQLRTGGHK

SEQ ID NO: 4758 - protein, 171 aa, Enterococcus faecium
  misc_feature (B) LOCATION 1...171
  hypothetical: YES
DELNIIERVGEMAKYRIEEKPDFTVTGIGVELKSSNTDFVGLAAEKQAFEQKVIGNGTIDALKQAAENHYFFTVNEPYNGKMMYYVGVQTSQDVPNTTRIIPFPKGTYLVVSALAESPEELRNDLTNTAFGHVLREVEDYAYVGGPNAVVEMGVTNGKYMGEIWIPVVNKP

SEQ ID NO: 4759 - protein, 546 aa, Enterococcus faecium
  misc_feature (B) LOCATION 1...546
  hypothetical: YES
KKLKNTLTKKLYFLSFFLYKKQSKFLSRTYRKPIKSLLQVSYNHFESVFTKAGGMLQMKNRRLLQFSLFLGVLYGIFLSVSIDACTTVLVGKNASVDGSTMIARNEDLNTAWSKYFVVRKENTNPSHFVSKGNGFTLDLPKEQLKYTATPEWDTSEGLFEEDGINSKNVAMSATESATTKEEILKKDPYTAHGIAEESMLTVTLPYIDSARAGVERLGKIVAKQGAAETNGVIFSDKNEIWYMEILSGHQWAAVKVPDDCYAVIPNMLSIDSFDLKDKDSYLCSADLESFLEKNQLINTKRDISLRDIFADKSKDEEYNLPRIWDAQRKLTPSKKQKITDRSFEMFVKPDKPISIAETAYIMTLHFNGTEYDTIEGTKPDKYRPISVPNTMESHILQIRNNVPEEISGIHWLALGIPDTSNYIPFYSNISETPEAYQKGTDMPDDISAYWTYRLTNILTKPYYSDFKKNITLPTRQKVRDHLSKELASTDQQARELIVNHPEKLTDYLNQKTQSFADYAIDAYQKMNQELIVKMSEKTATHHDKDL

SEQ ID NO: 4760 - protein, 133 aa, Enterococcus faecium
  misc_feature (B) LOCATION 1...133
  hypothetical: YES
DVINGQLIRKRFLMFLSNFFVRCLFLKKIKKESYGFLTIFVACIMMVLQRILISAVTIPTYATNPGRFYIYTFLQTSVVIGANLIPLYMGYQYQKIARLKVLHYLSRFAFIFLIATLVCNIFFLRTSWQLEYS

SEQ ID NO: 4761 - protein, 287 aa, Enterococcus faecium
  misc_feature (B) LOCATION 1...287
  hypothetical: YES
ECIKNRLGGILMFRHQKELQFEAKPDRPNPLIAKYLQELIGGQYGEMSVAMQYLFQGWSCRGEEKYKDMLMDIATEEIGHVEMLATMVARLLEGAPVEDQEAAMQKDPTIGAIISGMNPQHAIVAGLGPRPADSVGNPWSGAYIIASGNLLADFRANLNAESQGRLQVARIYEMIDDRGVKDMLSVLLARDSYHQNLWECAVKELEEKEGSILVPSTFPRDKERKDIAYDFYNFSEGDQSSEGSWASGKALDGEGEYQWLKEPKIEGAAPKLEPVTPKMYGTPPFKK

SEQ ID NO: 4762 - protein, 324 aa, Enterococcus faecium
  misc_feature (B) LOCATION 1...324
  hypothetical: YES
ILINNFLKERMYMKVKKAVIPAAGLGTRFLPATKAMAKEMLPIVDKPTIQFIVEEALKSGIEDILIVTGKAKRPIEDHFDSNIELETNLSEKGKTELLKLVEETTDVNLHFIRQSHPKGLGHAVLQARAFIGNEPFVVMLGDDIMEDEVPLTQQLIDDYERTHASTIAVMQVPHDETSKYGIINPGEVLEDGLYNVKNFVEKPDPSKAPSDLAIIGRYLLTPEIFDVLSEQQPGAGNEIQLTDAIDTLNKTQRVFARKFTGKRYDVGDKFGFMKTSIEYGLTHPEVGAPLREYILSLGKTLEAEGSKIDHNPKGITEIKEEKKK

SEQ ID NO: 4763 - protein, 291 aa, Enterococcus faecium
  misc_feature (B) LOCATION 1...291
  hypothetical: YES
TIIKRVEELMSVISRIESMMEDYSSAEKKLANYIIGNIEKVPTMTANELAEASGLSAPTVVRFSKKIGFQSLTDFKITISTELQTGIDEGFSDIEANESFYSIKNKLGNNAQVAIKETVDILEEETIQKVVECLESAETVFLYGVGASSLVVEDILQKWSRVGKPIIFEKDIHVLLPQLVSNEKKKVLWLVSNSGRSADVVALAELAKSMNIEIIALTQFGNNPLSKIADVLVQTSRPKEITNRSAATNSLLAQFATIDIIFYFYMAKNEKLSEKVKKTREAIQEYFMDSK

SEQ ID NO: 4764 - protein, 386 aa, Enterococcus faecium
  misc_feature (B) LOCATION 1...386
  hypothetical: YES
LLIKVGAHMLVSFSMVIRFFLTILLSLILTPVFKIISVQTGMVDKPNERRINKVPMPSAGGLPIFISFVISTLFLFRKIIPQSYIVPILIASLVIIVTGVLDDKYELTPKQKSIGILIASLIIYFVADIRIDSFTLPFIGYIQLGWLSFPVTIFWIFGITNAVNLIDGLDGLAAGISLIGLITIGIIGYFFLHASTVYIPVVIFCLVASIIGFFPYNFYPAKIYLGDTGALFLGFMMAVLSLQGLKNVTFVSSISLLIVMGVPVTDTFFAIIRRKANRVSFSTADKKHLHHRLISLGFTHKGAVLTIYAMALMFSFTAMVMNYTGRIGTIILIIAMLFAAILLFELIGLINEKHQFILKTLRFLGNKEYRTQVKQKYLKKWNRHIR

SEQ ID NO: 4765 - protein, 106 aa, Enterococcus faecium
  misc_feature (B) LOCATION 1...106
  hypothetical: YES
AMIKEYRTIGEVVGPLMAVEKVAGVKYEELIEVRMQNGEIRRGQVLEVQEDKAMVQIFEGTSGINLRDFSVRFIAHPLRNRSIGRHDRRIGRWFGTTERYGTRDRA

SEQ ID NO: 4766 - protein, 178 aa, Enterococcus faecium
  misc_feature (B) LOCATION 1...178
  hypothetical: YES
MEINWRKNLVIAWIGCFFTGASISLVMPFIPVYVEQLGTPKDQIELFSGLAISVTAFASAVVAPIWGNLADRKGRKLMMIRAAAGMTLTMGSLAFVPNAYWLLIMRFWNGILSGYIPNATAMIASQAPREKRRMGVRNIVYRSDCWKSDRTFNGRCTGSVVWYGKCILDHRGFVDDHN

SEQ ID NO: 4767 - protein, 119 aa, Enterococcus faecium
  misc_feature (B) LOCATION 1...119
  hypothetical: YES
FFVNEQDRKKHLMDSFQRLSLVNQFELLAKFEDQNRSYYERKIEILREGYEYHYDDEIWSDLSEPFPKEDSRFVLDVLNMYRDINFSKSKLNLDENQITNSYYTHFGSVAKFSKKSILV

SEQ ID NO: 4768 - protein, 275 aa, Enterococcus faecium
  misc_feature (B) LOCATION 1...275
  hypothetical: YES
SDVKREEEFNVRVLFIGDVLRSMGREMITEYLPTLKKNSRPKLTNVNGENAASGRGIGQKIYKKFLQDGVDVVTMGNHTWDNRGIFEFVNEAKKMVRPANFPEGTPGQGMVFVKVNQVELAVINMQARSFMVDLDDPFRKMNELVEEARKRTPIIFVDFHGETTSEKQAMGWFLDGKVSAVVGTHTHVQTNDARILPRGTAYLTDVGMTGPYDGILGMRREPVIEKFLTALPKRFEVVEQGRSILSGCILELDDTTGHAKEIQLIQINDDRPFME

SEQ ID NO: 4769 - protein, 333 aa, Enterococcus faecium
  misc_feature (B) LOCATION 1...333
  hypothetical: YES
MTVKVGINGFGRIGRLAFRRIQDVDGIEVVAINDLTDAKMLAHLLKYDTTQGRFNGTVEVHEGSFNVNGKEVKVLANRNPEELPWGELGVDIVLECTGFFTSKSAAEKHLTAGAKRVVISAPGGNDVPTIVYNTNHETLTGKETVISGASCTTNCLAPMAKTLNDKFGVVEGLMTTIHAYTGDQMTLDGPHPKGDFRRARAAAANIVPNSTGAAKAIGLVIPELNGKLYGAAQRVPVPTGSLTELVTVLEKEVTVDEINAAMKEASNESYGYNTDEIVSSDIVGMTYGSLFDATQTKVMTVGDKQLVKTVAWYDNEMSYTAQLVRTLEYFANL

SEQ ID NO: 4770 - protein, 71 aa, Enterococcus faecium
  misc_feature (B) LOCATION 1...71
  hypothetical: YES
LRVKRQTYNLLINGVQKLASAVISSANSKTRKAVFAWLFLLLVAGQLFHNLSTKRCSPANSSVTSHNIQQT

SEQ ID NO: 4771 - protein, 155 aa, Enterococcus faecium
  misc_feature (B) LOCATION 1...155
  hypothetical: YES
EVSNMKKKQRKALMRDIITEQPIGTQEELLARLHEAGADVTQATISRDIREMKLVKSQNENKIVRYTLFNQPSVSLNEERLRTAIRREVLRIQSVQFMVIVLTERNGADVVTNWLDEVAYPEVVGTMAGVDTFIIICRSEEEAQRFAEKLEKMRE

SEQ ID NO: 4772 - protein, 176 aa, Enterococcus faecium
  misc_feature (B) LOCATION 1...176
  hypothetical: YES
NMFLLKQFIPVQAKRARDTAEGINKELARPVEIFYTDKLRELGLGTLEGQSIDEMYQKYPDNLPNLRNHLDLYDPSPFHGETIESAITRIETVVADAVARHKDGPLLFVGHGASLTAAIQWMTGKELSELREMGGLFNSSLTILETEEPCRLLPYELKVWNQTDFLGTETAPEPLL

SEQ ID NO: 4773 - protein, 124 aa, Enterococcus faecium
  misc_feature (B) LOCATION 1...124
  hypothetical: YES
WTCFICQTHRNRDINSSLNILIKGLRIQPFSCYFVRLITFFSLRIIRFSDQLTCSEKDYYLCKFPNEGVGQYYSQYFLHSQLFVLAKHYLQFLLGIVAGEHITRLIHLRVVSPRNFPKSSETLL

SEQ ID NO: 4774 - protein, 86 aa, Enterococcus faecium
  misc_feature (B) LOCATION 1...86
  hypothetical: YES
VSFLIMNFRGGTEMITIASAMQQDEIKELLEGYNEEGMTFTFKEKQGIKLFFETSAEDPEVAAKKAKELIKAQPWGTVLYFQSTAV

SEQ ID NO: 4775 - protein, 89 aa, Enterococcus faecium
  misc_feature (B) LOCATION 1...89
  hypothetical: YES
VKPKRAVSKNYTDSCRRSLSLPLWLKELFEYFAYLPPIRFTTWSGNKGMQKNGEKCGMTKEVVIRKVRFLNNQYYDSVKYGILWEELAD

SEQ ID NO: 4776 - protein, 170 aa, Enterococcus faecium
  misc_feature (B) LOCATION 1...170
  hypothetical: YES
IACFFVYFFRANNMNHFWGRRLLTRDIKAIDCEEVNLPNYEKIAAVERLGNWILCHRCGMRTSVIDGQLADYGYFCTHCLYLGRCDTQQDLYLFDQPEAKPREVVFFWTGQLTEKQTEIAKRILCHSEKKTSSYLGCNRCRENRDALSYFSGNFKSWRKSSDLYTASRCL

SEQ ID NO: 4777 - protein, 378 aa, Enterococcus faecium
  misc_feature (B) LOCATION 1...378
  hypothetical: YES
LKFLKALKQSEQAKIVRLLLSKTQHVIFMVSNSMQKYVIPNTESNCCATLPLMFVTVERNWTMDNFIDMQVEKIREQVGDKKVLLGLSGGVDSSVVGVLLQKAIGDQLTSIFVDHGLLRKGEAEQVMESLGGKFGLNIIKVNARDRFLDKLKGVSDPEQKRKIIGNEFVYVFDDEATKLAGEEGVSFLAQGTLYTDVIESGTETAQTIKSHHNVGGLPEDMQFELIEPLNTLFKDEVRELGTQLGMPDSIVWRQPFPGPGLGIRVLGEITEDKLEIVRESDAILREEIAAAGLDRDIWQYFTVLPGIRSVGVMGDGRTYDYTVGIRAVTSIDGMTADFARIPWEVLQKISVRIVNEVAHVNRIVYDITSKPPATVEWE

SEQ ID NO: 4778 - protein, 270 aa, Enterococcus faecium
  misc_feature (B) LOCATION 1...270
  hypothetical: YES
LLTKEGENMAFIQANIYSNVLEMEVNLNVILPQTTKKVIGTSSEQETTDIPVLYLLHGMGGNHSVWERRTSIERYVANYGLAVIMPSTDLGWYTDTVYDMKYWTFIAEELPEICHELFPQLTRKREKTYAAGLSMGGYGALKLGLAKSENFAAVISLSGAVSVGNRMDDLLMVRKASFWEGIFGPLDQIEGSKNDPQYLLKELVKSGKPVPKFYMACGESDFLYQANQEMVSAMQEQGLAVTFEQGPGDHNWIFWDQWIQRALAWLMEKK

SEQ ID NO: 4779 - protein, 372 aa, Enterococcus faecium
  misc_feature (B) LOCATION 1...372
  hypothetical: YES
NITKKGANKMAQHVFIVGLGLIGASMALCIRQTNPELIVVGWDSQSKTREQAVEQQIVDYVASDFETGAEQADVILLAVPVRTTLAYLDVLERINLSDHVIITDVSSTKQQVVTSAEQKNLRFVGGHPMAGSHKSGIQAADAKLFENAYYIFTPLEKTKKDVEKLQELFCGTKAKYVTLTAREHDRITGMLSHFPHILAAGLVNQAEQFNQEYPRAKQLAAGGFRDITRIASSDPVMWTDILLSNKQILLERLADWQQEMTQIAEWIMTENQSEIFSFFNRAKESRDQLPVHKQGAIPAFFDLFIDVPDEPGVIAEVTGLIGKAGVSLINLKIQETREDILGILQISFKNQQDLLQAKRIIMSNTSYHCWIK

SEQ ID NO: 4780 - protein, 287 aa, Enterococcus faecium
  misc_feature (B) LOCATION 1...287
  hypothetical: YES
SITKSFPNSLRKEKIEMKKTSFLFALIAGLLLFAGCSNKKTSADNWATINEEKKIVIGLDDTFVPMGFRDKDGKLTGFDIDLAKAVFEQYGITVDFQPIDWSMKEFELNNGTIDLIWNGYSKTPAREKKVQFTKPYMENDQVLITPKESGITNFGQMNNKRLGAQNGSSGYDVFTKQPEVLKEIVKNQDAVLYDSFNEALIDLKSRRVDGLLMDKVYADYYLKQRNELEDFNITKGSYESEDFAVGARKSDSTLVKKINEALDQLEKTGEFQKISDKWFGEDVTPRN

SEQ ID NO: 4781 - protein, 327 aa, Enterococcus faecium
  misc_feature (B) LOCATION 1...327
  hypothetical: YES
MTTNFWKELPKPFFVLAPMEDVTDVVFRHVVKHAAAPDVFFTEFTNSDSFCHPDGKDSVRGRLTFTEDEQPMVAHIWGDKPEFFREMSIAMAEMGFQGIDINMGCPVPNVAERGKGSGLILRPEVAAQLIEAAKAGGLPVSVKTRIGYTEMSEMEEWISHLLHQDIANLSVHLRTRKEMSKVDAHWEVIPKIIALRDQIAPQTLITINGDIPDRQTGEELAEKYGVDGIMIGRGIFKNPYAFEKDPREHTEKELIGLLRLQLDLQDHYSEIIPRSITGLHRFFKIYIKGFPGANDLRVQLMNTKSTDEVREILETFEKEHPTLFSEQ

SEQ ID NO: 4782 - protein, 75 aa, Enterococcus faecium
  misc_feature (B) LOCATION 1...75
  hypothetical: YES
SITNIWSAFLIVDRRWAITKLVFPSIIAKKACWIFFSVNVSTELVASSKINIGGLLIIVRAIVNSWRCPSDIFNP

SEQ ID NO: 4783 - protein, 76 aa, Enterococcus faecium
  misc_feature (B) LOCATION 1...76
  hypothetical: YES
ILTKNSKKEEDQMYYVEVKTKGVKNKQYVKGISNEYPLLGSWKEAAPFSKPCAIKIKNELEKELTCGKAVVDIIEK

SEQ ID NO: 4784 - protein, 124 aa, Enterococcus faecium
  misc_feature (B) LOCATION 1...124
  hypothetical: YES
RETNFIEVKIMAFETTATVLGAPISYRLHPDAKRYTLRDNGFTETNGGNYQLIRPLDATPQSKEGFKLKITVSKDIQTLKMSITTANGLKAVNIFKDPKQKMSQDKFYFLMDGMISRGLFEKVE

SEQ ID NO: 4785 - protein, 412 aa, Enterococcus faecium
  misc_feature (B) LOCATION 1...412
  hypothetical: YES
KKTKIMLKAGGEMLDKVMFEEIIHPEKWINECYKELMEKEWNNEIERCRRHTERLIKRISNSQYQFPSECPIKGRYPLRDNIGWTEGFWTGINWLLFEKTGDPLFQQTAEKADIDFIHRIDCQIITNHHDLGFLYSLSTVADYKITGNRKMKEASIDAAETLLQRFWEKAGVIQAWGDPSDPSQQGRMIMDCCMNLPLLYWASEETGNQKYKKAAQAHIQNAADYLVREDGSTYHTFYMDVKDGKPRYGSTHQGYSDNSCWARGQAWGIYGFALSYRYLKEQKYFDLSKILANYFMNRLPEDTICYWDLIFDDSSREEKDTSSMVIMVCGLLELIESGLLDKTEKNLYQSAVWKIMRQLKERYATTEEEDGFLTQSVYNKPKNNGVNTPCIWGDYYYLEALVRMTSNWSSYW

SEQ ID NO: 4786 - protein, 69 aa, Enterococcus faecium
  misc_feature (B) LOCATION 1...69
  hypothetical: YES
RPAKNKIVLYPTLSQIIVMIIDIRIQKGFVNHCTPLIPSAFKNPLNNPVGLKKVMNTEATATVDVMVGI

SEQ ID NO: 4787 - protein, 173 aa, Enterococcus faecium
  misc_feature (B) LOCATION 1...173
  hypothetical: YES
WYCLPTKNPETRSVCQTSELKLEENNVRTTYMGKPGEVERKWYVVHATDVPLGRLSTVVASVLRGKNKPTFTPHLDTGDFVIVINADKVKLTGKKATDKIYYRHSNYPGGLKSITAGELRAKNSRRLIETSVKGMLPKNTLGRKQFTKLNVYGGAEHPHAAQQPEVLDITNLI

SEQ ID NO: 4788 - protein, 375 aa, Enterococcus faecium
  misc_feature (B) LOCATION 1...375
  hypothetical: YES
RLAKPHMTFVTMKESAMHKSRLLNETSFLLVISLLLLVSQGFVAMQVIYLLIAVLFTGVSYLLPTKPNWIFQVILFLLCAFLPDLVLFLPATMRVIAPEESHLDYLFLLGFLLISTVGNHPPIKVAFVVILLFFSFYLRKKDQRTTDLEKKYIVSKDTHWEKQQELSEQNKALALSQETQLALQIVEERNRIARDIHDNVGHLLSSAILQIGALEMINQEPKLKEPLENLSATVHTGMDRIRQSVHDLHETSISFQHSLEFLIADFPSSVTIEGNLFEGLNETQQNCFLMVIKEALTNSIKHSHAKTVVLHFRTLPAFYRLQITNDGTSPQKNSAPGIGLKTMRQRVQEQKGQVHIFQENQQFQLTIILPREGHQ

SEQ ID NO: 4789 - protein, 1057 aa, Enterococcus faecium
  misc_feature (B) LOCATION 1...1057
  hypothetical: YES
KMAKKRTEAEVTFIANDDGLKSTLKEISAELTKNRAELKLEQAQLQQTGSESDKLGSKLSSLEKQYELQSQKVEVTSQRLANAKKYYGENSTEVQKLERELINQQTAQQRLSNEIDKTSNALAQAKGEIQTYESTMQQLDSEQKNVQASASLIESEYKKWQATAGQSASEAEKLAKAQEYVSQQSENAEKTIDILRRQLEATQSEFGATSTEAMQMEAKLNDAEREFEELGQAAKNVDTTNLDDIGSKIDMNNLMEASDVLSDIGDKLTELGKQAVDSANSVGSSQSKIQANFGLSKQEAEELTNVARDIYYKGFGESLDQSTDALILVKRNLGDLNNQDLQNITEQAMVLENTMGADMDETLRGVNGLMVNFGLSAQDAMDLMVSGTQNGLDKTHELGDNMAEYSQLWSQMGYSADETFGMLQNGLDAGAYNLDKVNDLVKEMGISLTDGRFEQNMDMFSESTRKAFEEWKNGGGTQKDVINSMIQDFSNMDGQYDQLNKASTIWSALGEDNAMKVVQSLTDVNHTFDDVSGSAQKMNEDSTTPLQELNGKIAELKDSLAPIGNTIIDALEPVIDFLGKMADAFNNFPQPVQDFIVAIGGLTAAFGILLPAILAVSYLFGPMMLIIGGIIAVIAGVIVAIKNWGAITDWFSGLWKKFTDWLGDTWESIKDGASSVWDGVKETWSGFVDWVQDIWQGVSDWFGELWSGLVEGASNIWQGVQETWQTFVDWVSNIWNGVKEVWSIIWADIVGIVQIPWTLITSLIQAGINIIVGIFDVAGQLLGAAWQAVWTPISDFLKNTWDTMTQWISIAWNGIVTTFHTIFDPVVAWWNGIWTAISTTASNIWNSISATASSIWNSIKNTITSLVQAAATVIQNIWSTVSSWLGGIWNSISSTASNIWNSVTSSISNAINAAKSAIQSVWNSISSWITGIWNGIKNTALNLWNGITSTISSKVNDGKNAISSGWSNLTGIVSDIFNNVKSTIANIWEGIKKTVSAPIDWIRDKISGIFDNLNISIPHIPLPEFIMEGSFNPLKSQIPHLRVKWHAKGVSLLNQLY

SEQ ID NO: 4790 - protein, 233 aa, Enterococcus faecium
  misc_feature (B) LOCATION 1...233
  hypothetical: YES
TVANYELNIAHLYGNLMNTYGDNGNLLMLKYIAEKMGVSCHTEIVSIHEPFDADKYDLVFFGGGQDFEQLIISKDIQKKKDSLINYIENDGVMLAICGGYQLLGHYYMGANGEKIQGISALDHYTLSQENNRFIGDIVIHNEEFNETYYGFENHNGRTFLGEGERPLGKVVQGQGNNGEDQSEGVIYRNVFGSYFHGPILARNENLAARLIRLALEQRYGKELDLPYLEGQTA

SEQ ID NO: 4791 - protein, 196 aa, Enterococcus faecium
  misc_feature (B) LOCATION 1...196
  hypothetical: YES
RWANKMNKNKMATRVLTVMALCIGINYIGGTIALWLRLPIYLDSIGTIFAGALLGPVPGMLTGLSSGILSGVTTDIFSLYYSPIQILTGLLAGLILPRYLGKDKNSLKLLLLALILSVPGTIVSSIITVQLFGGITSSGSSMIVQLLHGLGLSQTTSVILVQAGTDYLDRLLSIVVVSLVITMLPQRLIYSKRKIG

SEQ ID NO: 4792 - protein, 115 aa, Enterococcus faecium
  misc_feature (B) LOCATION 1...115
  hypothetical: YES
GIYKNVNEVQKMNLLFQSIKSITVPELKEKLLENPALLDVRTPAEYRGGHIKGAKNVPLQSINRYDGDKEKTVYVICQSGMRSKQAAKELKKSGYDVVNVRGGMNQWFDRTVGGK

SEQ ID NO: 4793 - protein, 254 aa, Enterococcus faecium
  misc_feature (B) LOCATION 1...254
  hypothetical: YES
SVYKIGVIDMSIQISHLNVVIENLKILEDIHFTIPKDTFTSIVAPSGAGKSTLLKTLTGVQPMTSGTIKVDDQKVTGLHTAFSYMPQEDMLLPWLSVYQNVTLYQKINHLTINEEQVRDYLDIFGLNGYEHFLPEQLSGGMKQRTALLRTIMNPSSYLLLDEPFGALDAMTRGQMQDWMLKLPKKAKRTTLLVTHDIEEAIYLSDRILVLSARPAHVIAEIQVPEKRRSREWLLQQSELKQTIYQLLAGELDVK

SEQ ID NO: 4794 - protein, 126 aa, Enterococcus faecium
  misc_feature (B) LOCATION 1...126
  hypothetical: YES
MTYKIGQIIEGKVTGIQPYGAFVSLDNETQGLIHVSEVQSGYTKNIHSLLKVGQPVTVQIIDIDEYSKKISLSLRTLEKTNPAVPYRRKRYFTNKNRKIGFTTIAEQLPIWIEEALSELERKENKK

SEQ ID NO: 4795 - protein, 254 aa, Enterococcus faecium
  misc_feature (B) LOCATION 1...254
  hypothetical: YES
MDYKGYLIDLDGTIYRGTQPIPAGKRFVEELQKRKLPFLFVTNNTTKSPETVANRLADEFDIHVAPETVYTATLATIDFMKADGKGKKVYVIGEAGLIDLILAAGFTWEEEAPDYVVVGLDNYLTYEKVVKATLAIQKGATFIGTNPDKNIPTERGLLPGAGSVISFVETATQTPPIYIGKPEAIIMDKAVEVLGLQKEEVIMVGDNYETDIQAGIRNNIDTLLVLSGFTKEEDVPGLPIPATYVKQSLDEWSF

SEQ ID NO: 4796 - protein, 327 aa, Enterococcus faecium
  misc_feature (B) LOCATION 1...327
  hypothetical: YES
TIYKHTIERIETMKVSIVVPCFNEEKTVPLFFDEVEKFKGAHEFEYLFIDDGSKDGTLAAIKKLASAYPYVRFVSFSRNFGKEAALYAGLQASTGDLVTVMDVDLQDPPELLPEMINRITTSDIDCVGTRRSTREGEPAIRSFFAKKFYQLINKISDTEMVDGARDFRLMTRQMVDAVLELTEYNRFSKGLFSWVGFKTEYISYENRERVAGETSWSFWKLFNYSIDGIVNFSDAPLTIASFIGALSCVGSGIAILFIILRALLFGDPTSGWPSMVSIFLFIGGIQLLCLGIIGKYIGKIFLETKQRPVYIIRETEKVKPNELKPHQ

SEQ ID NO: 4797 - protein, 485 aa, Enterococcus faecium
  misc_feature (B) LOCATION 1...485
  hypothetical: YES
YTYNGGSIMGFRKDFLWGGATAANQCEGGYDEGGRGLANVDVVPIGKDRFPVITGKKKMFEFDEDHFYPAKIAIDMYHRYKEDIALFAEMGFKTYRMSIAWSRIFPMGDEKEPNEAGLKFYEDAFKECQKHGIEPLVTITHFDCPMHLIKEYGAWRSRELVGFYENLCRVIFNRYKGLVKYWLTFNEINMILHAPFMGAGLYFEKGENEEQIKYQAAHHELVASAIATKIAHEVDPENKVGCMLAAGAYYPYTCNPEDVWASRKSDRENYFFIDVQSRGEYPAYALKEMERNGIQIEMEPGDAALLKEHTVDFISFSYYASRVSTTDNELLEQTAGNIFASVKNPYLQASEWGWQIDPLGLRITMNDIYDRYQKPLFIVENGLGAVDTPDENGYVEDDYRIDYLAAHIQAMKDAVELDGVDLLGYTTWGCIDLVSAGTGEMKKRYGFIYVDRDNQGNGTLARSKKKSFNWYKKVIDSNGEILSND

SEQ ID NO: 4798 - protein, 680 aa, Enterococcus faecium
  misc_feature (B) LOCATION 1...680
  hypothetical: YES
MLYKLAVKSFFRQSRGYLVYFFSLTLSVMIYYSFSAMTYDQSLVRRASQDTSIDGGLSFGGFIITVVLLFFVFSANRFFLNRRQKEIGIYQLFGMNKLQISGIYVLEIMIIGLFACISGILLGIIFSKLFSMILVRMMDMDLTSPFFISIPSVVDTLFAFFIILLAVSVYSIWKIWRYPMIRSFGEKEQADSSTMRFRTRHRLLAVIGLLLLTSGYFGASHFREITSWMISYHYLDTLVFFFPFLIFFVCVVGTYLFFCYTFRLFLIILSKWKIYYYGINFLIMGNTQVHLLKSWRTNSLITVILGISLMTIGGTASISTILSYQEKVSSPMDYQFDVETEKKIKPILAEEGQKITKEITLHYKVIGSIYSQNLEEPMFQTANLITETQYQAFRKVNPDLPNISLKSPGHTVLLDQMQTLFRNISLYGSSIGLPDNQELKIQQMLPSVLGDETMVYLSPVLIVDDTVFEKAKGVDYQVVNVDVSGGNNEKIDERLSNDLSIKWLNAVYYSYDIVNGSLQGEISTKKLPDDQMKEAQFSQESSRLNFSSSYSKLRAVNRRIGINIFVTLFVGMIVIIATGSILTVRQLAEAEEEKENYHLLTKLGIPQRRIRRMIFEQNALTFFPPMILGITHAVFAINVFTQYIKTADYWLAYLVSGLLILIYLLLYVITSQLYCRIIEE

SEQ ID NO: 4799 - protein, 291 aa, Enterococcus faecium
  misc_feature (B) LOCATION 1...291
  hypothetical: YES
QMYNQKSFKGNPVYGDLYLVPTPIGNLEDMSYRSVRMLQESDLIASEDTRNTQKLLNHFEIHTPQKSLHEHNYKERVPRLIALLKEGKTIAQVSDAGMPSISDPGHELVLACIKEGISVISIPGPTAGMTALIASGLVPQPFLFYGFLPRKKKEQKETLKKLKEQTATLIFYESPYRITATLTNFLEIFGNRQVVLCRELTKVHEEYLRGSTEELLAYIEEHPVKGECCLLVEGNLFETPVTEVDEELGTLKEQVEAKIASGEKPNAAIKAVALKNGLKKQEVYRQYHELD

SEQ ID NO: 4800 - protein, 157 aa, Enterococcus faecium
  misc_feature (B) LOCATION 1...157
  hypothetical: YES
KEYKDVKGLKLKLLQLVTVSLLFGPYFQSVYHMTTLDVAAESTETKEDEVFLDEDYAKIEGKYIEKEETLEWHLAFEKKESANEGRIRLAIDAAAAGIGTVKNVRGTGLSSYDEDGEDLKVETIDGQEWYVGKVYSKEAETGTLIFETEKIPDVNEG

SEQ ID NO: 4801 - protein, 60 aa, Enterococcus faecium
  misc_feature (B) LOCATION 1...60
  hypothetical: YES
QIHNVRQSLLRKSIHAGDSINTVSCQLDVHCDVLSPIPTPFKKFYRFTLYKFFFKNSSIL

SEQ ID NO: 4802 - protein, 88 aa, Enterococcus faecium
  misc_feature (B) LOCATION 1...88
  hypothetical: YES
CSHKLYALIPKTIKKHIIVVKIIPSFLFVGNLYHSFKFVTKIIVAHLKISRKYFFYFLPFYFINFISRTLDKVRIMRSKQNRSRIYLH

SEQ ID NO: 4803 - protein, 158 aa, Enterococcus faecium
  misc_feature (B) LOCATION 1...158
  hypothetical: YES
CQHNNSRVIDSRQADDGRAIRRRRECENCSFRFTTFERIEAAPLLVIKKNGEREEFNRDKILRGLIRSAEKRPVAMEQMEQIVNHVENRVRSLGENEVSTNLIGEYVMEDLVDLDEIAYIRFASVYRQFKDMSVFLKELQDIVDKAKENNKENNKENN

SEQ ID NO: 4804 - protein, 83 aa, Enterococcus faecium
  misc_feature (B) LOCATION 1...83
  hypothetical: YES
AMHKENCSDVTKSITQNVDDRTCQWSKAQTAMTPTTEVGIPGTAHITAVNTIKSIDAKVPCERICASSSALLALGFKNNWMSV

SEQ ID NO: 4805 - protein, 275 aa, Enterococcus faecium
  misc_feature (B) LOCATION 1...275
  hypothetical: YES
NKHKGEKMMEFSMDMFRLDGKVALVTGAVYGIGFEIARSLATAGAKIVFNNLNQESVDEGIAHYKEAGIDAKGYVCDVTDEEAVQAMVQQIKEDVGSVDILVNNAGIIKRTPIIEMDAADFRQVIDVDLNAPFIVSKAVIPDMIEKGGGKIINICSMMSELGRETVSAYAAAKGGLKMLTKNIASEYGQYNIQCNGIGPGYIATPQTAPLRETQENGERHPFDQFIVGRTPAARWGEPIDLAGPSVFLASSASDFVNGHVLYVDGGILAYIGKQP

SEQ ID NO: 4806 - protein, 83 aa, Enterococcus faecium
  misc_feature (B) LOCATION 1...83
  hypothetical: YES
ILNKDRLSIFLVLCRVVRIMKRKKQVIPMYVVKVMHGYIDKTGCRTREKNLDNLLIFKDKKESEAFAKRIGGRVKPIQEVRPD

SEQ ID NO: 4807 - protein, 382 aa, Enterococcus faecium
  misc_feature (B) LOCATION 1...382
  hypothetical: YES
IVNKTKKESVERIMVEMALKNVYKKYDNAENYSVTDFNLSIKDREFIVFVGPSGCGKSTTLRMIAGLEDISEGELNIGGKVMNDVAPKDRDIAMVFQNYALYPHMTVFDNMAFGLKLRKYDKADIKKRVDNAAEILGLTEYLKRKPAALSGGQRQRVALGRAIVRDAKVFLMDEPLSNLDAKLRVAMRAEIAKLHQRLETTTIYVTHDQTEAMTMADRIVIMKDGFIQQIGTPKEVYDTPVNMFVAGFIGSPAMNFFNVTLKNGVITDGHGLKLRIPEGKNKVLVEKGYEGKEVIFGIRPEDIHSEQVALEASPEAVVKSEVVVSELLGAETMLYTKTGSTEFISKVDARDFHKPGEIVDLAFNISKGHFFDKETEQVIKLP

SEQ ID NO: 4808 - protein, 147 aa, Enterococcus faecium
  misc_feature (B) LOCATION 1...147
  hypothetical: YES
KVNKSWFSMSDCVTLNYHKLMQGRYAKFDQLNRGLLIAALVFSLLSRWLPYRIGQLLFIVFFGWMIFRFLSKKIYPRLNENQRYLKYLDRVKEKYHQIKNKKQVKMDRKSYTFFECPNCHQKQRAPKGKGRIRVTCKTCGIKFETNV

SEQ ID NO: 4809 - protein, 615 aa, Enterococcus faecium
  misc_feature (B) LOCATION 1...615
  hypothetical: YES
FSNKLFMWKCHFYCIIHLIIHFLFIKITEKRKEEINLKKTNSSGKPKRDFTKLSTPHTYVIIFGVVIFAWILTFVVPAGKFSTQDIEYKDANGETSTRTVLRQDSFRYAYELDKSYVFDQLEELQDHPAEREKLDVPEKGLEKVIADGEKNLTQEKLDEISLTDDVLYDQYGENIYDTSKKLHKTAKIWGTDDFGGFGFLNFVFEGLVSGDKYGSAVGIAALILVVGGAFGIIMRTGAIDAGIYAFISKTKGLERLALPLLFFAFSFGGATFGMAEEVIPFSMVMVPFVIALGYDSIVAVTVTYVASQVGNATSWMSPFSVAVAQGIAGIPVLSGATFRLIMWVVVTALAAGYMMIYAEKIRKKPESSLTYKSDDYFRSHIKKTSDENKKFMLGHKLILLEMLVVLVWIVWGVTQKGYYIPEIASQFFVMGLVAGIIAVLFKLDGMKVNDIASSFQSGAADLAGTAIVVGMAKGILLVLGGSDASVPSALNTILHGIGTALTGVPAVIGAWAMYIFQSLFNLVVTSNSGQAALTMPIMAPLADLVGVSRQVAVLAYQLGSGFMDAFTPVSASLIGVLGVARIEWAKWARFQIKMQGFLFVLGTIFIMIAIAIGLQ

SEQ ID NO: 4810 - protein, 973 aa, Enterococcus faecium
  misc_feature (B) LOCATION 1...973
  hypothetical: YES
VYNKKRCRSGSMKKVLVANRGEIAVRVFRACTELGIKTVGIYAEKNEYSVHRFKADEAYLVGQGKKPIDAYLDIEGIISIAKECGADAIHPGYGLLSENLNFAQRCEEKGIIFVGPKLHHLDIFGDKIKAKAAAIEAGIASIPGTDGPIASIDDALEFAKQYGYPIMIKAALCGGGRGMRVAHDEKSAREGYERAKSEAKAAFGSDEVYVEKYIANPKHIEVQILGDTHGNVIHLFERDCSVQRRHQKVVEVAPCVSMNEQQRQKICQAAVPLMKYVGYVNARTVEFLVEGDDLYFIEVNPRVQVEHTITEMITDIDIVTTQLLIAQGLDLHKEIGLPQQEGIKLNGSAIQCRITTEDPLNNFLPDTGKIDTYRSPGGFGVRLDVGNAYAGYVVTPYFDSLLVKVCTHGATFETAIQKMERCLKEFRIRGVKTNIPFMLNVITHPEFQSGNAKTTFIDSTATLFEFPRLRDRGNKTMKYIGEITVNGFPGIESGEKPFYEEPRMPKDLITRTDYVTAKNVLDAKGADALVEWIKGQENLLLTDTTFRDAHQSLLATRVRTKDFKQIARLTGEGLPELFSSEMWGGATFDVAYRFLNEDPWQRLRKIRSLMPNTLLQMLFRGSNAVGYSNYPDNVLVEFVKEAAAQGIDVFRIFDSLNWTPQMEKSIQAVRDTGKIAEAAICYTGDINDPSRAKYNVQYYKDMAKELEQLGAHIIAIKDMAGLLKPQAAYRLISELKETTDLPIHLHTHDTSGNGIITYSAASKAGVDIVDVAMSAMSGNTSQPSMSSLYYALVNGPRLPEITIENAQKLNHYWEDVRMYYKPFENGLNAPETEVYMHEMPGGQYSNLQQQAKAVGLGHRWDEIKQMYHTVNLMFGDIVKVTPSSKVVGDMALFMVQNDLTEEDIYEKGETLSFPESVVTFFQGELGQPVGGFPKKLQKIILKGRPALNERPGLLAESVDFNEVKKELAEKIGV

SEQ ID NO: 4811 - protein, 88 aa, Enterococcus faecium
  misc_feature (B) LOCATION 1...88
  hypothetical: YES
INNKSDSDSVEWNKIEVLHEIQHIDVSGGVASAVQSKLHGSSNESYRMGKYGRKNKFALIIEQHILRFFLCNQRMKTNSRTYFFVSAH

SEQ ID NO: 4812 - protein, 60 aa, Enterococcus faecium
  misc_feature (B) LOCATION 1...60
  hypothetical: YES
TSNNFNNFIFHCYFLLRYKILGKRFLYIFRIIRKLNIVKRVYFIKRVILKVSRHNVEYAK

SEQ ID NO: 4813 - protein, 68 aa, Enterococcus faecium
  misc_feature (B) LOCATION 1...68
  hypothetical: YES
FINKMMSGLTAKTRAIHTRCCCAPDKDKALLCNLSFTSSQTDAAFRRSSTTRSKTFLSFSPFNFNPYV

SEQ ID NO: 4814 - protein, 62 aa, Enterococcus faecium
  misc_feature (B) LOCATION 1...62
  hypothetical: YES
TINNIKVSFFYILKNRMALKSSVVSINLLLKKAKRRKSDVVDISLTHPLIENFLVKFTSLKI

SEQ ID NO: 4815 - protein, 62 aa, Enterococcus faecium
  misc_feature (B) LOCATION 1...62
  hypothetical: YES
TINNIKVSFFYILKNRMALKSSVVSINLLLKKAKKRKSDVVDISLTHPLIENFLVKSTSLKI

SEQ ID NO: 4816 - protein, 431 aa, Enterococcus faecium
  misc_feature (B) LOCATION 1...431
  hypothetical: YES
INNNCLALAESEEEFFMGLIKAATSMVGGGLADQWLEVIEPDNMSDTTVMTKGVKVRKDDKRGSNRKGTEDVLTDGTVVHVYPNMMMLLVDGGKIIDYTAEEGYYTIKNDAAPSMFNGTLKEAIAETFDRFKFGGVTPQKQQVFYINLQEIKGIKFGTSAPLNYFDNFYNAELFLRAHGTYSIHVVDPILFYTNAIPKNKTQVEINDINEQYLAEFLTALQSAINQMSADGQRISYVPSKSLELSKYMDTALDDSWRELRGMEIVSVAVASISYTDDSVKLINMRNEGAMLGDPSVREGYVQGSIARGMEAAGKNEAGAMTGFMGVGMGMNANGSYLSQAAQNNQEQIKQQAEKQNQQTAQGNADTWTCPVCGTENSGKFCSNCGAAKPVENVQPKLQMRCSECNEIVDLSNGIPKFCPNCGKPFKGIPVD

SEQ ID NO: 4817 - protein, 234 aa, Enterococcus faecium
  misc_feature (B) LOCATION 1...234
  hypothetical: YES
QTNNDFSLITPSKGAVFMEKTKFNRTYEILNEVFNAVTHGIGTGLSIAGLVVLLVKGAHLHSSLHIVSYAIYGSMMILLFLTSTLFHSLIFTKAKKVFQVFDHSSIFLLIAGSYTPFCLLSIRGWLGWTLFVLIWLFAILGIIYKALTLHKRERVSKVSTIIYIFMGWLCVVAAVPLYHSLGMTGVILMVAGGLSYTIGAFFYSLNSIRYMHVVWHLFVMLGAGFMYFSVLFFT

SEQ ID NO: 4818 - protein, 64 aa, Enterococcus faecium
  misc_feature (B) LOCATION 1...64
  hypothetical: YES
LKNNFCHSLTPKITLFTYEVGRRSNPELGYGTSTRTSPLELKSMRFTFRNDGRFIQLCVQSKFV

SEQ ID NO: 4819 - protein, 141 aa, Enterococcus faecium
  misc_feature (B) LOCATION 1...141
  hypothetical: YES
FRNKGERKMSRQLVLISHGKFCEELKKSTEMIMGPQEDIYTLPLLPEDGTETYKQKFLTVTDSLNDFVVLCDLLGGTPANIIAKLIMEGQQITLYAGMNLPMVIEFINSQMIGSEPEFVRAGCESIVSVNELINGIAEEEE

SEQ ID NO: 4820 - protein, 82 aa, Enterococcus faecium
  misc_feature (B) LOCATION 1...82
  hypothetical: YES
EGNKMAQQRKSGRKRRKVDYIAANHIEYIDYKDIELLKRFISERGKILPRRVTGTGAKNQRKITVAIKRARIMGLLPFVSED

SEQ ID NO: 4821 - protein, 286 aa, Enterococcus faecium
  misc_feature (B) LOCATION 1...286
  hypothetical: YES
EGNKMKIVIVGGVAGGMSAATRLRRLMEDAEIVVFEKGPYVSFANCGLPYYLSGEISERENLLVQTPESLSARFCLDVRPNHEVTAIFPENKTVEVVHEGQKHIEQYDALVLSPGAKPVVPSIPGITEADNVFSIRNVPDIDKVMHALEKQPKRAVIVGAGFIGLEMAENLKRRGLEVMVIEQAPHILPTLDEEMAAFIEKELSHQGVEVITSHAVAGFEDHGKRLRLDDGRTIPADLVILSIGVRPDNQLAVTAGIQLGIPGGILYNNVIKRIFLIYMRWGMLSL

SEQ ID NO: 4822 - protein, 527 aa, Enterococcus faecium
  misc_feature (B) LOCATION 1...527
  hypothetical: YES
VMNNPKLKQQVDNRRTFAIISHPDAGKTTITEQLLLFGGAIRQAGTVKGKKTGNFAKSDWMEIEKQRGISVTSSVMQFDYQGKRVNILDTPGHEDFSEDTYRTLMAVDSAVMVIDSAKGIEAQTKKLFQVVKKRGIPIFTFINKLDRDGREPLELLEELEELLDIESYPMNWPIGMGKGLEGLYDIYHNRVEFYRPENYQDERLVELDEDGLLPENHPLTENSLYEQVLEEVELIKEAGDAFNQEKIARGDQTPVFFGSALTNFGVQTFLETFVELAPAPYGHKTQDDQMVSPYEEEFSGFVFKIQANMNPAHRDRIAFVRICSGTFERGMDVWLERTNKKLKLSNVTQFMADSRENVEKAVAGDIIGVYDTGNYQIGDTLFEGKLKGAYGVLPSFTPELFMKVTAKNVMKQKSFHKGIYQLVQEGAIQLYKTYLTEEYIIGAVGQLQFEVFQYRMLNEYNAEVIMSPMGHKIARWIDPEDLDEKMSSSRNILARDRFDQPLFLFENQFAERWFADKYPNVKLKSLM

SEQ ID NO: 4823 - protein, 325 aa, Enterococcus faecium
  misc_feature (B) LOCATION 1...325
  hypothetical: YES
NMNKELNITQEWDKVFPKSNQVNHRKVSFPNRFGITLVADLYEPKEVSEKKLPAIAVSGPFGAVKEQSSGLYAQTMAERGFLTIAFDPSFTGESGGVPRYVASPDINTEDFQAAVDFLSVQKNVNPERIGIIGICGWGGMALNAAAIDTRVKATVVSTMYDMTRVTANGYFDVMDENARYEMREELNAQRIIDFKQGDYARAGGVVDPLPEDAPQFVKDYHAYYKTDRGYHVRSLNSNDGWNRTSGLSLMNAKLLHYIPEIRHAVLVIHGEKAHSRYFGEDAFKELKGDNKELMIIPGASHTDLYDQTDIIPFEKMATFFEENLV

SEQ ID NO: 4824 - protein, 87 aa, Enterococcus faecium
  misc_feature (B) LOCATION 1...87
  hypothetical: YES
NMNNETIILGKKYICQPIGLKQKVVGEVISKLENCVVICVDEYHDVDRNEILEKCGKVVAKYTHVYELETTEYLYNYSNKYEHTLVS

SEQ ID NO: 4825 - protein, 453 aa, Enterococcus faecium
  misc_feature (B) LOCATION 1...453
  hypothetical: YES
NMNKSLRLVIKRNECAIRLYPCHFSFNYLSNFISHLLPSLRIYHYTVNSSKKEATKMTGGLKMIEFDKQISRKDTESVKWDAIAETYQMDDLLPLWVADMDFLSPGGVAKAFSEYIKHGIFGYATLSDKLYQAIIHWERQHHAVELTKENIVFTSGVLTSLAAAVQTFTKPGDSILIHDPVYPPFSSIIETNQRHIVRSSLLEKNNHFIMDLSDMEKKIEENNVKAMILCNPHNPGGRVWSKEELKQLSELCLKHQVILFSDEIHQDLTLFDHTFTSMLTIDPNLDDLLVAFTSATKTFNLAAIKNSMVFIKNPEMKADFEKHLVMNQQHEINTFGLIGTQAAYETGGEWLSQLIPYLEKNVQTVNQFFEQYLPKVRIMNPEGTYLMWLDFTAYISDDQELENTLVRKGKVVLNPGITFGPSGHGHMRLNIACPEETLLEGLNRIKYALETID

SEQ ID NO: 4826 - protein, 225 aa, Enterococcus faecium
  misc_feature (B) LOCATION 1...225
  hypothetical: YES
IMNNRIPIFEYRKKARVSLVNQWGINTWLVFLSIILTSVIQNFFDGFSPFPEESMQQHLLSFLVDNLLLFAFNYALFYIALVVVRGGRPKSNLLFSVFQRKYFGSILGINLINSVINWLLNSLIFLPMFLISGVSTYMQLLFSSNAVPTGVMPEDFLDISFVLSMIGMIFVSALIMSIVGGLFQFAAWTKFDYPDLSVIQCLKYGWFLLKDRIGTYILLQLSFIG

SEQ ID NO: 4827 - protein, 117 aa, Enterococcus faecium
  misc_feature (B) LOCATION 1...117
  hypothetical: YES
MANNRRLEETFNDGWLKILTQTTKRNELGKKIGVEDTEITSLKFRNLSMRDSDITAMDAMGSKLTKKVKTPFHPIAKKFNKDQYFIVIDSMRYNVIYADYDNFYIYFYLESVGEYGD

SEQ ID NO: 4828 - protein, 238 aa, Enterococcus faecium
  misc_feature (B) LOCATION 1...238
  hypothetical: YES
EENKMTETTLYIVRHGKTMFNTIERVQGWCDTPLTKQGQEGIHYLGRGLKNVDFSFAYSSDSGRAIETARIILGEHSKGKEIPYFIEKRIREWCFGSLEGGYDMEMWGVIPRVLNFKTYDEMFTTEVSFEQIANAVYNLDTAGWAETYETLRDRVWTGFEDIAHHCEKNGGGNVLVVSHGLTIAFLLNLIDPKQPVRAGLLNGSVTKVTYANGRFSIHGINDTSYIDNGKTHSRDSFL

SEQ ID NO: 4829 - protein, 121 aa, Enterococcus faecium
  misc_feature (B) LOCATION 1...121
  hypothetical: YES
KRNKTFLWQNKLLAMRRVSYTILKVSKGGLAMNTYVEITDGTTNNYFYAFVEFKGSVLTLYSFQGLNRNIVKEIPMNEIENLTKDIYWGGQRISFSHEGKMYQFFECGPAVVDYLQENLFV

SEQ ID NO: 4830 - protein, 205 aa, Enterococcus faecium
  misc_feature (B) LOCATION 1...205
  hypothetical: YES
KGDNMKLTVQEIQEWLTQFAEAINQNKQYLSDLDTPIGDGDHGNNMGRGVSAYEEAFQADHPETISDTFKVFSMAMISKVGGASGPLYGSAFMNMMKATKEVDSIDSQEKLGEVIEQGTAGIQSRGKAEADDKTMLDVWLPVTEALKAGNLTKEIIDQAKEHTKVLVAKKGRASYLGERAIGHIDPGAASSAILFSTLLDVINQP

SEQ ID NO: 4831 - protein, 763 aa, Enterococcus faecium
  misc_feature (B) LOCATION 1...763
  hypothetical: YES
MIDNLITIYDKNDANNLAEHLYDTQGLGALSDWLTATVSNKLNGAEIFQGTYSINGTNADLIVDGRIIQCYVDENRAKQRLRIYYAKTSVIGNTIEVKAEPIFNDIRKSVLNKYDSGTEKITATQAWQNAKVLAKPAIPSQFSFSSLVDTLANVKIEKANFLEFFGGKEGSILDRFHGEFLKDNNTLRHEKSLGTDHKIKAIYTKNLTGLDLEIDAQSVLVGVYPFISSSSEGEDEITLPEEVIFTDYVDDYPAGYVSFVDFKDKATDVATLREAAKDWLKTNIDKQKPQVSGSIELVPLRHQRGYEKFVDLEKVSMGDGVDVYHPQLKVNMSARIVEYTFNVLTNSYDKLVVGNVKTNFLENTENNVSNLINDAIDQLKNGGEISDLLNDIVDHQTDMITGQNGGYVLLDPKEAPSRILIMDTPDKNTARNVLQINNAGIGFSKTGINGTYETAWTLDGGFNASFITAGEIVGITIRGTTLISDGADYRTSIANGKMTWYSKKVNKDIMELEARDYVSADAGIVSYTMKTGGGFMIRNPQGNLVFSTWDNGNNRPFLSFGAPNFRYSNASYVTSGDGSSLSINGSAGNSWEFKVAGRTMKFTSDGMLTLPGCFFGSWEDGKLARFEQSTVQVYKDFTVRGTKNSTVPTEHYGQRLLNAYETPEYYFADYGEAVTGDNGKVRVDIDPMFAETVNLSRYMTHVTPTELVLCAVTHEDIDHFIIETSKPNVLVRWNLVAHRLGYEDIRLKEDTAYDSTVLDQKRF

SEQ ID NO: 4832 - protein, 114 aa, Enterococcus faecium
  misc_feature (B) LOCATION 1...114
  hypothetical: YES
VLDKNLLCFLYRKKLRKYNFLVNVFLSFFYLISHLFLLNTRRNRGNLFIISGSFSFLRSNKYSTNVVKCLKIESAEKNKILNNKSDTAEIPVIENSLCKKTTEKKIPLAQKRMI

SEQ ID NO: 4833 - protein, 104 aa, Enterococcus faecium
  misc_feature (B) LOCATION 1...104
  hypothetical: YES
FSDKKEYFYEITKMACIIKKRPRRTSYNKIAFKILIERRKYYNVRKEMNKMKNLIAGGFLFVGGGILMNTDNFGNVIPFLGAACALIGVGMLIYFVFSDDGKYG

SEQ ID NO: 4834 - protein, 64 aa, Enterococcus faecium
  misc_feature (B) LOCATION 1...64
  hypothetical: YES
DADNNLANKDVDVLLLGPQVRFMKADFEKRLEPKGIPLDVINMADYGMMNGEKVLDQAITLIGE

SEQ ID NO: 4835 - protein, 141 aa, Enterococcus faecium
  misc_feature (B) LOCATION 1...141
  hypothetical: YES
KKDKEGEKMKKNELFRDWEFRYRYIYRKRRTKKSKQRFLSALVSDIYSMRTDVTVIAYDTLAYRSKNIYVGDIEKAEKVICTYYDTPVHALGSYFMFDWKDQRKKTIYSILLSFILLFSLGWWGMMIYNKNPHHVFDLLSV

SEQ ID NO: 4836 - protein, 149 aa, Enterococcus faecium
  misc_feature (B) LOCATION 1...149
  hypothetical: YES
PMDNSRKIEADYVQLDELLKNSDIVTLHVPLCADTRHLIGQRQIGEMKQGAFLINTGRGALVDTGSLVEALGSGKLGGAALDVLEGEDQFVYTDCSQKVLDHPFLSQLLRMPNVIITPHTAYYTERVLRDTTEKTIRNCLNFERSLQHE

SEQ ID NO: 4837 - protein, 262 aa, Enterococcus faecium
  misc_feature (B) LOCATION 1...262
  hypothetical: YES
IVDKTAHDVVQLARAKERWTSLDFFEEIFDSFEECHGDRLFADDEAIVGGIARLDGKPVTVIGIQKGRDLQENIRRNFGSPHPEGYRKALRLMKQAEKFNRPVITLINTAGAYCGVGAEERGEGEAIARNLLEMSDLKVPIIAIIIGEGGSGGALALGLADEVWMLEETIYAVLSPEGFASILWKDGSRAAEAAELMKITAPELRELGIVDRVIPETFNGEQLPRYKVAHIMKKALIERLTELVRLDQHKLLEKRYKRFRQY

SEQ ID NO: 4838 - protein, 67 aa, Enterococcus faecium
  misc_feature (B) LOCATION 1...67
  hypothetical: YES
FFCNKGTKKDNSIIIPPKGIIINHPIIGIQKPKLRSISPIKKSIQPFDLGDVTETLLLPQFLHVIIC

SEQ ID NO: 4839 - protein, 244 aa, Enterococcus faecium
  misc_feature (B) LOCATION 1...244
  hypothetical: YES
HYCNRRNNKMSVHIEAKEGEIADKILLPGDPLRAKYIAETFLEDPVCYNQVRGMLGFTGKYKGERISVQGTGMGMPSATIYAHELIQSYGVKKLIRVGTCGALSKDVHVRDLVLAQGAATSSSMIEKNFQAFHFPPISDFNLLLKAYEIAKEKGYTVHVGNVLSEDSFYKDDLTETFQLAELGVLGVEMEAAALYYLGAKYHVQTLSLMTVSDHLITGEETTAAERQSTFNEMIEVGLETAIAE

SEQ ID NO: 4840 - protein, 392 aa, Enterococcus faecium
  misc_feature (B) LOCATION 1...392
  hypothetical: YES
EDCKMRYMTAGESHGPELTAIIEGLPAGLPLSEEEINHELARRQAGYGRGGRMKIEKDRVRITSGIRHGKTIGSPVTLVVENKDWKNWTTVMSVAEVPEKDQSLRRVARPRPGHADLVGGMKYHHRDLRNVLERSSARETTMRVAIGAIAKKILEELDIIVAGHVICLGGIQAEIPGNISIQEIKEISEASEVRVVDPAVEQRIKDLIDQTKKNGDTIGGIVEVLVGGVPAGLGSYVQWDTKLDAKIAQAVVSINAFKGVEFGVGFTSGSLPGSEVMDEILWEEERGYFRRTNNLGGFEGGMTNGEPLVIRGVMKPIPTLYKPLQSVDIDTKEPYKASVERSDSTAVPAASVVAENVVATVVATELLSKFPSDSLVELKAAVKEYRDYLKHY

SEQ ID NO: 4841 - protein, 306 aa, Enterococcus faecium
  misc_feature (B) LOCATION 1...306
  hypothetical: YES
KICNEEGPCRMKSMTGFGKAIRETKAYQLDIEIKSVNQRFLDVQIRSPKILNFVENDFRQLIKQQLSRGRIEVFVNLAYIGKNEKQIVINWELIDSLITQLTDGIQQRYGSQNQVSISRMAERFALDENFVTVEEKPEESMEELAQLALDTLKSALDSIEASREKEGQALALVLKKNTEEFKEVLKKLDSFVEIYEKEFQIRYQKKLEEFLGAKVDEQRLLTELAILLERGDIHEELDRLAIHVQKLDELIEAQCPVGRELDFLIQEMNREINTIGSKSNAIEIKNQVVQSKTILEKIREQVQNIE

SEQ ID NO: 4842 - protein, 229 aa, Enterococcus faecium
  misc_feature (B) LOCATION 1...229
  hypothetical: YES
IKCKMRAISFKKDYRLLILAYIIHWKGGDPMNLKNTNSNKSTLYVISDDYINKLKKVDYRVQNNYREQRLYFKSNLKISNKNEEINYYVPLASAKENQRSLTNKSVFKIYGDREEKDFLGVLHINNMIPVPKDCAKVWTPNSPNVDEKYKMLVIKQAKYLKLHESEINESCELLYNSKLGKLDPSYFKKNRKEVITYQKIMTNVESLEAVSIAESQRNIHVQTQSIDVE

SEQ ID NO: 4843 - protein, 157 aa, Enterococcus faecium
  misc_feature (B) LOCATION 1...157
  hypothetical: YES
WECNSMAMIKFDHVDKYYGKFHALKNINLEFEKGEVVVVIGPSGSGKSTMLRCINGLETISSGKLLINDTDLHDKKTKLTEVRKNIGMVFQHFNLYPNKTVLENIKLAPIKVLKQDQATAVKNAEKFLKTVNMLDKKDLILPCYPGDNSNGWQSPEV

SEQ ID NO: 4844 - protein, 329 aa, Enterococcus faecium
  misc_feature (B) LOCATION 1...329
  hypothetical: YES
RISKGGRSVTKLIEFKHVQKKYDGKYVIDDLNLAIKKGEIFVLVGPSGSGKTTTLKMINGLSKPSAGDIYFKGKSLNEYNLQKMRWNMGYVLQQIALFPTMTVKQNIEVIPEMLGWEKQKRADRVDELLQKVGLSPDIYRDRMPRELSGGEQQRIGIIRAIAASPDVILMDEPFSALDPISRNSLQELVLSLHEELGTTIVFVTHNMEEAIKLGDRIAFMKDGEIIQCDTPEQLLMNPKNDYVRHFFDEPKQTKEWRVEDLVVNGYFLNEIPENARQQVCFDTPMKEVYSLLSVYPSIVIVEKQRSIGSLTSKEIFAFLSREEEGNENI

SEQ ID NO: 4845 - protein, 342 aa, Enterococcus faecium
  misc_feature (B) LOCATION 1...342
  hypothetical: YES
WSSKGGFCLDLKKAKKVSIVDFCKQNGIGLKQDSREYYRLEDHDSCVISDRKNLFKWNSKDLGGDIFDFIKAYYDCSFKEAKQKLEDSDYEVHSFNTKVKKAPYQYQKENEVPVSVAKSYLVNERRIDTALVEDFLSKGLIKQDKKGNVLFLWKKDQEIVGCTEQGTRKFFHEGKQKDVTWKKIQENSKEYSGFNVTFGQPDKMYFFESEIDLMSYITQKPEKAENATFVSMNGLKVGNVLHGVTEHYNKFKSLPSETVLCVDNDKAGRTFIETEFKEKGIGREGIGISEVKVDVPLREGFDWNDNLTRGKEAFKRFKLEDVSKIVNFTHKLSLNTPVYEME

SEQ ID NO: 4846 - protein, 241 aa, Enterococcus faecium
  misc_feature (B) LOCATION 1...241
  hypothetical: YES
NNSNNMTLEDLFMKILIADDDKEIVELLSIYVHNEGYEAVKAYDGKEALSKIRTIPDIELLILDIMMPEMDGMQVVKELRKESQIPIIMLTAKTTDMDKIKGLVAGADDYVTKPFNPLEVMARVKSLLRRTKMQIAPDQPDVLEVNALIINKDSHEVKTIDGKEIQLTALEFGILYLLASHPNRVFSADEIFERVWKQESIVSAKTVMVHVSHLRDKIEEATGGEKVIQTVWGVGYKIDAR

SEQ ID NO: 4847 - protein, 130 aa, Enterococcus faecium
  misc_feature (B) LOCATION 1...130
  hypothetical: YES
QSSNDLKKSRCSVYFVYRMYWEEIYFWEEIVMSKSEEIENMVLKLYDLVLNPEIKEKERILLIDAKTGLEKGQYYPKVINNLERSLRPLAIRGELSKPVSPFYMEISTIGKFEKELGRGMASAPITFGHL

SEQ ID NO: 4848 - protein, 444 aa, Enterococcus faecium
  misc_feature (B) LOCATION 1...444
  hypothetical: YES
SYSNRLAENNPEILVERRVKIIQAIVQKFVNKMSVGFLLLLLTLVFFVWTAGVGFPATLFIYNNSSLLIAFSVAILLILNVYKAKGVDFLYLGVALALFIFFSYFRELRNESLFGDLLFPLIILFCLVIKWIEWTKWDRGIYLIVFTVFLGITLYRVFTEIQVPEGQSIWAPGNSLSDIWINTNTIGSSLMTLALLISGFASSFERWYVRIIGGIAVVAAFLGIWVCQSRGALVALIVFAILDLLPKSLMRVIRAPFIAYTVTILLALPISYLAAVSEKVNLFTGREDIWHKFYQTLGEKSEQVLLGMKTFIFQRGNQFLGNHNSYNSILNIYGLIGFGIAALLLILFIGRLTLKADLSNGQMTFIWAFFAVMMQSFMEDTLTSYPWVPIIYILLAMAVHRYDEPEVTEEFYVMEEAYDDMTYDDTSYEEQPDSAHSSRIQRYH

SEQ ID NO: 4849 - protein, 280 aa, Enterococcus faecium
  misc_feature (B) LOCATION 1...280
  hypothetical: YES
NQSKGQIKCHCCDHLIPPLFCFKMYTYFFNRSLHMKKYFIIEDNQFHSEWIIRELVNHHIENIVQLTSISQINQLIQLGTIDNHDVFFIDIDLKQSLTGIDVAEQIRKKNAHSNIVFFTAYTNFAVEIINRKILPIGYIRKDRNLSEQIRQVLEQINWKEQQIVNVDKIFIDQKGGSLVLYPREILYIESIKGLKNQVMVKTTTEDKLVNTSLKQLKTELEKYAYFLLLKSYCINLSQLQKIDSAHYVLEFFNGDSLLVGRKIFEKTKERFHDFQKTASS

SEQ ID NO: 4850 - protein, 166 aa, Enterococcus faecium
  misc_feature (B) LOCATION 1...166
  hypothetical: YES
WRSNILWKSIDRRRSKSIIEQIIKQRKVGNSFMKKPKVAFVCVHNSCRSQIAEALGKYLSSNVFDSYSAGTETKPQINQDAVRLMKEMYQIDMEKTQYSKLLSEIPQVDIVITMGCNVNCPTIPCKYREDWGLNDPTGKNDDEFLKTIHSIHAKILELTEKIKIMR

SEQ ID NO: 4851 - protein, 384 aa, Enterococcus faecium
  misc_feature (B) LOCATION 1...384
  hypothetical: YES
KMSNRMILNETSYFGKGAIESIVPEFQQRGFGKAAVITDKGLIEHGIATKVTELLDKAAIAYALYDGIVPNPTIQNVKDGVAFVKEAEADCLIAIGGGSPIDTAKAIGIILTNPEFSDVISLEGVADTKNPCLPILAIPTTSGTAAEVTINYVITDEVNHRKFVCVDPHDIPIVAFIDSDMMMGMPKKLAASTGMDAMTHAIEGFITKGAWEMTDMLHLKAIEIIGHSLEVSVDGDQNGREKMALGQYIAGMGFSNVGLGLVHGMAHPLSAWYNIPHGVACAALLPTVMKYNKEYTGEKYREIALVLGIKGAAEMSLEDVREAACGEIDRLSKAVGIPETISELGVKEADIPAIAEDALRDVCTPGNPRETTVEEIIALYQSLM

SEQ ID NO: 4852 - protein, 483 aa, Enterococcus faecium
  misc_feature (B) LOCATION 1...483
  hypothetical: YES
KRSNTLIFIKQYKKKEGRFMFLSDDFLLKDDWAKKLYHSYAKNMPIIDYHCHLDPKEIYENNNFSNLTEAWLGGDHYKWRLMRACGVPEEKITGNASDFEKFLAWCQTVPKIIGNPLYSWSHLELKRFFGIDLLINEENAEKIWTQANEILAAPDFRRREIAKKSNVEVICTTDDPADDLHYHQLLAHEEPDLKVLPSFRPDKALNIEKEGFNAWVTLLEEAADQTITTYQELIEVLGQRIEYFHQHGCRVSDHALDILRYKEADETVLEEIFQKARANKLLSSDEIDAYRTETLIHLTHFYHSHNWTMQLHIHAYRNCNTQMLEKLGPDTGYDGMNDLSLTIPLQKLLNRAEETDQLPKTILYSLNPNDYPAILALMGCFQKEQNGKLQLGSGWWYNDTRAGMRDQLTQFADGSALGNFVGMLTDSRSFLSYTRHEYFRRVLCEFLGEMVMRGEAPEDEQLLGSLVQAISYTNAKNYFGFFA

SEQ ID NO: 4853 - protein, 83 aa, Enterococcus faecium
  misc_feature (B) LOCATION 1...83
  hypothetical: YES
RCGKTHWRTEPTYVEKCGDEVWVAEKFQTNLEIAGSLRNSFRASLGIENDGGRALFGLGAHLGLPNSDKLRMPFIHIRESDCE

SEQ ID NO: 4854 - protein, 83 aa, Enterococcus faecium; identical to SEQ ID NO: 4853
  misc_feature (B) LOCATION 1...83
  hypothetical: YES

SEQ ID NO: 4855 - protein, 193 aa, Enterococcus faecium
  misc_feature (B) LOCATION 1...193
  hypothetical: YES
KAGNDMKQLSSAQVRQMFLDFFQSKGHTIEPSASLIPVNDPTLLWINSGVATLKKYFDGSVVPENPRITNAQKSIRTNDIENVGKTARHHTMFEMLGNFSIGDYFKNEAIHWAWEFLTDPKWMAFDPEKLYVTVYPKDTEAKRIWHEEVGLPLDHIIDVEQHFWDIGARPCGPDTEIFYDRGRSLGPFTRRRS

SEQ ID NO: 4856 - protein, 261 aa, Enterococcus faecium
  misc_feature (B) LOCATION 1...261
  hypothetical: YES
KEGKIMINLGIIGTNWITHQFVQAALSTKKYELTAVYSRHLEKAQEFGSHYEGDIEFATDLKTFFNITHMDTIYIASPNSLHFSQAKQAILAGKNVIVEKPAFSTPKEMDEIIHLANEHNVYFFEAARNIHESGFKKIADYLPLKDEIIGANFSYMKYSSRYDQVLDGEEPNIFSTHFSGGALMDLGVYLVYAAVAWFGMPKEVHYFPRKISTGVDGLGWGILRYENFDVSIQPGKIGDSYLPSEIYFDSGTLVMNGVKCN

SEQ ID NO: 4857 - protein, 141 aa, Enterococcus faecium
  misc_feature (B) LOCATION 1...141
  hypothetical: YES
EGGKRSMVMTDPIADFLTRIRNANMVKHESLEVPASKIKRDIAEILKREGFVRDVEYIEDDKQGVIRVFLKFGKNGERVITNLKRISKPGLRAYVKADEVPKVLNGLGIAIISTSEGVVTDKEAREKNIGGESYRLRMVIK

SEQ ID NO: 4858 - protein, 542 aa, Enterococcus faecium
  misc_feature (B) LOCATION 1...542
  hypothetical: YES
VIILKYFNKKNLLKKLSVQKKNVSMQTINEGLEILNQVIQEVKNENGTTLAGKDIFKLYDTYGFPVELTEEVAEDEGLKVDHAGFEKEMDAQRERARSARSTEKSMGVQSALLTDIKVESKFIGYTEQESDSQLLVIVKGESLLNEVAEGEAQMIFDQTPFYAKMGGQVTDQGWIMNEVREIVTVVTDVQKAPNGQFMHTVEVKAPMSEGQTYHLLIDQSMRNRIIKNHTATHLLHKALKEVLGEPCKSRWFFNRSWNFTIGILPTFGQITSDELAEMERIVNEKIWEAIPVETIETDIDTAKDMGAMALFGEKYGHDVRVVNIGGWSIELCGGTHVANTENIGIFKIVSESGIGAGVRRIEAVTSKEAYELLEEEEKQLKQVATIVKSPQLKEVVSKAEQLQQQVRELQKENEQLASKLANQQAGDVFKDPETINGKTIIAAQVKVKDMNQLRQLADQWKQKNISDILVLANEQEGKVSLLAAMTKESNEAGLKAGDLIKAIAPKVGGGGGGRPDMAQGGGIYRVGIQDPLKAGKEWVAQQ

SEQ ID NO: 4859 - protein, 110 aa, Enterococcus faecium
  misc_feature (B) LOCATION 1...110
  hypothetical: YES
EFILQDLFISCFFHKINKIIKKHFAYLTEDSRALYSGQDLHFFEESERSGKGLSKRKPFRITNIVLPSCPTTPRGRFKNCRKLEAINKRITRIEKIIFCLMIRRIFKDSR

SEQ ID NO: 4860 - protein, 454 aa, Enterococcus faecium
  misc_feature (B) LOCATION 1...454
  hypothetical: YES
PLILGRWLLRGFSFSTIRSRGDYTMARKKRNPDAEKLAESILNAYQPESVDDMQDALKDVFGPLFEKMLQGELNNHLGYDAHSKEPKEHDNRRNGYGTKTLKTSFGEVAIDVPRDREASFEPELIPKRKRDVSDIEGKVLSMYARGMSQRDIAATVEAIYGFDISHEMISDITDAVLPELEEWQARPLAKCYAFLFVDCMYVTLRENYEAKEYAVYTILGYDLKGNKEILGLWLNQTESKNRWMQVFDELKARGVEDVFFISMDGVSGLEEGAKAIFPSVIVQRCIVHLVRNALRYIPSKDYKEVCRDMKKFYGASSLNAAHAAFDSFQNRWSHYSGAVDVWKRNFAHVEQLFDYGSAIRKIMYTTNAVESVHSSFRKVTKKGAFSNENALLKLLYLRTKELHAKWSGGRIQNWAMVLNQLMINETFSSRMKSMRFTFRNNGRFIQLCVRSKFI

SEQ ID NO: 4861 - protein, 161 aa, Enterococcus faecium
  misc_feature (B) LOCATION 1...161
  hypothetical: YES
PSILGGWLLHGFYFSKIRSRGDYTMARKKRNPDAEKLAESILNTYQPESVEDMQDVLKDVFGPLFEKMLQGELNNHLGYDAHSKEPKKHDNRRNGYGNKTLKTSFGKVNIDVPRDREASFEPELIPNRKRDVSDIADCRQKLFQTRNSSLEQLFIYFVSNF

SEQ ID NO: 4862 - protein, 92 aa, Enterococcus faecium
  misc_feature (B) LOCATION 1...92
  hypothetical: YES
SSFKFTSVSSTVPVEIGSKALAGSSSSKISGFIAIARAIHKRCCCPPDKAKALLSKLSFTWSHKAACFKLVSTISSNFLSFFSPCCFKANVI

SEQ ID NO: 4863 - protein, 80 aa, Enterococcus faecium
  misc_feature (B) LOCATION 1...80
  hypothetical: YES
KPFNWWYTYKWNFVINAFVAFQQVFKERRMAMTFYNKDIQYRVTLDTDLNLFVVFDKENTNHVATGVTIEQAVQELKKSA

SEQ ID NO: 4864 - protein, 944 aa, Enterococcus faecium
  misc_feature (B) LOCATION 1...944
  hypothetical: YES
YNFKRTLEAGEEEDILKPRTYAVVDIETTGTNPKEDRIIQFGCVMIEAGRITSRFSIDIHPGRKISKQIQHLTGITNQRVQKAPYFEDVAQTIYNLLADTIFVAHNIYFDYNFLNHELMRCGLPSLKIPGIDTVELAQIFLPTEPSFRLADLSESLGFIHENPHQADSDAEVTGQLLLLIEERMRKLPIITLEQIARLSSHTGMDTSRFIYHVLEEMKENPEPLDLSLEIIDGLALQKKEVELFTSVHYGERTYPRKKQAKEKMFGKTLMYRKEQNRLMNAVYDHFTKDESKDLMIEAATGMGKTIGYLLPLSYLATPEKPAVISTVSLVLQQQIMEKDIPLLNQLLEQPIQPVIIKSYRHYIDLQRFKGTLVEPPGQKQYALYQMAVLVWLTQTKTGDLDELHLTNLNHAFFADVAHRGTEFLARNQSFYKQDFVRFLQKKIKQSNFLIVNHAFLVQETQRKEPLLPASPYLLIDEVHHLPEIAEKVNDKRLSINYFHKQIQQLEEPNQLFDRIQSYLPKEHEALRWLSIYREELSALCEAQICVAEGLMNLVSSKQPNGQYPEEVMMTKEMLDQLPLESGTAMDHLQLFYQEIQQLQSQMRLTFEIIQESWTNQMRIDLASLYSLFDQLDKQYLLMDQWLEDWRDHLIHWFVPGNTAQQMIFHLHDFQAAMLPSTVWYPRYDHILYIGGTLKIGPNRQYLSKRLGIEAAPLKVIASPYDYEKQARIYVPKEAPAVHQVSNQAYIDYLEAALTGLIEQEDRPILVLFTSHDVLQKVYQKMHLSMLEKGREILAQGFGGSREKLLKRFILSEKSVLFGADSFWEGVDLPGDALQIVVVTRLPFDNPLRPMVKARNAYLESEGINPFYQESVPKAALKLRQALGRLIRTETDRGVLLILDRRLVTAKYGARIIHALPKKVPIKELAMDEIYQDIHEFLKKNEEGS

SEQ ID NO: 4865 - protein, 552 aa, Enterococcus faecium
  misc_feature (B) LOCATION 1...552
  hypothetical: YES
TNFNKGGAIMKMGIWLRKAVLFAAVLGALGAVSKTVEASASEFIRGADISILSDMEKSGAKYYEDDISKDALEILKNNGVNYVRLRLWQDPYNSNGESYGAGTNDLETTIDLAKRAKNLGLKVLLDFHYSDFWVDPGKQNLPKAWQGLTFEEMNTALYDYTKNVLSEMKQLDVYPDMVQIGNELNSGMLWPYGKSWGEGGGEFDRLAAFLKSGIQAVRDTQPKTTPVMLHLADGGDTGAFTWWFDEITSRGVSFDLIGVSYYPYWHGSMNELQTNMNAISQRYGKEVIVVETAYGHTTANADTMPNAFGEAEAAAGGYEPTPTGQAEYLLDLADRIQAVPNNRGAGFFYWEPLWYNGNVSWATQAGMNYLSVQSTMGNEWDNQAMFDFAGNALPSLRAFKQAGAQINLVKNASFESDGPTTSPSNWQTWFQQGTAKGTIKTEAGTFFGDYKLTFWQDQAYEASAYQNVSGISKGTYTLSAYVMSGGEFDTNQLYIKNYGGAELNTAVVKTSEWTKITIKDIPITTGVCEIGVYSKASGNAWTNVDFVSLVKQ

SEQ ID NO: 4866 - protein, 289 aa, Enterococcus faecium
  misc_feature (B) LOCATION 1...289
  hypothetical: YES
LDFKKIEWIFFVAFLGLNVFLFSSYHDAVYQENNVIRSNQTESIQQRLASDDITYTGKISSENKQGYYLSAEQTNLSTSLANYRKAGKSGLLASGVFLDGDVLTKSLSSSDAEKNVIDPDKISSSLEDFLSNKDNILFGNDYVYTKNFSHLEEEPLEIQASQEYEGIPFNDDTAKIVLSLEKNDNDYSITKYMQTHLSDIEQLREKTELYTEEEAINTLYINNKIPRGSKILWRQLAYSCILKVREKNVYVPVWHVAIETSDKVVQIESVNAFSNTIVTNNTVPKVEDQ

SEQ ID NO: 4867 - protein, 68 aa, Enterococcus faecium
  misc_feature (B) LOCATION 1...68
  hypothetical: YES
ALFNIGRSKDIFVKKVQKKYPHPLFFVKNYCTIQVAYGYRNFHNFRARTYLIQGLIFQVKQKPVKHSA

SEQ ID NO: 4868 - protein, 482 aa, Enterococcus faecium
  misc_feature (B) LOCATION 1...482
  hypothetical: YES
NYFKDTVILSKKSRRVSTVSKSEVSKMGLGTFIGLTMALCATVRSIPTLAAVGWTLIFYSIFAVLFFAGPISMVSGELSTMLPQEGGPQLWVKTALGSKWGFVVAWLLWVQMFPGMVMVASTLGPLLGNTFGNVELGNNHWFVLGCILVIYWIITILNLKFDMAKVGGNIGVWLGVYIPVVIMFVLGVLAAFKVGLVSNGYLGDFSWSKAFPDLEHIDSLKYLAGITFIFVGIEMSSVYMPRLKDATKNYTKGVFIALIGLVLLNVINAMLVANVVPDGKMELANITQPILIDCQILGLPEVIGNIFSFMVFIGVLLQLSAWVTGPSKTIIQVAREGFLPPKFGFHKENKYGVSRNVVLTQSIVISLFALLYGVMDDVSAVFLTLTNATTVIYCIVYILIAVSLLKMRKKHPEFERPYRIGKNGNGLSWVVSCMLIFSIIVVVFATLGTATLSDALLVAAITVVMFVIPLIINHFKKESLGD

SEQ ID NO: 4869 - protein, 62 aa, Enterococcus faecium
  misc_feature (B) LOCATION 1...62
  hypothetical: YES
ANFKIKIAWTISEEDLKSSDMSQAVFCFMHLFLNSLLRQVAVLLEEDNFYHSFSLFRLFYQK

SEQ ID NO: 4870 - protein, 79 aa, Enterococcus faecium
  misc_feature (B) LOCATION 1...79
  hypothetical: YES
PLFKSTPLIITFLVRIKDKSDTYYSQNRNLTNLMLTNLLREFHEHYNKKSTFLHVFFGYLCFLTIQQLKTYKKICMYSF

SEQ ID NO: 4871 - protein, 129 aa, Enterococcus faecium
  misc_feature (B) LOCATION 1...129
  hypothetical: YES
IKFKLRGATLEVLNLPSMNGIEDENLRRLINSLVIELYKYQAESERKKIKERQAQGIEIAKKKGKFKGRQLKFKKNDPRLKHAFDLFLNGLSDKEVEEQTGINRRTFRRYRARYNVTVDQRKNNEKRDS

SEQ ID NO: 4872 - protein, 102 aa, Enterococcus faecium
  misc_feature (B) LOCATION 1...102
  hypothetical: YES
IRFKNKSCKGSIGKNGRNVLAISTENILPKLELAVALIYFMIFPKVSRPERRPLSKIVKSFSKRITSADSFAISTAVSTEIPISATFIAGASLIPSPKNPTV

SEQ ID NO: 4873 - protein, 67 aa, Enterococcus faecium
  misc_feature (B) LOCATION 1...67
  hypothetical: YES
MVFKSFYLRQSVFSNVKHEELILFEYSFCSMQDGFFTTSDSWCSISCPSVLAQKTAKYEKLFCRLFL

SEQ ID NO: 4874 - protein, 81 aa, Enterococcus faecium
  misc_feature (B) LOCATION 1...81
  hypothetical: YES
TVFKSQFLGSKSNLCKNVETHVYKIFLTTRNEAALSQPLDKRRSISCPSVLAQKRQNMRSYFSIFFSHTQVITLISQPLLS

SEQ ID NO: 4875 - protein, 71 aa, Enterococcus faecium
  misc_feature (B) LOCATION 1...71
  hypothetical: YES
IPLNDWFEIKNVFIDSSILSIFIMHCLVIMHNIFFWHLFWYMNTYRICCSASQLLNYPLYIFIRFFWVTVG

SEQ ID NO: 4876 - protein, 71 aa, Enterococcus faecium; identical to SEQ ID NO: 4875
  misc_feature (B) LOCATION 1...71
  hypothetical: YES

SEQ ID NO: 4877 - protein, 124 aa, Enterococcus faecium
  misc_feature (B) LOCATION 1...124
  hypothetical: YES
PKILTASGTAVATFTLAVNRNFTNQNGNREADFINCVIWRKPAETMATLAKKGSLIGVVGRIQTRTYDNQQGQRVYVTEVVADNFQLLENKAATESRAHADQSSTSPSTATFEQRIQRRLTTMD

SEQ ID NO: 4878 - protein, 228 aa, Enterococcus faecium
  misc_feature (B) LOCATION 1...228
  hypothetical: YES
MVINNLQQQAYESIRKQIIYSELAPGSKISDKVLEEQLAIGRTPIREALIQLRNQELVKTIPQSGTYVSKIDIRSASLARYTREKLEKPILQECSAKMTKQDQAKLEKILEQTDQAVIAQNKKAFFDLDTDFHRTCYEIAGKREIWDWLESYSTHLNRFRWLRLTISELDWGRVLDEHQTMLQSMIDHNFDEVGFLCTMHLHMIIEEQEYVIHNYPDYFEDIQDRPIK

SEQ ID NO: 4879 - protein, 222 aa, Enterococcus faecium
  misc_feature (B) LOCATION 1...222
  hypothetical: YES
CHIKEIGELLADHPAYFHTDAVQAYGNQTIHPEELGIDLLSISAHKINGPKGVGFLYKRDGVNIPALLLGGEQEEKRRAGTENLAGIWGMAKAVELLSPEEREARNNKYKGFQQLILDTLEANEIPYQVNGDLTNKLPHVLNLRLIGEANDLLLMKLDLNGVAISTGSACTAGNIEPSHVLEAMYGEDTPILKESIRISFGLGNTEDDIQYFLDQLVRAVKK

SEQ ID NO: 4880 - protein, 66 aa, Enterococcus faecium
  misc_feature (B) LOCATION 1...66
  hypothetical: YES
FIINIEPIFRRSSRDCANLKYKFGYRHFWVEGYYVTKVGQNEATIKKYIQEQEKHDSALDKLSVRE

SEQ ID NO: 4881 - protein, 72 aa, Enterococcus faecium
  misc_feature (B) LOCATION 1...72
  hypothetical: YES
KSINSLQMFKFFSSFKKTKMLCFFKKRKRFHEKEDSFENLKKEEGIGKNELFEQKFYKMRVIIFVLILFLIK

SEQ ID NO: 4882 - protein, 61 aa, Enterococcus faecium
  misc_feature (B) LOCATION 1...61
  hypothetical: YES
VPINNMNPVIKYKPVAVVKYFPLAVKNNATAKKASEINNTTANRPVMSCNNPNVFSKDKVE

SEQ ID NO: 4883 - protein, 85 aa, Enterococcus faecium
  misc_feature (B) LOCATION 1...85
  hypothetical: YES
QEIKLSVVVNVGNYREKRQEIIQRLADRTAEKVKRTGQPVFLGPMPAFESKQIHAALSKDEHVKTHSEGEEPYRYLVVEPAKKYY

SEQ ID NO: 4884 - protein, 129 aa, Enterococcus faecium
  misc_feature (B) LOCATION 1...129
  hypothetical: YES
EGIKMEIIYPPLVEEGLKYYLETTQQSLDKCTFYRSMVERGIITETGLPTQQAIENGLVKDYYEDQGLSFDDFLRIYPIFEEYDEELFQCIDGYWEIPVDMKENLVSQLESGELTFEDAQQIQAYLEDR

SEQ ID NO: 4885 - protein, 287 aa, Enterococcus faecium
  misc_feature (B) LOCATION 1...287
  hypothetical: YES
TPIKALADSANKMANLKEVPPPLERKDELGALAHDMHSMYIRLKETIARLEDELAREHELEETQRYFSAAASHELKTPIATVSVLLEGMLENIGDYKDHSKYLRECIKMMDRQGKTISEILELVSLNDGRIVPIAEPLDIGRTVAELLPDFQTLAEANNQRFVTDIPAGQIVLSDPKLIQKALSNVILNAVQNTPQGGEVRIWSEPGAEKYRLSVLNMGVHIDDTALSKLFIPFYRIDQARSRKSGRSGLGLAIVQKTLDAMSLQYALENTSDGVLFWLDLPPTSTL

SEQ ID NO: 4886 - protein, 333 aa, Enterococcus faecium
  misc_feature (B) LOCATION 1...333
  hypothetical: YES
DAINCIVSHQKGRISLSEKRDLFEKLLEQIQLEEAEKNHPLLTAGEMDSVVVHRKSRLWEFTLHFSKILPIMLYRSLTQHLTIAFKDIAQVKLNILADDQTFDEQLLQDYWAQALENQQCDTPLAQQVLKTQVPVIKDRKVILPIDSTGAISYLKQQYLPLVEELFVSYGFPKFRIEPEVDEQQAERVLKLFEERKQEQAEAFMKQAAESLVVHEQKKKERKEQSPALEGPIHIQLGRNIPADEPTTPMISIVEEERRVTLEGYVFDKEVRELRSKRKILTLKITDYTSSFIVKKFSNGEKDEQVFDAISVGSWLKVRGSIQEDTFVRDLFSE

SEQ ID NO: 4887 - protein, 62 aa, Enterococcus faecium
  misc_feature (B) LOCATION 1...62
  hypothetical: YES
VAIKYFRMGFTSLLSVVSICFYTLLYARGVPSFSLWENVDVAVFMLDVDVFKQIGDCLNRWW

SEQ ID NO: 4888 - protein, 63 aa, Enterococcus faecium
  misc_feature (B) LOCATION 1...63
  hypothetical: YES
IKINGMQKNKAFIHCGKYFNKKKSKTRNNVRKMASINVKRLANECDSLRKTVTPFQKRKTINP

SEQ ID NO: 4889 - protein, 103 aa, Enterococcus faecium
  misc_feature (B) LOCATION 1...103
  hypothetical: YES
LIVKSSQDMSSSSFSSWMISAFGSTGFFNNKMVILVTKEPVNNAPMNAHGLVIVATANIPDAGIRLSAPQNMLNPPPTVPPTPVAMTLRAKSFNTIGKHPSVI

SEQ ID NO: 4890 - protein, 197 aa, Enterococcus faecium
  misc_feature (B) LOCATION 1...197
  hypothetical: YES
MRVKGQNSVDKKSIFQFGKPEERSILDLFPYKSCTEEGVLVTKEDHFQRYYRVVSTDVEGLNEQEKLERMNQLTTVMRTYVPTIKLVSLTTETDLTEQIVQKRQLLDKNRMEQSLGRNLQRLRKYEKKLVEEIQELKRAEQERPDLSFFFIIEGRTIKDLQTRNRQLMRSSGILGLKPLYKKELIKILYRMNNMNDE

SEQ ID NO: 4891 - protein, 145 aa, Enterococcus faecium
  misc_feature (B) LOCATION 1...145
  hypothetical: YES
EVVKMAIVVGADLKGTRLKDVVKNFLVEEGFEVIDVTKDGQDFVDVTLAVASEVNKDEQNLGIVIDAYGAGPFMVATKIKGMVAAEVSDERSAYMTRGHNNSRMITVGAEIVGDELAKNIAKGFVNGKYDGGRHQIRVDMLNKMC

SEQ ID NO: 4892 - protein, 83 aa, Enterococcus faecium
  misc_feature (B) LOCATION 1...83
  hypothetical: YES
TNCFAKKKKQLENTVASRYYKKVLKVSSVKRLSSFFVGIEEMYTIGISRESRGKLEIKISVFSKEIVERSVSSIGKKQTRFPK

SEQ ID NO: 4893 - protein, 267 aa, Enterococcus faecium
  misc_feature (B) LOCATION 1...267
  hypothetical: YES
TYSNKKGVLFVSNYRAITFFDLDGTLLDAKSKITPEVAKAMNALKENNVLPVIATGRTEAEIHSIMEDAGITSAVTMNGSFIRVNGEEIYSQTFSSEECQKMYDHVQLNGHELSYYNDQKIWCTGHSQTMIDAYDFIHSDVPEIDPLGFKDNTVNMLLILSQSGDEYYHEHFPELTFYRNGPYSIDTVKKGISKGAGVKRLKKELQLEEVPTFGFGDGPNDFALLEACDNKIAMGNAYDGLKELSTFITKKNTEAEIVHALKHFDLI

SEQ ID NO: 4894 - protein, 419 aa, Enterococcus faecium
  misc_feature (B) LOCATION 1...419
  hypothetical: YES
THSNKEDFMKTILFAPAVFNLAETTRMIEVAKAMKDRYYCVFFGFSKTFAPLITESGFEYHLLAPILTKKQEEQIIKFDQLRTLKNPFTKEMVASRITSEQSLIAKFEPRLIVTGSNVTIFLSARNKKIPLVYVKPYALSEPFFQSEHALMPHELRFFGPLSNPLWHWTKKRIVNTRWIPNAFKHAAQKEMLPLPKTSLQMMDADLNLITTPKLFLEEEQLPENYRIVGPIFAKLSTSLPEEVLTFIQRKQQERKRIIYFAMGSSGNPRMLRKILFFLQKQPDLAVIAPIDYLLDDIQSDSEDLLITEYLSSHLLHEFIDFSFIHGGEGTVQTACESGKPFIGVGMQFEQSCNIDYCVKYGNAIALTKPVTERKLQIALREVSSPKIRQQARTLQAVFPINGPQQAIQEIETFLSNHPI

SEQ ID NO: 4895 - protein, 289 aa, Enterococcus faecium
  misc_feature (B) LOCATION 1...289
  hypothetical: YES
GASNGAKGWLQIAGFSIQPAEYLKIISIWYLSLTLSKRQNSVQKDFLGTVKRPLAMVIGLTALVAILPDFGNAAVIFMIILVLLLASGVNYVYTLIVGVGGFCLSTFTIWLINITNGKILPGRLQYIYNRFAIYQNPFSDELNKGHQLVNGYYAMFNGGLFGRGLGNSIQKKGFLQEAQTDFIYAIVVEELGVIMGILILALLFFMIVRIVLVGIRSKDPFNSLLCIGIGAMFLIQVFVNLGGITGVIPLTGITFPFLSQGGSSLLMLSICVGFVLNISADEKRKSLGL

SEQ ID NO: 4896 - protein, 351 aa, Enterococcus faecium
  misc_feature (B) LOCATION 1...351
  hypothetical: YES
NAPKKEVHIKLKPTIYDIAKKANVSKSTVSRVLNNQPNISDKAKASVLQAIKELNYEPSKIARGLSGNGFDAILALSHRTSHTTYGNPFFSDVIQSISAVSEQNNFDLILQTAKTPEEELEKCAKKIQEKMIRGIIILSSTMDETLLFELDQYNIPIVVIGKVGNDYTNIYSVDTDNFQDSYDLVETLIKNGHRHIGCLHAPTEVYVSNDRLNGYRQCLFDHHLDIRNEWIIDGGFRLEDSMAAMNDLMKLRERPTAIFSTDALKSLSIYKVAEQSGKQIPDDLSIAGFSDPLLSSLFSPQLTRIDIPTNQLGIKATELLFQLIHHQYPEEKRIILSTEITLTDSIQQQEM

SEQ ID NO: 4897 - protein, 619 aa, Enterococcus faecium
  misc_feature (B) LOCATION 1...619
  hypothetical: YES
KLPKHLNKEEIHMFSNKTRQDSIQKMQQEELDLLIIGGGITGAGVAVQSAASGIKTGLIEMQDFAEGTSSRSTKLVHGGIRYLKTFDVEVVADTVGERAVVQSIAPHIPKPDPMLLPIYEGEGATTFNMFSVKVAMDLYDKLANVTGTKYENYTLTPEEVLEREPFLKKEGLKGAGVYLDFRNNDARLVIDNIKKAAEDGAYLVSKMKAVGFLYDGDQIVGVKARDLLTDEVIEIKAKLVINTSGPWVDKVRNLNFTRPVSPKMRPTKGIHLVVDAKKLPVPQPTYFDTGKQDGRMVFAIPRENKTYFGTTDTDYQGDFTDPKVTQEDVDYLLDVINHRYPEANITLNDIEASWAGLRPLLIGNSGSDYNGGDNGSISDKSFNKVVDTVSEYKENKVSRAEVEDVLNHLENSRDEKAPSTISRGSSLEREPDGLLTLSGGKITDYRKMAEGALRLIRQLLKEEYGIETKEIDSKKYQISGGNFDPTKLEETVTELAKEGVAAGLEEEDATYIADFYGTNARRIFELAKEMAPYPGLSLAESARLRYGLEEEMVLAPGDYLIRRTNHLLFERDQLDEIKQPVIDAIAGYFEWTEEEKAQQTKRLEALIAESDLRELKGEK

SEQ ID NO: 4898 - protein, 63 aa, Enterococcus faecium
  misc_feature (B) LOCATION 1...63
  hypothetical: YES
VMPKDLLNYVSLQKNLIGTCHLVKSQKSGALGCIIRARFLQKITDAYDKNPEIEKLMLDDYFR

SEQ ID NO: 4899 - protein, 133 aa, Enterococcus faecium
  misc_feature (B) LOCATION 1...133
  hypothetical: YES
FCCFCGSTRKRKKEKQHDEVISLKTSILLGGIIASLLFFSWQEPVQADTKSSGTITFYDLSPVPHPSGSVNGASKQQTQLPIYKESNQHGVFPETNEEKIRFLYLIIGIELWLLAWLLLWRRKEKEDEHVATK

SEQ ID NO: 4900 - protein, 325 aa, Enterococcus faecium
  misc_feature (B) LOCATION 1...325
  hypothetical: YES
LITNVNSGKGSARYIAPFPFSLDLRYNVKVGDRMNYLKRSLGNAWDFLKGTQAYFRDVLLMHGFILFICLPLLSSTTRFILHRGAIDYLSYDNIPLIFSQHPGVLLSLIAVLLTILLLVYFEFAFLLMSVFFIKKKEPVSLKQLLHLTILQLKKVRPITFLFFLAYFLLILPISGLSFNSDLLSKIKIPAFIMDFIFANRWIVVSSFLLVYIFLGYIGIRLIFALPEMILRDRPFRASIRESWLLTKSRLFAITGQFIVIGGTILLLSSLGYIVVILAQSVVEEFFPNYALISAVFAMTLLQGILLFNIVMSTVGIFYIIPGFHG

SEQ ID NO: 4901 - protein, 129 aa, Enterococcus faecium
  misc_feature (B) LOCATION 1...129
  hypothetical: YES
LTTKSIKRKILSNAIKKIGGFSLYSTDPKMKKIQQITLKMSQEIVDFCLKNQLLCYFCGGGAIGTVREQGFIPWDDDLDFFMPREDYEKFYQLWVNSEKSKKYPIQKASKNYNDHNSFTNIRDGRYNIY

SEQ ID NO: 4902 - protein, 651 aa, Enterococcus faecium
  misc_feature (B) LOCATION 1...651
  hypothetical: YES
TMTKLKRLATKEDEIVDVKIPISNEELKDRAKQYDLLTPKRFATRYNKMLFLPTSFKWNGSEYPIQYNYCINPFCCNFGKEQHKFKDVKGKPSRYKMTGSSKDKGHKGMYCNDNPIGRGVSQNCTVTPLSNWSVVEEIKRLIEINSIQDVEPDYQFHKEGCSEEESTPFNEPKQFYKRGKSRGKSQRYQCKACKKFTNVLPKREETTTYHQQKNTILPMFAKMVVGRVSVSRTCDILGIGVGTYYHKLEWLYRRCLEFLERYETQPLQTKKFNEMWLNTDKMHYYLNNVRKKGQGSKKYTGFEDLNMQTYIVVSAEVLSRYVFRSDVAYDWNISMDELNEDTRKFKEDHLNTFSRKNDRLDWSYYPQEPSANDSENRNAYLHELGKITNRSRFVDGLNVDAPYTTTAHYWLIKQMVNADEWRMISDDDFSIRNAFYRVFTKELRLSDAHHFICQVNKTKSRKQCLKEFGQAKAELLDWGDIRGFKTKFLRTLASHYLTELLTSHQFHEEAISKDGERYRKYADNPIKHPLATKDKGFYSVDCRTDLSALEPNEIAKMLLNVNDHSTNSFIQQIRRYISSLERPLTTARGDKKSYIYANFNPKYAQFAITILRTYYNFCRPFKSADKKVLTPAQRLGITDKQFDWKDIIYFK

SEQ ID NO: 4903 - protein, 73 aa, Enterococcus faecium
  misc_feature (B) LOCATION 1...73
  hypothetical: YES
SIAKAVIKERTLAITKPSTASFNVVTEWESNTCASAANAENTAAGPGKIKAGIFQTMTTICQIIKMNAILTAG

SEQ ID NO: 4904 - protein, 339 aa, Enterococcus faecium
  misc_feature (B) LOCATION 1...339
  hypothetical: YES
SVAKRAGGSIMKARKKNKLLLLICFVLLIIFFIALSNGAASVGKTAFWQALVDFDGSKQSHQIIRNIRLPRVAGAFLVGSCFALSGALMQGVTRNPLADSGLLGINAGASLAMALSFAFWPKASGFSVFLVSLAGSFAVTLLVFGFLQFSKMGMNPLQLILAGVAISSFFTAISQALTQFFNLQQDLAFWFVGGAANITWKQLTVLFPVYVLAVLVSFSLGKAISLISLSETHALALGGRPKRTRLIVFCLVAVLAAIAVSLVGPVSFIGLLVPPIVRGMVGTDYRYVLPVSFLVGGGLVMLADLVARMINPPFETPFGLVIALIGVPFLLIQVRRERR

SEQ ID NO: 4905 - protein, 293 aa, Enterococcus faecium
  misc_feature (B) LOCATION 1...293
  hypothetical: YES
KYANWLFFFFENFVILLFMEENVMKRILTIGGSDPFAGGGIQTDLKTFENFGLFGLSALTSIGALDINERFMLESISLELLKRQLVSIDKMTSLDGIKIGLLNSSEAIMVVRDFIKTKQNIPIILDPVLAFKETEAVINQLYISQLIEELFPLVTMITPNLAEAALLSGQALPSSLTEMIHLAKELTASGTKNIVIKGGTRMAGDEAVDLLYSIDHYEVFSHKKIDTTTVNGAGCAFSSAITANLVLGADFTKAVAESKKFVAHCISNGVLMNDHTGSVWSGGIQKGGMRNEN

SEQ ID NO: 4906 - protein, 151 aa, Enterococcus faecium
  misc_feature (B) LOCATION 1...151
  hypothetical: YES
GGAKPMKLHELKPAEGSRQVRNRVGRGTSSGNGKTAGRGQKGQKARSGGGVRLGFEGGQTPLFRRLPKRGFTNVNRKDYAVINLDVLNRFEDGAEVTPVALVEAGIVKNEKAGIKVLANGELNKKLTVKAAKFSKAAQEAIEAAGGSIEVI

SEQ ID NO: 4907 - protein, 88 aa, Enterococcus faecium
  misc_feature (B) LOCATION 1...88
  hypothetical: YES
VSCLICFFCCHSVAEAVKNTISAPISAEPMITKINGAEKEVKPKLTGTFLLFNTAKRTIIKTKTNPRITLLCFFNSFTYFLLKIPLAK

SEQ ID NO: 4908 - protein, 243 aa, Enterococcus faecium
  misc_feature (B) LOCATION 1...243
  hypothetical: YES
LLYKKINQLLESEEVEPAKLMKFCPVKNQVPIRKDNFAYRLVQLLKEHGKEYFWSWEMSHIGYDKYEEGNALLTKKTLESQVLTVSQFQKKEDYQTRKILIGKTKIDDQDIFVSSCHFSWWTDKKSGFYFEWKNLENYFLETRVPLFFLGDFNNPVDSQGYYTVRESCLLLQDSYVVANEKGKAATVEKKIDGWEQNTEKLRIDFIFVPEGMQVKKYQRIFDGIDSPIISDHYGVEIELDVNE

SEQ ID NO: 4909 - protein, 102 aa, Enterococcus faecium
  misc_feature (B) LOCATION 1...102
  hypothetical: YES
LCYKNVSKQLLKMTKLFVSENDHEKAALSLAFLKITTILFRFRPKNKKRNYSSLNNFLKGKMNNTNIIMFNSSVGPKNLVIKYVLFTTANLKINWTTIVNNS

SEQ ID NO: 4910 - protein, 319 aa, Enterococcus faecium
  misc_feature (B) LOCATION 1...319
  hypothetical: YES
MTYKHLTIDELTMIESYYLQHNKPVEIANRMGRAIQTIYNVVNKFKQGKTALDYWHQYKENKKKCGRKVIQLPAHEVDYIKEKVTLGWTPDVIIGRKERPVSCGMRTLYRLFSKGIFDIDTLPMKGKRKPNGHQEKRGKQQYQRSIHDRPDNYPDFNSEFGHLEGDTIVGIHHKSAVITLVERLSKVIITIKPNGRKALDIETALNQWFSRFPKNFFKSITFDCGKEFSNWKAISNQHDIDIYFADPGTPSQRPLNENSNGILRRNGLPKSMDFRKVNQTFISSVSNQRNHIPRKSLNYRTPIEIFLSYVQEAFYSSLI

SEQ ID NO: 4911 - protein, 76 aa, Enterococcus faecium
  misc_feature (B) LOCATION 1...76
  hypothetical: YES
MTYKHLTIDELTMIESYYLQHNKPVEIANRMGRAIQTIYNVVNKFKQGKNALDYWHQYKENKNNVVDQSSNNLLMK

SEQ ID NO: 4912 - protein, 319 aa, Enterococcus faecium; identical to SEQ ID NO: 4910
  misc_feature (B) LOCATION 1...319
  hypothetical: YES

SEQ ID NO: 4913 - protein, 127 aa, Enterococcus faecium
  misc_feature (B) LOCATION 1...127
  hypothetical: YES
KAYKLGLFSMYEKEKSFMDKYINMKNPPRFSGEWKFFAFFFLDLLTLGGCFFWAKIVNNLVHLPLFFALLNYGLWIAIALVIVWRPYNNPGQRQIFAIIESIFFTDKNHYHALDPNRNYHGTYKEDE

SEQ ID NO: 4914 - protein, 76 aa, Enterococcus faecium
  misc_feature (B) LOCATION 1...76
  hypothetical: YES
VRVLQGPLWRCKFHMEDYPSPAEGNGLENRQAGKTVQGFESLILLFHIIAGWSSLVARRAHNPKVVGSNPAPAIKN

SEQ ID NO: 4915 - protein, 212 aa, Enterococcus faecium
  misc_feature (B) LOCATION 1...212
  hypothetical: YES
RGVLTGGFQMKNTRVQKMVAVAMFAAIALVLQYFAFPIMPAFSFLKIDFSDISVLISMFLFGPAAGVATAFLRSVLHLLTTGFSPDNLVGDTASFLSTTIFTFPIYYFFSVKKQHKGRNKFLGVITGTIALTIFMSIANYFVITPLYLMFLGLNATQMLGMSLANYVLIGIVPFNLIKGFIVSAVFLVLHAQLLPWLSRKQHQFEQRHTAVK

SEQ ID NO: 4916 - protein, 216 aa, Enterococcus faecium
  misc_feature (B) LOCATION 1...216
  hypothetical: YES
RQYNDRRRFWRKRTIEARVQLIKNQIAETTSDFDREKLQERLAKLAGGVAVVKVGAATETELKELKLRIEDALNATRAAVEEGMVSGGGTALVNVISKVSAVEAEGDVATGIKIVVRALEEPIRQIAENAGYEGSVIVDKLKNVELGTGFNAATGEWVNMVEAGIVDPTKVTRSALQNAASVSALLLTTEAVVADKPEPAAPAAPAMDPSMMGGMM

SEQ ID NO: 4917 - protein, 298 aa, Enterococcus faecium
  misc_feature (B) LOCATION 1...298
  hypothetical: YES
TEYNFIEIWWKINMKKNLKSFFRENGRYAAASFLIPFLILALVYLSIGIYPGSSRSILASDAFSQFSNFHASFRNVLLGKQSIFYTWNASLGLNYLSLISYYLGGIFTPLVFFFPNQMMPDALYVLTLLKVGCAGLAFWFLARTFKIPRWGHVALSVSYALISFITAHSEIIMWLDAFFYLPLVILGIHRVMDLKRPKLLFISYLLLFLSSFYMGFMIGVFSFLYFIARLLTNWSEYKKTIVPYGITSLLAGGASMIIVLPSSAGSSVKWRGTESDHYVENRSDFLSGSNHEKYDWCL

SEQ ID NO: 4918 - protein, 397 aa, Enterococcus faecium
  misc_feature (B) LOCATION 1...397
  hypothetical: YES
ERYKESRRSHMASYIEPIRFALIVFPFLALAISSVFFIYEYRKYGTFLVTRAVILYSFVFYLLCAYFLVILPLPAKETVAQMTGPKMELHLFASWQHFRDNTVLVLSEPSTYLPAMKQSVFLEPAFNVLLLIPFGIYLRYYFRLSFMKTMIASFCLSLFFELTQLSGLYFIYPRPYRLFDVNDLVTNTLGGIIGFVVTLLFTFMLPTRRRMDELSYEKGKTVSLTRRLVAYLIDWTFLSLINLVAAIFFKIAFDSGAVTSHIWWLLLEVGVYFMIVPFITNGWTLGKKIVRIRLVEEDRERISLKALMIRYGYLYFLFYGLSWLGQLLQQIMNSTTNTVLQMSAVFISLGVLLLQGIFILNILLSFLRKKRILFYEKASHTYTVSTIGQTKDDDSRN

SEQ ID NO: 4919 - protein, 314 aa, Enterococcus faecium
  misc_feature (B) LOCATION 1...314
  hypothetical: YES
RRYKMNQVIEETKIWQMMGTTITLQVGHEEPSRLLAELGEWLHVYEHRFSAHDATSELMAINQAAGRQAVIVHPELFELIKLGKAHSCARNSYLNIAIGPVVQKWHIGFEDALVPTKAEITELLLLTDPHQIQLDEKMKTVFLTKPGMMIDLGALAKGYIADKLITHCRERNAAFALVNLGGNIVVFGESPRRSDGAWRIGLRNPKGSREESLAVVKLNNQSLVTSGIYERYLQNGSSVYHHIIDPKTGFPVKNDVASLTILSDSSVDGEIWTTRVFGASSLEVLKALEKQPGIHGAFVSKEKQFLYSKGFEKI

SEQ ID NO: 4920 - protein, 255 aa, Enterococcus faecium
  misc_feature (B) LOCATION 1...255
  hypothetical: YES
NIHKFNDNYENLCRAKGVLLLDEKLDIKTAIKDTLPTVFGYIGIGLAFGIVGKAAGFHPLVVTLMSLLVYAGSAQFITVSMLASHSPLLSIVFSTFLVNSRMILMSMTIAPYFKKNRLLQNLLIGTLLTDESFALGMNKLNYTGQKLNFRWMNTANWISYLTWVGSSLVGALLGNFITDPKKFGLDFAIVAMFIGLLYLQVISDRNTSKRLQLILIGLTLILVYVGLIFIPSNLVIVVVTLIGCGLGVWIKHAFF

SEQ ID NO: 4921 - protein, 115 aa, Enterococcus faecium
  misc_feature (B) LOCATION 1...115
  hypothetical: YES
DKHKGGVEMLNMYFVFGVPIFLLFLYATIAYVRKRTTIHYLGFILLIISGFMLVFNLQTWQQALLEMDKMTPHALSKVLGYPVYLIWLPIFISGCLVLLNIYRGVRRIVQLRKSK

SEQ ID NO: 4922 - protein, 478 aa, Enterococcus faecium
  misc_feature (B) LOCATION 1...478
  hypothetical: YES
MEHKELTSFPKDFLWGSASAAYQVEGAWQEDGKGESVWDRFVRIPGKTFKGTNGDLAVDHYHRYKEDIALMKEQGLKAYRFSVAWTRIFPNGRGEVNQAGLAFYERLIDELIENDIEPMLTLYHWDLPQALQDEYNGWESRQIIEDFTHYAETLFEAFRGKVHYWISLNEQNIFTSLGYLLAAHPPGVTDPKRMYEVNHIANLANASVINKFHELEMPGKIGPSFAYTPNYPIDSNPENVLAAENAEDLMANYWMDVYMWGKYPIAAMRFLEEKGWAPTIEAGDAELLESAKPDFLGINYYQTATNAFNPLNGVGAGKMNTTGKKGSSEETGVPGMYKKVENPFVERTNWDWEIDPEGLRIGLRRITSRYRMPVLITENGLGEYDKLTEDKQIHDDYRINYLQSHVKAIKEAISDGAEVLGYCTWSYTDLLSWLNGYQKRYGFVYVDQDETQEGSLERYKKDSYYWYQKLIEENGENL

SEQ ID NO: 4923 - protein, 303 aa, Enterococcus faecium
  misc_feature (B) LOCATION 1...303
  hypothetical: YES
RPHKTSKMRSFVSGGKEMAQIGIYEKALPKDISWKERFSLVKEMDFDFIEMSIDETDERLARLDWSEEKIAELREEMFSSGVRIHSICLSAHRRFPFGSADPEKKKAAKQLMKKAIHLAHNLSVKVIQIAGYDVYYEEKSMNSREDFIEGIKESVKEASKYGIILSVEIMDDPFMNSISKFLEIKEQIHSPFLQVYPDLGNLSAWPENNPARELEKGIDYITAIHLKDTYPVTKEYSGQFRDVPFGSGCVDFLGLLRHLKRLDYDGTFLIEMWSEKSQDFRREIQQAKDYLSSKLKEAGYDVL

SEQ ID NO: 4924 - protein, 316 aa, Enterococcus faecium
  misc_feature (B) LOCATION 1...316
  hypothetical: YES
QKHKMPERKDGNKLKKIMNDPSNIVEEMLEGLVKSYPELVHRVESSRVVAKNQKAEQVGLVSGGGSGHEPSHAGFVGEGMLSAAVLGDVFTSPTPDQIQTAIKEADSGKGVLLIVKNYTGDALNFDMAKELAAMDDIEVESVIVDDDIAVENSTYTAGKRGVAGTVLVHKIVGDAARNGASLAELKELGEKVVQATKTIGLALRAATVPEVGKPGFELGEDEIEYGVGIHGEPGYRREKMQPSKVLAKELVTKILDDYSNLPKEAGVLVNGMGGTPLMEQFVFMNDVLALLEERGVNVVFRKVGNFMTSLDMQGFL

SEQ ID NO: 4925 - protein, 313 aa, Enterococcus faecium
  misc_feature (B) LOCATION 1...313
  hypothetical: YES
TINNEFNLGVNEGSSQVANNQYILLHETANETATGRNEAQYMQRSWTSAYTAYIVGDGGIVYQVGQLGYVQYGAGSYANANSPVQIELQHTHDKETFEKNYKVYVELARDSAMKYGIPLTLDTPYNQPGIKSHLWVTQNIWGDHTDPYGYLSEMGVSKEKLAYDLAHGFTDDNPTTSEDKPVIDPTRAGAANSTLTDGTNYAHIDQFGEIENANLHVAGWHIANYKYEYIFIMDYNTGKELARVRADGIYRPDVNQAYNTLGNVGYHVSFNMRDFPNKKVYVMMRATNDPEGNTKGGAQDFHDKPWYLNIPQR

SEQ ID NO: 4926 - protein, 159 aa, Enterococcus faecium
  misc_feature (B) LOCATION 1...159
  hypothetical: YES
MEVLWATGMRVSELIGLKLGDLHLSLGLVQTVGKGDKERIIPLGDYAIQWLERYLDEARPLLVKDASEMHVFVNNHGKGLSRQGIWKNLKQLVREAGIYKEVTPHTLRHSFATHLLENGADLRTVQELLGHADISTTQIYTHITKKRMTDVYKQHFPRA

SEQ ID NO: 4927 - protein, 72 aa, Enterococcus faecium
  misc_feature (B) LOCATION 1...72
  hypothetical: YES
RINKKEAIFMYDLHDIVEMKKPHACQTNRWEVIRMGADIKIRCMNCGHIVMMTRRDFEKKLKKVIEKNAEKE

SEQ ID NO: 4928 - protein, 60 aa, Enterococcus faecium
  misc_feature (B) LOCATION 1...60
  hypothetical: YES
FANKNFSGRSIWERDGDGIHFYPWAGSFNDHFIAERSDSRLYCTVQTESRIGEERYGWNH

SEQ ID NO: 4929 - protein, 125 aa, Enterococcus faecium
  misc_feature (B) LOCATION 1...125
  hypothetical: YES
VANKIHLRRCYHMEKELSTLDQYLIDPDWGKPKIEETSGRKIRCNLLTDEELACDQDDLGNFVSIWDHVYLIHLSKHSNKPEYIYVIEDGLIDALEEYDRDNLIDISYYGPGKKYIAEMEAEFDE

SEQ ID NO: 4930 - protein, 88 aa, Enterococcus faecium
  misc_feature (B) LOCATION 1...88
  hypothetical: YES
NKNNHIILLKLGWLEMSLLCKLVPERCIACGLCQIEAPDIFDYDEEGIVLFAQEPEAHQQFVMPEEETYVKKAYQKCPVRAILLENKI

SEQ ID NO: 4931 - protein, 267 aa, Enterococcus faecium
  misc_feature (B) LOCATION 1...267
  hypothetical: YES
IENNSFDCRPFPICAILALRMVIHMKSLIYAIGDVHGKHELFEKLIHYYDPKIHQLVLLGDLNDRGPRTKECFLLGKQLVEETGAIYLRGNHEEYFLQFLQSPEDWYAPYMRNGGKETFESLIHPGASEEYSPTEISMMIQSRYSELIKFLVQRPLYYEWENYLFVHAGVDLTKKDWRKTSLRDFIWIREPFHEGKNNTGKTIVFGHTITPMLHGDMQTTDLWIQDHKIGMDGGAVFGGSLHGVVFDKEGILQDIEYQNNEGPWHGI

SEQ ID NO: 4932 - protein, 94 aa, Enterococcus faecium
  misc_feature (B) LOCATION 1...94
  hypothetical: YES
WQNNFFIVKIVQLLIYGISVAWAFFYRGITPTWPFYLLLVGILVGNFAPLHYRTNFFPTDSGLFLKTKTRKLENIIEMTITCIIIFLVIFLNVF

SEQ ID NO: 4933 - protein, 379 aa, Enterococcus faecium
  misc_feature (B) LOCATION 1...379
  hypothetical: YES
LKNKFYRLKQLLEASYMTISYGKFDLKEVINASGKMTILGVSKVSESVLAAQRFGGEHFFEMSDLAIKTGAYLSQLLKVEDAQIVSSASAGIAQSVAALIGQGDMYHVYHPYTEKIARREIIIPKGHNVDYGTPVEVMVAQGGGKVIEAGYANMCTPEHVSMMITEKTAALLYIKSHHAVQKSMLTVAEMVEVAKAHRLPLIVDAAAEEDLFKYSEMGVDLVIYSGAKAIEGPSAGLVIGKKKYIQWIRLQSKGIGRAMKIGKDNILGFTQALEDYLKNGSESGDSMKQRLAPFVNAINQLPDLSAKIVQDGAGRDIYRASVTINGDKSAKEVIQELKARNPAVYTREYQANNGIIEFDIRSVSQNEMEKIIKRLREIM

SEQ ID NO: 4934 - protein, 301 aa, Enterococcus faecium
  misc_feature (B) LOCATION 1...301
  hypothetical: YES
TRNKKQKGTIIIMIKLIASDMDGTLLDAHMSVSPENAEAIRFANDAGVEFMVATGRNYQEARAALDEVGIDCAMITLNGAQVFDKEGNSLFTVSIPNNQAISVLDILDANGIYYEVATNDGLYSENQAKRIESFASMVATHLPHLTYKMAIAMASAKLELLHITYVDSIRAILEEKNLEVLKIICFHTEGPAVLGPVGKQISLLGDLAVTSSGQNNIEVNHKNAQKGIAVAHVAHERGISLEEVMTIGDNFNDVSMLQVAGVSFAMGNAEIEVKDYAKYTTDTNLESGVGKAILRAIAEDL

SEQ ID NO: 4935 - protein, 89 aa, Enterococcus faecium
  misc_feature (B) LOCATION 1...89
  hypothetical: YES
WRNNMSEYREIATPSRTKEILLKHGFSFKKSLGQNFLTEPNILRKIVETAQIDEHTNVIEVGPGIGALTEQLPKHAIQVISLDKSPWFA

SEQ ID NO: 4936 - protein, 352 aa, Enterococcus faecium
  misc_feature (B) LOCATION 1...352
  hypothetical: YES
RRNKHMSLQAQLESLKEATLVKITAAQDLNELNQIRVETLGKKGPITEVLRGMKDLSPEERPKVGSFANEIRDLLTEEIERKKQVLEEEALNAALAKETIDVTLPGRKVKHGTRHIVTQIMEEIEDIFVGMGYQIVEGYEVESDHYNFERMNLPKDHPARDMQDTFYISDEILIRTHTSPVQARTMEKHDFSKGALRMISPGKVFRRDTDDATHSHQFHQIEGLVVDKNITMGDLKGTLEVVMKKMFGEDREIRLRPSYFPFTEPSVEVDVSCFKCGGAGCNVCKYTGWIEILGAGMVHPNVLKMSGIDPEEYSGFAFGLGPDRVAMLRYGVNDIRNFYQNDLRFLSQFKGE

SEQ ID NO: 4937 - protein, 75 aa, Enterococcus faecium
  misc_feature (B) LOCATION 1...75
  hypothetical: YES
LFDKRTSRSAGKRSNRQTIDLFIGDTKAEFSSYPKSSRIPTRSFFENGLLFKIQPRIKPIYSDWEKARHSSMVVR

SEQ ID NO: 4938 - protein, 689 aa, Enterococcus faecium
  misc_feature (B) LOCATION 1...689
  hypothetical: YES
RNDKQEKEEKMKRSDKHGKNRTGAYIAGAVILIAAAGGGYFYYQHYQETQAVEAGEKTVEQFVQALNKGDYNKAAEMTSKKAANKSALSEKEILDKYQNIYGAADVKGLQISNLKVDKKDDSTYSFSYKAKMNTSLGELKDLSYKGTLDRNDGQTTINWQPNLVFPEMEGNDKVSLTTQEAARGNIIDRNGEPLATTGKLKQLGVVPSKLGDGGEKTANIKAIASSFDLTEDAINQAISQSWVQPDYFVPLKIIDGATPELPAGATIQEVDGRYYPLGEAAAQLIGYVGDITAEDIDKNPELSSNGKIGRSGLEMAFDKDLRGTTGGKLSITDADGVEKKVLIEHEVQNGKDIKLTIDAKAQKTAFDRLGGKAGSTVATTPKTGDLLALASSPSYDPNKMTNGISQEDYKAYEENPEQPFISRFATGYAPGSTFKMITAAIGLDNGTIDPNEVLTINGLKWQKDSSWGSYQVTRVSDVSQQVDLKTALIYSDNIYTAQETLKMGEKKFRTGLDKFIFGEDLDLPISMNPAQISNEDSFNSDILLADTGYGQGELLINPIQQAAMYSVFANNGTLVYPKLIADKETKDKKNVIGETALQTIVPDLREVVQDVNGTAHSLSALGIPLAAKTGTAEIKEKQDVKGKENSFLFAFNPDNQGYMMVSMLENKEDDDSATKRASELLQYLNQNYQ

SEQ ID NO: 4939 - protein, 331 aa, Enterococcus faecium
  misc_feature (B) LOCATION 1...331
  hypothetical: YES
KGDKMGIPVTIVSGFLGAGKTTLINQALQVSPYPREEIIIIENEFGEVGIDHKLLVHSEERVLQLNNGCMCCSLRSDLLAILISLLETIEEHQQPISQIIIETTGIADPQPIIQTLLTAPQLRGRVYIDSLLTVIDSDSFELIEREPQALKQLVMADRIFVSRKQNLNLSALKKLQREIKSINPLSDIRMFTHSETIQKKDFYNLKKFNHPLVFESDSSENHYNGKYYHQHHQVHEFKSILLTSDQDIKKDFLLQWIDWLILTNQGSLYRFKGLIALQEQDFIVAMQEVNEQVNFQYTTRQKDQTTIILIGKMLDEERIKQSFDKLLAESK

SEQ ID NO: 4940 - protein, 176 aa, Enterococcus faecium
  misc_feature (B) LOCATION 1...176
  hypothetical: YES
TIDNLSGKLLEEFIVVAVVCALFLWHVRSGAGGDYFVAAGVVYCFYVMHFQGLNANIMSLGGIAIAVGAMVDAAIVMIENAHKRLEEWQHQHPDATLDNKTRWQVITDASVEVGPALFISLLIITLSFIPIFTLEGQEGRLFGPLAFTKTYAMAGAALLAIVVIPILMGHWIRIQP

SEQ ID NO: 4941 - protein, 241 aa, Enterococcus faecium
  misc_feature (B) LOCATION 1...241
  hypothetical: YES
EHDNGKGVHTVMAYKYLVIVESPAKAKTIEKYLGRNYKVMASVGHIRDLPKSKMGIDFENNYEPHYISIRGKGDVIKSLKAAAKKAQKVYLASDPDREGEAIAWHLAYLLGLDLKEKNRVVFNEITKDAVKAAFKEPRTIDVDLVDAQQARRTLDRIVGYSISPILWRKVKKGLSAGRVQSVALKIIIDREKEIREFVPEEYWSIDGNFKKARKKFKANFWGIDGKKKKLPDAQSVKRSHC

SEQ ID NO: 4942 - protein, 411 aa, Enterococcus faecium
  misc_feature (B) LOCATION 1...411
  hypothetical: YES
SQDNQGNLIGKGMNGMELSKRTKRLEPSVTLAAAAKAKALKAKGRDVLSLTVGEPDFATPENIQEAAIEAIRNGKASYYTPTAGIPELRQAIVDYLKKNDGLVYESSQTVVTDGAKFALYTLFQTILDPQDEVIIPVPYWVSYGEQVKLAEGLPVFVKGKESNNWKVTVEQLEQARSGKTKAVIINSPSNPTGMIYSKNELQAIGEWAVKNDILIVADDIYGRLVYNGNEFTPIATISEAIKNQTIIINGVSKTYAMTGWRIGYAVGNPEIINGMIAVASQSTSNPTAVSQYAAVEALKGEQDTVEEMRNAFEERLNTLYPLVAELPGVSLEKPQGAFYLFPNVKETLRMCKYENVTQWVEDLLEETGVALVTGEGFGAPENVRMSYATDRATLEEAVRRIKQFIESKSQN

SEQ ID NO: 4943 - protein, 296 aa, Enterococcus faecium
  misc_feature (B) LOCATION 1...296
  hypothetical: YES
DSDNRIRGGKRMYGGIEAGGTKFVCAVSDGGEILEKLSIPTTTPEETLDQVFEFFDRYELKGIGIGSFGPIGIDKTKDNYGYVLATPKKGWAQFDFLGTIKERYNIPAAWTTDVNAAAYGELKQGAAQGKNSCIYLTVGTGIGAGVVINEEIFSGIAHPEMGHIWVKRHPDDHYEGTCPYHKDCLEGLAAGPSIEARTGIKGQDLPQDHPVWAIQAYYIAQALINYTLTLAPEKIILGGGVMNQDHLLQKIRQQFVELMGGYMETPQVSEYIVRWGLPNESGIIGSLLLAEHEHQK

SEQ ID NO: 4944 - protein, 161 aa, Enterococcus faecium
  misc_feature (B) LOCATION 1...161
  hypothetical: YES
KEDNMGHPKILHDTKGNISSEEKAIRVDAREELFKQQPLINITPPDWMAASARSEWNRIVPTLKKDYPLSEADYGSLVAYCLAFARMKTAEAEIRKSGTFITCENGVKKANPAVRVQSQAMSDLKKQATSLGMTLESRSKLALNKVKNDEPEDPFKELMNS

SEQ ID NO: 4945 - protein, 92 aa, Enterococcus faecium
  misc_feature (B) LOCATION 1...92
  hypothetical: YES
QGDNNYSKKGDCDKSRVTVLFFRINGVQKLASAVISPAKLKTLGAVFTWLFLLLDAEQLFYNLSNKRCSISCPSILAQKTAKYEELFFRLFL

SEQ ID NO: 4946 - protein, 487 aa, Enterococcus faecium
  misc_feature (B) LOCATION 1...487
  hypothetical: YES
KSCKISWIKQKKIIKRIIKKTIKKQKGGISLENAWKELQPKNIYQGRKAAPLREDSKNALLYLYQPLIGGEALSIYFTLLSEISQESGKGPEGMHADLLSSLGCGIPQFYDARKKLEGIGLLDVYFKEDSDLGPRFIYELLEPLIPKAFFKDSVLAFLLLEKVGERRFQKLTQFFEPKRHTAEGYQKITKKFLDVYRFNEAVYAANQENIESLNKSFEESESVALLEADSTFDWQFLNDWLAKKHIASLDDPIIKQVDMYHQLYGFDELTLGELISQSYDFSEQKVSEKELQKAILAMQRRPVKQTKETVAVSENSNEPSSNEHLTNAALQLIKEAQSIPPMKYLEAIKSEKGGYVSKQENWLLQDLVSQSGLSSSVINVLLNYVLVIKNNASLNASYVNTVANEWAQKKIATAEEAIQHIRQISNQAKQSKQKKQTNYQTGKRNVRREKLPDWVNQPKDEKQISSEKKAEIDRRFKEYLAKKEGDI

SEQ ID NO: 4947 - protein, 334 aa, Enterococcus faecium
  misc_feature (B) LOCATION 1...334
  hypothetical: YES
RLCKIIRKEVCKMKKILVLHTGGTIAMKENMLTGGVSPDVANPLLDAEITIPKHVELLVEDIFNLPSPHIMPSHMLVLKERILSAYASGISGVVITHRTDTLEETAFFLDTTIGNKLPIVLTGAMRSSNELGSDGLYNFESAIRVASCEEALDKGVLVVMNDEIHSARYVTKTHTTNVATFRTPTLGPIGLVTKNRILFLQELLETKRLDISAVDGTIPIVKAYAGMQGDLLEAIAHTKVDGLVIEALGAGNLPPQALAALEKLLVQKIPVVLVSRCFNGIAEPVYDYEGGGKELEKMGIIFCNSINSQKARVKLLIAVNYGLSGEELISFIQN

SEQ ID NO: 4948 - protein, 166 aa, Enterococcus faecium
  misc_feature (B) LOCATION 1...166
  hypothetical: YES
QLRNYLYGGQKMIEELNKKDLPWSLLLDADPDKEKVQVYVSRGSGWIWKEKEKTIGVLIYVAREKEYEIVNVAVAPTYQGKGIGGKLLETAFQKLSQLASSQTQIIIRTGSTSSAALHLYQKMGYVEIGRVKDYFIHHYSEPIFENGDQLRDQVILAIHLPKNSFN

SEQ ID NO: 4949 - protein, 60 aa, Enterococcus faecium
  misc_feature (B) LOCATION 1...60
  hypothetical: YES
RLRKATATDFFAACCPTIYSSNSLTICLGVCFNSYISTHLLQFFYDNIMISKDTDICGNI

SEQ ID NO: 4950 - protein, 255 aa, Enterococcus faecium
  misc_feature (B) LOCATION 1...255
  hypothetical: YES
NNSNTIRRNVMDVKGKNVFITGSTRGIGKAMALAFAKAGANIILNGRGEIPKEKIEEIEAFGVKCVGVSGDISDYEKAGQMIKEAEEKLGSIHVLVNNAGITNDKLVMRMDAEDFKKCLDINLIGTFNMTQHVLKKMMKQREGAIINLSSVSGLIGNIGQANYAASKAGVVGLTKSVAREAATRGITCNAIAPGFITTDMTEVLADKVKEQAEKQIPMQRFGQVEDIAQTAVFLAQNPYITGQVINVDGGLVMHG

SEQ ID NO: 4951 - protein, 145 aa, Enterococcus faecium
  misc_feature (B) LOCATION 1...145
  hypothetical: YES
PSSKWSIERSSTMKKAYETAMINHGGRNGEVEAPNGSMHMKITPPGIHAEGTNPEQLFAAGYASCFNGAVQHMIKEAGMTAESTVKARVSLYNLDDGGYQIGVVLEVHIDGISEEEAQKIAEDAHEFCPYSKATRGNIDVEVTIV

SEQ ID NO: 4952 - protein, 174 aa, Enterococcus faecium
  misc_feature (B) LOCATION 1...174
  hypothetical: YES
EYSKVLYYLWKKKNRQSFYSWKMDETYIKIKGRWHYLYRAIDADGLTLDIWLRKKRDTQAAYAFLKRLVKQFDEPKVVVTDKAPSITSAFKKLKEYGFYQGTEHRTIKYLNNLIEQDHRPVKRRNKFYRSLRTASTTIKGMEAIRGLYKKTRKEGTLFGFSVCTEIKVLLGIPA

SEQ ID NO: 4953 - protein, 301 aa, Enterococcus faecium
  misc_feature (B) LOCATION 1...301
  hypothetical: YES
ERSNKMKKVLFTLGMIGVLLAGCGSGSGNTDGSATQNNSSDSNEQVKIVAVGSTALQPLVDAAQESFVQENPNYQISVQGGGSGTGLSQVEAGAVTIGNSDVFAEERDGIDASKLVDHKVAVVGMAPIVNKDTGVKDITKQELIDIFTGKITNWNEVGGKDQKINVVNRANGSGTRATFEKWGLDGATPIQSQEQDSSGTVRQLVSQTPGAISYLAFSYLDDSTQALSIDGVEPKEENVADNSWKIWSYEHMYTNGKPSPEVQKFLDYMMTEEIQEGPVKELGYLPITMMEVERDHEGNIK

SEQ ID NO: 4954 - protein, 398 aa, Enterococcus faecium
  misc_feature (B) LOCATION 1...398
  hypothetical: YES
KRSKIMHKLIELIEKGKPFFEKISRNIYLRAIRDGFIAGMPVILFSSIFILIAYVPNAWGFHWSKDIETFLMTPYSYSMGILAFFVGGTTAKALTDSMNRDLPATNQINFLSTMLASMVGFLLMAAEPAKEGCFLTAFTGTKGLLTAFIAAFVTVNVYNVCVKNNVTIRMPEEVPPNISQVFKDLIPFTVAVVLLYGFELIVKGTLGVTVAESIGTLLAPLFSAADGYLGITLIFGAYAFFWFVGIHGPSIVEPAIAAITYANIDANLHLIQAGQHADKVITSGTQMFIVTMGGTGATLIVPFLFMWICKSERNRAIGRASVVPTFFGVNEPILFGAPIVLNPIFFVPFIFAPIVNVWIFKFFVDTLNMNSFSANLPWVTPGPLGIVLGTNFQVLSFI

SEQ ID NO: 4955 - protein, 174 aa, Enterococcus faecium
  misc_feature (B) LOCATION 1...174
  hypothetical: YES
RGSNNMVVKTETLEEKARELLKERGVTVEDIAQLVMFLQKDYISDLTLADCTESVNSVLTKREVHNAIITGIQLDILAEKKKLMSPLQHIIEDDEGLYGIDEILALSIVNVYGTIGFTNYGYIDKVKPGILKELNSHDGVHVHTFLDDIVGAIAAAAASRLAHKEPEKRSRLTQ

SEQ ID NO: 4956 - protein, 64 aa, Enterococcus faecium
  misc_feature (B) LOCATION 1...64
  hypothetical: YES
PIGNKARFCKIWEAIFQNRFLSLKAEHLCHNLSTKWCLKACICDNKNNQTKNRKHYFSLVVLIT

SEQ ID NO: 4957 - protein, 83 aa, Enterococcus faecium
  misc_feature (B) LOCATION 1...83
  hypothetical: YES
TIGNKAQFCKIGEAILQNRFLLLKAEHLFHNLFIYLYLLNRYFLLSLKVALARFHHLKHDGIATFGLSVLFSHELLRNWTDGC

SEQ ID NO: 4958 - protein, 87 aa, Enterococcus faecium
  misc_feature (B) LOCATION 1...87
  hypothetical: YES
ILGKNNAKILSLLLSQNKKTLIYQRFLQYLLVSTIHIYMETAGSGNNIGVYVDAATARYAKPVAGFATTENKIIGRGLIINNGQVLS

SEQ ID NO: 4959 - protein, 157 aa, Enterococcus faecium
  misc_feature (B) LOCATION 1...157
  hypothetical: YES
NEGKEVSDTIQVGIMIEIPAAAVLADKFAKEVDFFSVGTNDLIQYTMAADRMNERVSYLYQPYNPSILRLIKNVIDAAHAEGKWAGMCGEMAGDQTAVPLLVGMGLDEFSMSATSILKTRSLMKRLDTAKMAELADRALKECDMMEEVVELVHEYVK

SEQ ID NO: 4960 - protein, 104 aa, Enterococcus faecium
  misc_feature (B) LOCATION 1...104
  hypothetical: YES
KMGKFQVIDHPLIQHKLTIIRDKNCGTKVFREVVDEIAMLMAYEVSRDMPLEDIVIETPITETTQKTLSGKKVAIIPILRAGIGMVDGILELIPVYKVGHIDLY

SEQ ID NO: 4961 - protein, 206 aa, Enterococcus faecium
  misc_feature (B) LOCATION 1...206
  hypothetical: YES
VFLNYKTILKAGKKMPIRVILIDDEQTILDGMKQLINWSEHGFQLIGTFSSPLKALDFSLVHAIDIVVTDVMMPELNGIELSRLLKQQQPETQILILSSYDEFDMVKDSFKEGVADYLLKPRLSPDFFLNSLTAVSQKIKKKPNKSPITNRYEQICENLSQQIAGQTRPLLDPLLFEHTLFFCYIPKNGHSVQNKALNKNSRSPIH

SEQ ID NO: 4962 - protein, 96 aa, Enterococcus faecium
  misc_feature (B) LOCATION 1...96
  hypothetical: YES
AFLKIVLFSLKFWFRLLQPVFGSPLIHTVHVLTPNEADHVSDVPTDDTSIYFFYATYKVFDGGHPSKGRHSDHATVFFVVQNSFSFSSXHIHVFMT

SEQ ID NO: 4963 - protein, 237 aa, Enterococcus faecium
  misc_feature (B) LOCATION 1...237
  hypothetical: YES
KVLKYCMIFLDESLDGGASLDSRVLKEYLDKNGFPIIRKGYHKYLTFEGMEDSHTYILKEGTVKASVISNDGREFNLRYIKDLEIVSLLKDEYSQFIDSPYNIRVESEYAEFYRINRVRFWQNINQDPKLQHYVKEYYRYRLLYSMKKMQQMLLNGKLGAVCTQLYELYDLFGVRTEEGMLIDFSITNEEIAKFCGISTASSVNRILKQLKKDGIITVKDHHIVILNMDLLEDNIIF

SEQ ID NO: 4964 - protein, 274 aa, Enterococcus faecium
  misc_feature (B) LOCATION 1...274
  hypothetical: YES
VFSLYFVIIKDNKIVNWKGTVMKKNKVILSISLAAALLFAAGCSANNTTSSSSSTESSKSTSTAESTTASSVDLNALELPQLTKDVAENEDLVEMVTNKGTIKIKLFPEHAPKAVENFMTHAKDGYYNGLTFHRVIKDFMIQGGDPKGDGTGGESIWGEGFETEINNHLYNIRGALSMARSQDPNSHGSQFFIVRYTDDMHDGLXKDDYPQAIIDDYKNGGYPSLDGLYTVFGQVIEGIDVVDAIANIETDSSDKPTEEVKIDNINILQEATQK

SEQ ID NO: 4965 - protein, 186 aa, Enterococcus faecium
  misc_feature (B) LOCATION 1...186
  hypothetical: YES
QLLKEMLKMNKPRLDARMIAIMGLLIALMVTLSRLVAIETPFIKISVTFIPQVIMGILFGPFWSGIGAVLADLVGMALFSKSAFFIGFTLNAFIEGAIYGFFFYRKEITWKNAILATLSVTLIINLFLTPLWLALMYHVPLFSWVVWAPRLLKTVIWLPIQSIAIYYVGRSIPYKKILRSLAIHAK

SEQ ID NO: 4966 - protein, 233 aa, Enterococcus faecium
  misc_feature (B) LOCATION 1...233
  hypothetical: YES
VNLKFIFKNAMITVKLQVNFTCKLYHFLKGVFMAKIGYIRVSSQDQNLDRQLAMMEDLNIDKLFQEKASGKDIQRPEFQKLLNYIREGDCVIVASLDRLGRDYEDIKNTVTFMKQKKVALKILDAQFLDFNTGNELLDTAMFDMFLSLLSYIAQNEREKIRERQRQGVLLAKKAGRYKGRPIEYSENSTDPQKRLVFKTVVDMLNQGVPVAEIAKENGLSRPTIYKIKKANDL

SEQ ID NO: 4967 - protein, 103 aa, Enterococcus faecium
  misc_feature (B) LOCATION 1...103
  hypothetical: YES
VNLNMQKNLERSGSQMMIKKLIEEKQKDKDFAEAYDREGRKLETAVALYHAREEAGLTQAELAQKAHTTQSTIARIERGDNVSFDKLDDIARALGKKLVVEFA

SEQ ID NO: 4968 - protein, 174 aa, Enterococcus faecium
  misc_feature (B) LOCATION 1...174
  hypothetical: YES
HILKIIARKEIYSGRYQIIKAMLFCCCLLIYVLEEKRMDKEIKVTVKLDLTELKELLNKASDQVEQIKYQGMDRKRLIDIIEQQRLELIQKEAVCKEYKKHLEQVIEYHSVEKYRSVVQKNRATSPDPRQDVSISIKTPVFNSVKSEKLESISTALVEKAAEMNSLANEVSRLI

SEQ ID NO: 4969 - protein, 79 aa, Enterococcus faecium
  misc_feature (B) LOCATION 1...79
  hypothetical: YES
LTLKYLPSFFVIDIEELELSYKAFSISLLDFIIVKQEYKQERTIVNMIKIIKVLFFFLVIYAIAFFITFLTTPLYFLTP

SEQ ID NO: 4970 - protein, 311 aa, Enterococcus faecium
  misc_feature (B) LOCATION 1...311
  hypothetical: YES
SQLNCLFFIHFMRKKSLMKRFKGSKMSKKIGKESLSLGLKKEIVKFKSMYREPEFRLIFQLDIVRGLKISFSCLGYLVWLFIARVGWSNAYSFYKLFAGTDRLKESLEVKEALNILGSLAFSLFIFALFILQVGKIMMSTNDNYINYLKPFQKGIKIICRQGTVLFLLSLYEHEIHFQNYYNTTTKLGAFLLLYLVSNIAEKMLFKHIVKQVFSDIQKESYCLKTPYGNLKNVELFLFKMDSKWDKYIYRSKEVFLTGSYNKTLQESLYDTGAIFNNEPMVLKDFFGDYELVWNPKQLSEQGAENEFAEVH

SEQ ID NO: 4971 - protein, 297 aa, Enterococcus faecium
  misc_feature (B) LOCATION 1...297
  hypothetical: YES
IKLNERRSAQIVEKRQKMENQEVGYTTKDWMLRFVKGMFIGSGFILPGVSGGALAAVFGMYERLISFLAHLTKNFKENVLFFLPVGLGGVTGIFLLSFLVSFLLGAYETTILWFFVGCIAGTVPALWKEAGKKGRDTSDVIIMVVTFVLAYLFLLYGAQLFDGQVDQNFGTWLIAGGLIGLGMIVPGLSPSNFLVYMGLYKAMADGFKEVRLEVIVPIGIGGILCVLGLSKIMDYIFSKAYSKLFHFILGVVFASTIMIIPTDYAGLGVAGVLACPVLFIAGTALGWWMSRLEEQYK

SEQ ID NO: 4972 - protein, 383 aa, Enterococcus faecium
  misc_feature (B) LOCATION 1...383
  hypothetical: YES
EMLKVWVEQTKDGRFKFIERYVDPYTEKTRKKSTTLTSNSPQAWKKAQKILDKKIKEALEDYNKSDITFGELYKEWYEYYKQHVKRTSYLKVPMMMKHVSKHISDDTIVRNIDETLINKIIEDMYTFGDLSLNYTKQTKTTLSVMLNYAIDRKYIQRNPALAVKIHPKKVEEEKRRLSMNKKYLEKEEIDQILKQLYSNPRRKLHGIIAEFLYLTGLRYGELLALQMKDYEDGKISINGTLDYTSVKMDNAIKTTPKNTYSQREVQLPNRAKELIESVIADNILAGRPTDPDQYIFISTSGTPLALHSFNAILHKVEEELELEKSLSSHIFRHSHVSLLSELGVPLKAIMERVGHSDANTTLSIYNHVTKRAKQQVIDKLNSL

SEQ ID NO: 4973 - protein, 302 aa, Enterococcus faecium
  misc_feature (B) LOCATION 1...302
  hypothetical: YES
KFLKGANQVLKKSTMKDNLIGYGFLAPALLLLTIFLIIPVIMVIYYAFTDYYLLTPDARQFIGLENFKRLFADPIFVKSIWNTAKFVVWIIPVQLGAALGMALIINKNRKGNIFFKVAFFAPVVMSLVVISILWLYLLNPNEGLVNTLFAKIGIASQPFLTSPKQAMYTLVFVSAWQGAGYQMLLFLGGMQNIPQDVYEAAEIDGFSKFQQFRYITMPLLKPTAIFILLTTLISAFKLIIQPMVMTQGGPMNSTMTMVYYIYQTGFTDRMVGYSSSIALIFTTMIGLITIAQRKLVKEDDPA

SEQ ID NO: 4974 - protein, 345 aa, Enterococcus faecium
  misc_feature (B) LOCATION 1...345
  hypothetical: YES
NSLKLVHYFKICYSLFIQSVKGDPMLKEKMKTLPMLPGVYLMKDRDGKVIYVGKAKRLKNRVSSYFHQNKQHSKKVLRMIHHITDFDFVVVDTELDALLLECQLIQHYRPFYNRQMNYFSNYNYVHITNKGFVLTDTPTARTYGPFRLYKKMPSILRIMEETYQMPWLSEISLLALRVQLPDLQEMTFEQKKKELQGLFQGRNKKLLTYLKKRQQHFIYQLNFEKAGMLQKDIELVTYFIRRIQEQKQFLRTPSLTFSMPLAADESQKKHYLVCYGQLAETMITSGDVSPDFYYEKKEAHLSLKRQLSKEEIDPVQILISYRKKLEKEQFEIELLNKKEAEKQLN

SEQ ID NO: 4975 - protein, 321 aa, Enterococcus faecium
  misc_feature (B) LOCATION 1...321
  hypothetical: YES
KILKKSVLRNSNQINQKIWMNWLFVKTLLMQLNDFLGAPSSRHTPSGKRLYREKQNGFMLEYYQLYLNELETVPALYAYPEKEGPFPPVLYLHSHGGDFSVGKSELIHGAPYLASPSFAEVLTGMGYAVWSIDAWGFEERGGISESELFKQFLLTGKTLWGMRIYDVISLIDYLETREDTDTQRLATIGLSMGGLLSWWVTALDSRVKVCIDLAAQVDIEILLLHRRLDHHGFYYYVPNLLTAYTTLAIQEKIAPRPRLSLVGKNDTMCLDEGVLKLRKGLDKKYQSMGSPENFFFFSLTGGHMETQEMRNIWKQFIREHL

SEQ ID NO: 4976 - protein, 327 aa, Enterococcus faecium
  misc_feature (B) LOCATION 1...327
  hypothetical: YES
EYIKAALFDYKKRGIIKLCISEQKEVRHMLQKKISGEQVNTMVSDQYEIYHVKDVVSQNKTIYHHHDFYEIHATLKGEATFYLNGRQFTIKAGSVLLIHSNDLHRIVRQSSDVFERVYIFVTPSFLESRSTPWSNLSACFQPMGEKRSRVLQIEQEVLKQKLSFIDHPPDKKIYGEDIKYEQALVEYLIFLNQVVQKEESAQEQNAVVPNERVEQMLQYISKNLSHPLSLEEMEKQFFVSKYHITREFKKYTGFTFHQYVMKKKLIYAKHLLREYRSSSAVYSKSGFSSYPHFLKAFKREFGITPKEFLKRDTQKQLVHYEHFEDEQ

SEQ ID NO: 4977 - protein, 112 aa, Enterococcus faecium
  misc_feature (B) LOCATION 1...112
  hypothetical: YES
NNIKSFQSTQKKHKLTFIFFHPDYTVGFGISPNHAFRLVGYTTGRELHPALKIVIQLRTIIISDIISVNKKFFSRLSKYNNLQAGKHRLFLNILLFGKLLSPIWKQKLLSHL

SEQ ID NO: 4978 - protein, 215 aa, Enterococcus faecium
  misc_feature (B) LOCATION 1...215
  hypothetical: YES
ESINLMFGGEDMLGKVLEELFIRIWVIIKLTLYFWIYTFAGGIIFGLGAAWKTVNELFYLYGFEYKEITIKRGWNIYKRNFLRGNLLFSLFLSGTALLSYNLYLSVQIKGLIFLAIDFILLFALLCLFATYQYSMILDSEYTISVPNLLKLSFISVFSSFSSFLKIIIGSGIILGVTWQFKGLILFGVIGLLTVWNGTMTTHWREELDKQLESYE

SEQ ID NO: 4979 - protein, 114 aa, Enterococcus faecium
  misc_feature (B) LOCATION 1...114
  hypothetical: YES
KYIKEVSAMKLVNVTNSHSRLVLNQLENTDAHLVKVYTAGNTTIVYTEAPEHNEILLINDKRKIQPKEIEDAKNYFLDKIKDAVYHEDEIKVIELAGLVEISIPKHELGATLAV

SEQ ID NO: 4980 - protein, 63 aa, Enterococcus faecium
  misc_feature (B) LOCATION 1...63
  hypothetical: YES
QIINEVDSMKKFVSGILVGSLATAAAVAGLVASVKKTVIDPIDEKEAMIEENRKKAMRKRVSR

SEQ ID NO: 4981 - protein, 69 aa, Enterococcus faecium
  misc_feature (B) LOCATION 1...69
  hypothetical: YES
VQIKHLQLTWLHEDIKSKLLKLPMARVARSCWAVDIGYIVLSYTIIRKEILLCIVIKKMQKSKKIAGGF

SEQ ID NO: 4982 - protein, 167 aa, Enterococcus faecium
  misc_feature (B) LOCATION 1...167
  hypothetical: YES
KQIKKSRIAPTVLINSTNLLYHIKERFDLMQLLREVDFKQTRCNARDVLKNFRRLERMAGRSLIDIKSPIITDMPKAPKHGNKAEDAIIQMMDIEAERDAILAALMALSLISRQILYYSFCDVNKHSNYEIGQLIRGYGEKNVEKLKSIALIEFAEAYKKGVLVQYR

SEQ ID NO: 4983 - protein, 254 aa, Enterococcus faecium
  misc_feature (B) LOCATION 1...254
  hypothetical: YES
IKINGGGKRMSLIIDHVTGGYGHLPVLKDISFDVQPGEIVGLIGLNGAGKSTTIKHIIGLLEASKGTIEINHLSLKKNTEEYRKQIGYIPETPSLYEELTLREHIEVTAMAYDIPMDIAMKRAEKLLETFRLSNRLDWFPANFSKGMKQKVMILCAFLIEPSLYIIDEPFLGLDPLAINALLELMVEMKKEGAGILMSTHILATAEKYCDRFVVLHNGEIRADGSLEMLRKEFQLPDSSLDEIYIALTKEQAHE

SEQ ID NO: 4984 - protein, 106 aa, Enterococcus faecium
  misc_feature (B) LOCATION 1...106
  hypothetical: YES
NRIKILNFSCFCYNFSEVIVMEQYIGLLDKIRVIKTQPLLVRFTLRTSHEPINCVVANIEIADKLLILEEGKYTISVTGQFNKRNQLVIESMQIRNPDHFTRSMGI

SEQ ID NO: 4985 - protein, 281 aa, Enterococcus faecium
  misc_feature (B) LOCATION 1...281
  hypothetical: YES
MLINEQLVKRVITPRPKISHKGTFGRIVLIGGNEQYGGAIIMSALAAVHSGAGLTTVVTDEKNRSALHSHLPEAMIVVWTDTDQFLSVIKQADVLLIGPGLGTSSKSLERFKQVLENQSKEQWLVIDGSALSLLAANHLLLPYPEQTVLTPHQMEWQRLSSLPIQEQRDKENKKKQQEIGAVLVLKSHETKIYGHQHFYTNPLGSAAMATGGMGDTLAGMITGFLAQFPQNDQTIAAAIYLHSFIGDQLAKEQYIVLPTQISEALPKWMNYFCKKSMENEA

SEQ ID NO: 4986 - protein, 459 aa, Enterococcus faecium
  misc_feature (B) LOCATION 1...459
  hypothetical: YES
IMIKNAFAYVTRKSLKSLIIILVILSMSTLSLISLSIKDATDRASKETFANITNSFSMEINRQVNPGTPRGGGNVKGEDIKKISQTDSIDSYVKRINSVADLVDYDIIETQETLANQSPERAKNFKRTVMLTGVNDSTKETKFVSEAYKLVEGKHLENEDKNKILMHKDLAEKNNLKVGDKIKIKSNLFDADNEKGADETVEVEIKGLFDGHNSGVVSAAQELYENTLITDIHTAAKVYGNTEDTAVYQDATFFVKGDKNLDSVIKDLGKLDINWREYNLIKSSSNYPALQQSISGIYSISNKLFFGSLIFAGVVVSLLLFLWMNARKKEIAVLLSLGISKLEIFGQFLIEMVFISIPAFVGSYFLAQYTADKLGNNILNKVTGDIAKQIAKQSASSQLGGGAEAEGFNKTLSSLDINVLPKFMIYVVIFMSLVLLVSLIISSFNILRRNPKELLIDNN

SEQ ID NO: 4987 - protein, 232 aa, Enterococcus faecium
  misc_feature (B) LOCATION 1...232
  hypothetical: YES
IKIKSLIITIKSIGNCYWRRIMDFLRKFGFFFLLLGVLSDFLTPYVLGLYYPELDQMKSVISVFGEVSSPVRKAFLIWSVVSGIFFILSLPALYAAFVSTSRVLATLVTAAIAFYGIGDCIFTGLFSINTHESSWNVSTWVHNIGSGLGYSGFLLFPVLLFLIYRKNGQMDVSHLYLGLSVISLLFAAIYGLARIPSINSWPLLNKIGFCQRISFFFNYVPIAWLSILHLKQ

SEQ ID NO: 4988 - protein, 611 aa, Enterococcus faecium
  misc_feature (B) LOCATION 1...611
  hypothetical: YES
FWIKLMGEEIIVGLFDFLKKKQGKVSKHVDYQLASSLFRTGKVFAEKLEVDISNVDEFRKTFIAFDVETTGLNSSSDRIVEIGAVLFKEGVPIQSFGTLVNPKVRIAASASAINNITNEMLNSAPNEQEVYPQLVEFLGDALDGKITMCAHNASFDFGFLSNTFSRLGYDAKIKYVDTLSLSRKHIKGIVNHKQETVAEYFGLINDTAHRAESDADICGKIFWGVLDIIEESLEEQKKQIEKMTPDIKELEACAFIQDIIEKKGCDTSWIRYRKNSNNYVDVTCLYTFLKFKFAKKGNYIIIRKDATNGIDLPIEPCTVSEGGTTNVRVYFRSPFDLTPLSNYIFSAYSDCYNSMNEYMSVSNYTKKEAEQSLSMLKSISKSAMKELLFDAKNRGYDETEVNLNIEKVISREDVIINGLHNRVSLNKIRNIGNWEKGFDAGYPYWERGETARKNGKVDEAIALFDKARYNGYDAPALYDSYAKAYRKIKDYDNEILILDEGIMRKTRHDVGTLEARRDKAIKLLFAKQEAERIAKEKSDFLKANKKEDAISEPSKKRGRQIIQMTDDGTIIKEFDTIASAVKEVGVNSKSIRDAANGVQKHAGGYYWKYKD

SEQ ID NO: 4989 - protein, 322 aa, Enterococcus faecium
  misc_feature (B) LOCATION 1...322
  hypothetical: YES
HRIKPSKKSARIVGDVMGKYHPHGDSAIYESMVRMAQPFSYRYMLVDGHGNFGSVDGDGAAAMRYTEARMSKIATEMLRDINKNTVDFQSNYDDTEKEPVVLPARFPNLLVNGTTGIAVGMATNIPPHNLSEVVAAIDLLMDNPDVTTNELMEVLPGPDFPTGGLVMGKSGIRRAYETGKGSITVRAKVEITEMPNGKERIIVTELPYMVNKAKLIERISELHRDKRIEGITDLRDESSREGMRIVIDIRRDASASVILNNLYKLTSLQNSFGFKYVGDRKRCAESFELEPIPGKIFRNINAKSSHDGRSLKKKKQKQEHTS

SEQ ID NO: 4990 - protein, 64 aa, Enterococcus faecium
  misc_feature (B) LOCATION 1...64
  hypothetical: YES
SLVKSRFFLLFSSNPLPCHFFLLYLSVLEFSNRSNQSKNEEREPLYEKYAATSLLFYLYERTCS

SEQ ID NO: 4991 - protein, 370 aa, Enterococcus faecium
  misc_feature (B) LOCATION 1...370
  hypothetical: YES
MTVKNKSKKKGRQQVDFYQSLQLDPFILKQKIREAASKKEKCMYICSLFLRSLFIVLFAICFIIIITTLFESKHKPYAVVLFCMLMSIRFVDFGYKISHSIIGLAIVMFSLLVAPYVQLIKWSVMGMLIHFILLSSILMATASDPKMGNASLYGFSYLFIVYSLPKDSLNKNFFTQTSSLLFLFFCWFSVLLYRKHREKNKDKSLFKEIFLKGMYSQEKIWMLIYAFGISLLIVAGEYVPFQRLMWAGFAFSSIVSSYGLMSIGFKERAVDRIIGSLIGCVLFIGISQFIPFNWVGILGGLALGVCSTYRYKTVFNSFGALAITASLFGVPGAVTIRIFENILGVCLGIMYIGVTEILIRKIREKHGLNH

SEQ ID NO: 4992 - protein, 69 aa, Enterococcus faecium
  misc_feature (B) LOCATION 1...69
  hypothetical: YES
IYVKMWKAIFTKFFLLLETKRLFHKLLVNGVQSANPRYSLTKRQNMRNYFSVCFSNNQVKVLIAQPFFV

SEQ ID NO: 4993 - protein, 61 aa, Enterococcus faecium
  misc_feature (B) LOCATION 1...61
  hypothetical: YES
SHVKNSFFVQLAVVWKKNELMVYFKIAEFLEEFVKKVFYSLGYVRIGVVYLGRKTGEKKRI

SEQ ID NO: 4994 - protein, 309 aa, Enterococcus faecium
  misc_feature (B) LOCATION 1...309
  hypothetical: YES
VQVNNKKRKRERRDIVKRNYLVISIIALSVLLFFEITSVASLITEVKGQTHSSEHSSQSFKQSEQSTIKSQSTETANVKEAIQESAEKVQSQSSQSTQDSTKTSRDPAVKSVAISFDDGPGATTTPQLLRILKEKNVHATFFVLGENTAQHPEIVKQTAEAGHEIGNHTYDHQNLATLSAQSMTEEVTKADTEIKKVTGKTPTFVRPPYGSVTNVGATIIQRPIIEWSVDSEDWKTRNPDLILQKIQATVYDGAIILFHDIYPETIRAVPQVIDYLKEQGYRITTVGDLLGHPTAVENYYGRNDHRPVQ

SEQ ID NO: 4995 - protein, 171 aa, Enterococcus faecium
  misc_feature (B) LOCATION 1...171
  hypothetical: YES
SKVKERDFMNDMYLFIVFAASAYVLQAVISWKQLKHFNQTYSELRRKGKVAIGKRPGKIRSGTIVMLAIDDHDQVLEVRKMQGVTSLAKFHSLPVYAGEDIHYIDRYHPSVRAEDRLTQAALENAREVYLRIEAGNEKSEQPSLPFIAMLNNFRIWKSTIKEKRSDKRWIS

SEQ ID NO: 4996 - protein, 742 aa, Enterococcus faecium
  misc_feature (B) LOCATION 1...742
  hypothetical: YES
KKVNGFRFVGSEMMDITHRKTDKNFILFDEKSRVFHLRNTFLSYLIKIEESNVLAHIYFGKPVKQYKDNKNYPRRDRGFSGNVPLNPDRSLSKDTLPQEYSSHGSMDFRTPASIIQRKNGSDLLDLRYDSHYITDGKPEIEGLPQTYVMDKSEAQTLVISLKDRETAIYFDLFYTIFTDRAVITRSVKIRNETGETIKLEKAASFQLDFAHTRRFDEVIALPGAHVNERQISRQSVLSGTKVFESRRGTSSHHMNNFIALVHHHTTENTGEAIGLQFVYSGNHSFELEKDQINQLRVVGGINSHRFSWELNAGQSFQTPEMILSYSSQGLNKMSQIHHELLRERIARGRHQFAERPILVNNWEATYFDFNSEKIKAIIDEAKELGIEMFVLDDGWFGKRDADNSSLGDWFEYEGKLTNGLREIADYAHSKGLKFGLWFEPEMISVDSELYRTHPDFLMQEPGRMPSASRSQHVLDFTRLDVRQTIEKQMRKILDTIPLDYIKWDMNRSLSDVYSITLDPQRQGEVAHRYMLGLYELLEHLTTDYPEILWEGCSGGGGRFDAGFIYYMPQSWTSDNTDAVERMKIQYGTSLAYPISSITAHVSAVPNHQTDRSTSLKTRGETAMSAVFGYELDLTKLSPEEKKQVKDQIISYQTIRPVIQYGHYYRLASPFEENIAAWMFVSPKQDEAIVFLGRILASAQPAFHEVYLMGLDDEALYQEQTSKRIFSGSRIDDSWTLLPRFSR

SEQ ID NO: 4997 - protein, 243 aa, Enterococcus faecium
  misc_feature (B) LOCATION 1...243
  hypothetical: YES
FRCFPFYYVIKFYIGGLSMTLLIKNMNMKRGKKRVIRQLNLLVESGEVAALIAPNGFGKTTLLNGIAQLLPTTYDQLSLHNISPTAYTDYRRSFFFLESTNQLSDYLSAVDYLTLIKYYWQSKVECQTVFQRLKMTEYLTLPIGKMSLGMKQHVLLAAYLISDSSVMLFDEPLNGLDPGSIDILNSLIRQWQKEGKTILLSSHAIANIQSICSKACFLKNGEIVTESSNMEEILAIYRKLYEV

SEQ ID NO: 4998 - protein, 126 aa, Enterococcus faecium
  misc_feature (B) LOCATION 1...126
  hypothetical: YES
RGVNSKAPGEFGGKGFKSEGLEDQTKLAKYAGLSWKVNQSGNYQSQNTPLTKQGNRYFRYYLVEAANSVKNYLPEYKAFYQSKYKEVPKHQHKRALVLTARKFTRLVDTLLRKHQLYTPPRSVIEK

SEQ ID NO: 4999 - protein, 109 aa, Enterococcus faecium
  misc_feature (B) LOCATION 1...109
  hypothetical: YES
SFSNSSFVLMSTTLALTSITSKCVIFFTSLPITSCISSKIFSISLPYSTMTSISTATCFLPTSVSIPAVTLSVFTSFPATLEKKPPFADNKPSTCSIAIPMIFCTTLSS

SEQ ID NO: 5000 - protein, 68 aa, Enterococcus faecium
  misc_feature (B) LOCATION 1...68
  hypothetical: YES
INSKDMYKQQFHGWSMSIFSNDSRIGESYDRFGDLVIVISFRVGKDVMQFFCKQIFLLFFSIDNCCFT

SEQ ID NO: 5001 - protein, 741 aa, Enterococcus faecium
  misc_feature (B) LOCATION 1...741
  hypothetical: YES
TNSKKKDGKEINQLNEKEILRLQKELKRWENKYKKLQQVFRLQEEIIATYEAAYGEAPGLIEEEVQVKESEGNSSFFKMMEKRSYNRFNQEQKAAITYDMKKHLRIIAGAGSGKTQTICAKAVYLMTQKQVDEERILMITFTRNAANELKKRVDNFSQRKTAVHIGTFHSIFFRIYNEICRKFPEVAMQGIQGDFSKDTAQKVNAVLQQLIRKYNLYIFDQYGEKTIASRLDYWQNMNLSVEEMVQLVKEKYDSIDKNARQPISERLYGLLTELQEQKRSQQLLEFNDVLQNLKSALENEEIQHYIGQKYDYLFIDEFQDTNPLQWEIVKRMTKENRIKLIVVGDDDQSIYGFRGSEPAYIKNFEKEYPTKTLFLLTNYRSRAAIVQGANRLISYNKNDRIPKAMIPAQKEAGVMEAYLFSDTKAESQWLIKQIQTFIQKNGKYKESIILYRSASQTQQLVQSLLKTNIPFVLEADSPYEGIFGIKSFQHFYQKIVHWQTALNLQKKNQAYQQLLRQLMADCYLKKSECDQYFSPKYQNIAVADYILSISPNLKSKSAEIREFEEALRKTDQHQEIYSLVQSYLHLPRIAKEIDQSDQEWIREEVKQHATFRRLQALSQETQATAKELKTRLIAYRQGKLDALCIQSIHKSKGLSYRNVFLIGCNEGSLPYNGATEKKVIDFNEIKAEPVTTIEEERRLFYVAMTRARNRLYLCVPQMKNSRKLKVSRFIKETGSRVKKGK

SEQ ID NO: 5002 - protein, 686 aa, Enterococcus faecium
  misc_feature (B) LOCATION 1...686
  hypothetical: YES
MCSKRRSKQLNKHACRLDKERSCSEKHYVKFMMRTMLISLSVGVYMHVPVQATTQTIKVVRTSVSETTDSPITITHTFTDANGKQLLPALTSYNKVSYPPTINHYWLIPNKTLWTSETGSSVPLSIFSDMTDPTKGDQLKQITDILNHALTDIKDGGSAQVSYVYEKDYSQFERKKIDVLAGTKVSISDLVERLKNADGTQGDMSKVISNNGNIVDTTNTGTSTISLSYFDPIALKTMTASAVIHVRADQTAIKGKDLHLRTGESYAPKDLVEYVTKSDGTSGNKEEIKMNGTVDTTTPGEYPVVLTYIDSKTSNVAETTAVVYVEASAASSTVITHFIDSQTNKELQAETHMSSVNRIPDLRLPAEFSDRVPNIDLSTYEQNGKVTSISDWMQANGLDRKSHWSEILEVLHSELMNNRKQSGGEITFTYVYIPDNRSLEGHDLIVHPNEKINKEELIQSATNSLGKPVPLKDVSVTINEVPLEDGYLTKQTGDFTIMYSYHDPYSLQELHAQSLLHVLPLNKQIDQKEQKRQEESLSEKKQQMAHAVSPTGKVKQTRSLELARISRKISESNKTIRQEAHLAPQVSGLENEILEPKIKQQSEKEFVAKQSEDQKESDDQKETKKKRLSTIDSTDEHLQPQVPLPSPGTPAPGGGIPSSALGDFMRGMAGTWVYANRNEFDADDWF

SEQ ID NO: 5003 - protein, 153 aa, Enterococcus faecium
  misc_feature (B) LOCATION 1...153
  hypothetical: YES
IVSNTRCLRFRDIMESVYRQERKSNRKKGQMMIQKTRVMLYVNDVEMICRFFVEKIGAEISETIELPEEFKSIVLSISKELELGVFPKVFVQKFSPEVLGPPPSLVFFTDEFETIYENMEEPGEITDNNGILTFNFSDPEGNYFVIGKAESSD

SEQ ID NO: 5004 - protein, 166 aa, Enterococcus faecium
  misc_feature (B) LOCATION 1...166
  hypothetical: YES
KASKRMNKQIGVLQMRMNVESFNLDHTKVKAPYVRVADRKTGAHGDVIIKYDVRFKQPNKEHMDMPSLHSLEHLTAELIRNHADYIVDWSPMGCQTGFYLTVLNHESYEDILDVLEATMKDVLEATEVPASNETQCGWAASHTLEGAQALAREFLAKRDEWSEVEA

SEQ ID NO: 5005 - protein, 132 aa, Enterococcus faecium
  misc_feature (B) LOCATION 1...132
  hypothetical: YES
PRSNCIPSTTSSSVSIPFDSSIVMTPSFPTFSIASAIKCPTLSEPEETAATCAMASFESTTVEILCNSSTAAFVANSIPRRMPRGLAPAVTFFKPSRTIACVRTVAVVVPSPAISFVFDATSDTSFAPMFSK

SEQ ID NO: 5006 - protein, 87 aa, Enterococcus faecium
  misc_feature (B) LOCATION 1...87
  hypothetical: YES
MESNAIEQAQFHDRAHKEIIDLAVTAAENPMADEAEDFANVMAHPKDPAWGLLYEEWIELARNVNQVIYDLRKNGGIKFDADNEEDF

SEQ ID NO: 5007 - protein, 956 aa, Enterococcus faecium
  misc_feature (B) LOCATION 1...956
  hypothetical: YES
WGSNMKLVQNNEVKEIKNGFVKNSNKILGKLKKVGSFKKNKYHTGKIEGEDLPKSLQDKLNVPLVFIGVFLGSIVFLAITYLLNFLKALLVAIGQSESGLLGVEFDPKFSLAYLKPLGDTKQYFMCAVVAVIGVAYLIYGKLNHESEKNLVYGQKGDSRLSTIKEIKRDYHEIPEKTEVYDGIGGVPISHYQDKYYIDRDTVNTVVLGASRSGKGETFVVPLLDNLSRAKIQSNMVVNDPKGELFSASKETLEKRGYRVLVLNIDDPLESMSFNPLQLVIDSWANKDYHEASKRANTLTSMLFASGMGTDNEFFYKSAKSAVNAIILTIVEHCFNNDCIEKITMYNVAQMLNELGSLFYTDPKTGKEKNALDEYFNTLPQGNQAKIQYGSTSFAGDKAKGSILSTASQGIEMFTSDLFGKLTSKMSIDLKEIGFPKSIQFKVNTNLVGKRISISFLRKENDVIRLIKKYRVKVKALGLCVLNFNEYLQDGDMLDIRYEEEKSRAWYRIEFPKKQANSHDTSLVTKKFKSGKNYSDLEISTLRLKYTDQPTAVFMVIPDYDPSNHVLASIFISQLYTELASNCKQTPDKKCFRRVHFLLDEFGNMPAIDNMDGIMTVCLGRNMLFDLVIQSYSQLETRYDKAFKTIKENCQNHILIMSNDEETIEEISKKCGHKTTINRSASSKHLDTDSSVTSSAEQERVITVERASQLIEGEQIILRNLHRQDTKRNKIRPFPIFNTKETNMPYRYQFLAEDFDTQRDINEIDIACEHINLSLQDNQIPYARFIKDLKTRLEYSIINNIPISEEDYQDYLNLSGSQQTINEEELLKLVNTEVKSQDMEGQVLSEQEMKINIYLKESQKEAIELVKVINGRLADENSADMVIKTINSQILDTPFIQSLINDSIAIHNVQESKDQIMILEQQLANAYELAVFKTKNSILKNKIIKLKNAMTKLAKAI

SEQ ID NO: 5008 - protein, 321 aa, Enterococcus faecium
  misc_feature (B) LOCATION 1...321
  hypothetical: YES
RSPKMILTITMNPSIDSIYFTKHFELGTMTRFDSPVRYVGGKGINCGRASALLGSSVILTGFLGGYFGSMIQDMLKNENLFDLHFLPIAEESRGAVTIMHDDETQTELVEAGPEIADTTIKKLMNDIKLISKNNYLSVITINGSVNNPDPFLYAKLLQYIKEQIDPSTYILMDISGQHLREVLASKYKPMFIKPNIHEFSDIIHQKITQKSDIKHHLKTNPLFKDIDVIMISCGSYGAVVKVKEEFWNVEIPKIPIINTTGSGDATVGGFAHSLEQNYPLKECVRYAMACGMSNAQQSEVGKVIPADVKNLAKSIKITEMK

SEQ ID NO: 5009 - protein, 241 aa, Enterococcus faecium
  misc_feature (B) LOCATION 1...241
  hypothetical: YES
IIPKRREEIMQELVILKNKEAVTTSLQVAESFEKKHQHVLRDIDALKKDVSNFGQMFVEGNEPDSYGRNRRVFFISRDGFFLLAMGFTGKKAIYFKQKYIEAFNEMEDVIRKNTVPQTIEDMMIYQLEEMKDVKKDVSMLKDTMRISGQQEFEIKQKGNMKVMGVLGGKESRAYEEISKKVFSKFWSEFKRTFSIPRYGELPRKRFDDAVSFIEMWLPETAIRMEIDQLNRQQRLFGDDNE

SEQ ID NO: 5010 - protein, 80 aa, Enterococcus faecium
  misc_feature (B) LOCATION 1...80
  hypothetical: YES
HIPNYYLLIVLKACKNILMNLSRCNQMDLKTFTAQIELMHQEALRQSVSYEDKWLNTFHGGRESALDQVLKLLKGECRDG

SEQ ID NO: 5011 - protein, 99 aa, Enterococcus faecium
  misc_feature (B) LOCATION 1...99
  hypothetical: YES
PTPNNALVKQYVALIGTENVSVTFTKEAIERIAQIAFDVNRDTDNIGARRLHTILEKLLEDLLFEAPDMQMGEITITEAYVDDKLGSIAANEDLSRYIL

SEQ ID NO: 5012 - protein, 61 aa, Enterococcus faecium
  misc_feature (B) LOCATION 1...61
  hypothetical: YES
VQPNEKYEKLFLFGCSYYLMQNSFFTTSPINGVLLPAPRSPVTIFNKHEKLFFEIAPCDSE

SEQ ID NO: 5013 - protein, 503 aa, Enterococcus faecium
  misc_feature (B) LOCATION 1...503
  hypothetical: YES
IRPKRDYCKRRCSGNCKIRRKSGCNHVFQKNFYGVEQLLPNQLEGAYDRDGKGLSVADAMPGGKQRFAIIGSEEFDWTIDQEKYIYPNHRGIDHYDRFKEDLALFAEMGFKCYRFSIAWTRIFPNGDEGTPNEAGLEFYDQLIDECLKYDIEPVITISHYEMPLHLAKEYGGWKNRKLIDFYERFAQTVLERYSSKVKYWMTFNEINSAFHFPALSQGLVKSNGAGEYQNIFQAWHNQFVASSKAVKIGHELRSDIQIGCMIIYATTYSIDANPVNQAATMIQNQEFNFFCTDVQVRGEYPAYTARTHKKYGVDPEKLEQTEKDFQLLKEYPVDYIGFSYYMSTAINETDPQAATSEGNLLGGVKNPFLEASEWGWQIDPEGLRIALNELYNRYQKPLFIVENGLGAIDHMEEDGTIIDDYRIDYLRRHIEAMANAVADGVDLMGYTPWGCIDLVSASTGEMSKRYGFIYVDLDDEGNGTLNRSKKKSFDWYKEVIASNGVNL

SEQ ID NO: 5014 - protein, 79 aa, Enterococcus faecium
  misc_feature (B) LOCATION 1...79
  hypothetical: YES
SLPNPFSELYSLYLFRYNGIANDTSVGRTERVGLMSEQNQNLASNYSKKYTYRSEPKQISFRVSESEFAKLKQSAEALQ

SEQ ID NO: 5015 - protein, 63 aa, Enterococcus faecium
  misc_feature (B) LOCATION 1...63
  hypothetical: YES
AITKSALITMIGPRSGIDASLPEIFVLPKIDEEWEKYSQPESTDYEQKINELDAEVITAQTGN

SEQ ID NO: 5016 - protein, 109 aa, Enterococcus faecium
  misc_feature (B) LOCATION 1...109
  hypothetical: YES
MITKTRKQGNSIMLTVPKDFNVPNGVEVEAKLVENGILYEFVEPQKEFYDFSEDILSDIIAEGYDKDEILVEFKNRKNKMHSSFRDIAEDTLTNSKVMTKEELATEIGL

SEQ ID NO: 5017 - protein, 97 aa, Enterococcus faecium
  misc_feature (B) LOCATION 1...97
  hypothetical: YES
IITKKTRPQQTCSLISTQSACQNHPISPSMPVLKLNVHHLSSFLVQHVCNHTYNFQSNNRFRLAKSCKIQAANPSFTTLIILNTHNVYKCNHSKKSV

SEQ ID NO: 5018 - protein, 79 aa, Enterococcus faecium
  misc_feature (B) LOCATION 1...79
  hypothetical: YES
RKTKKRGNEMVKAEVGRSYICKPIGVSHELIGCIERTYNNTAVVYVESYDQRDYPIIYESKYRMLVKFCDISTPAELVS

SEQ ID NO: 5019 - protein, 316 aa, Enterococcus faecium
  misc_feature (B) LOCATION 1...316
  hypothetical: YES
MKTKKSLFLILAVSFLVLAGCGKQASDQADEGSKEKLSVVATNSILADMAKEVGTDQIDIHSIVPVGTDPHEYEVLPEDIKKASDADVILYNGLNLETGNSWFDNLMETAKKEEGKDYFAVSKNVEPLYLTSGEEHTKADPHAWLDLSNGIKYVEEIARIFSEKDAENATLYKKNAEAYVEKLKELDTQAKESFASIEENKKLLVTSEGAFKYFSRAYDLPAAYIWEINTESQGTPDQMKAIIDQIRAKEVPVLFVETSVDSRSMERVAKETGLKIYDKLFTDSIAKEGEQGDSYYQMMKWNIETIHEGLSQTKES

SEQ ID NO: 5020 - protein, 189 aa, Enterococcus faecium
  misc_feature (B) LOCATION 1...189
  hypothetical: YES
EETKMENKNMNTTNGSVLANEKGENRMMNGELTYEDKVIQKIIGYALKDVDGLLTLDGGFFSNMAEKLVNTDNVTAGINTEVGKKQVAVDLDVIVEYGKDIEDIYNQIKELISTEVNNMTHLDVIEVNVNVADIKTQEEYQKDQETVQDKVTEAAKSTGQFASRQTDKAKSAVGKGAQKVKENNEPRVQ

SEQ ID NO: 5021 - protein, 112 aa, Enterococcus faecium
  misc_feature (B) LOCATION 1...112
  hypothetical: YES
TRTKRNNALKIIRFYKKISKPRCQFQKVVLDCFQYLKQHFLFKYGKLPSRAKQLQENEFTLLLVLHTYLYIVIIWMTVSSQYRKCWTISKRLAISPFFSYDKVEGVFSLTET

SEQ ID NO: 5022 - protein, 414 aa, Enterococcus faecium
  misc_feature (B) LOCATION 1...414
  hypothetical: YES
ERTKYVLFYVTAMSVSIVLMKFFQLFQTEQATYIPLFYPAAFAPLVLSFFLNRRAGIMAGIFQAVSALFIFYDSIGTNFLTIILMSYVFSGLMATIVRRKRISEQGLSAAMWVIIFPVMMDVILIVYQGMSFGDATTWLMLVCGFTGALFSFLLTIGLHPYIELMVNDDSVIVLNELSNPNHPLLKQLLEEAPGTYHHSMMVANLSANAVAEIGGRSLLTRVACYYHDIGKIKHASFFVENLPSGAENPHNFLLPEDSKHIIFGHVTDGAKILEDYNMPQMVIDICKQHHGTTLMRYFYIKAKERNPEVTEEQFRYPGPKPQSREAGIVNIADSCEAAVRAMDHPTSEKIESFVHNLIEERISDGQLDDSGLTLKEIRKVEKSLISGLSSTFHSRIKYPKMKTEVEKIKEEQEE

SEQ ID NO: 5023 - protein, 184 aa, Enterococcus faecium
  misc_feature (B) LOCATION 1...184
  hypothetical: YES
RLTKKQRYINRFWLVFKYLLVSVFLAFMLRGFLFIPVPVEGNSMENVLKQGDMVVMEKFSEIRRFDIVVFQLADGTIYIKRVIGLPGENVSYQNDQLKINGKVVKEPYLTKNLKSDHANASYTTDFTLQELTGQSKLPEDNYFVLGDNRRVSKDSRSFGTINKTDILGKARFVYYPLDEIKWIQ

SEQ ID NO: 5024 - protein, 210 aa, Enterococcus faecium
  misc_feature (B) LOCATION 1...210
  hypothetical: YES
SMTKSKPIIIGVTGGSGSGKTSVSRAIFNNFPDHSIMMLEQDSYYKDQSHLSFEERLNTNYDHPFAFDNDLLIQHVGDLLNYKAIEKPVYDYVAHTRSQATIIQEPKEVIILEGILILEDERLRDLMDIKVYVDTDDDIRIIRRIKRDMEERGRTLDSVIEQYLTVVKPMYHQFIEPTKRYADIIVPEGGENHVAIDLITTKVASFLNHK

SEQ ID NO: 5025 - protein, 139 aa, Enterococcus faecium
  misc_feature (B) LOCATION 1...139
  hypothetical: YES
MMTKHEEIQKGVIFPAGEKNEAYAQVFTGQSYLNMLVNDPEISVGVGNVTFEPGCRNHWHVHTDGYQILLVTGGEGWYQEEGKPARRLMAGDVVVTHKGIKHWHGATKDSWFEHLAITAGNSEFLEPVTDELYEGLENQ

SEQ ID NO: 5026 - protein, 70 aa, Enterococcus faecium
  misc_feature (B) LOCATION 1...70
  hypothetical: YES
SMTNEVTAGHAASVGRVDPEEMYYLMSRGLHKEEAERLVIRGFLGSVLTAIPVEQVRKELVEVIEGKLNG

SEQ ID NO: 5027 - protein, 186 aa, Enterococcus faecium
  misc_feature (B) LOCATION 1...186
  hypothetical: YES
EETNMVESPFHSTTICAVEKDGKFAMAGDGQVTMGESVVMKGTAKKVRRIYNGEVVVGFAGSVADAFTLEEKFEGKLNEYNGNLQRAAVELAQEWRTQQSMQKLEAMLIVMNDKEMLLVSGTGEVITPDDGILAIGSGGNFALAAARAMKNYAQNDMSAKEIAENALNIAADICIFTNHNIIVEEL

SEQ ID NO: 5028 - protein, 69 aa, Enterococcus faecium
  misc_feature (B) LOCATION 1...69
  hypothetical: YES
YHANPKFSDDFFAITFSNSILIYWCLHFSYDHDAAIMVDHRSAYRYGISDYGTFIYKDGQALHDHSKTD

SEQ ID NO: 5029 - protein, 211 aa, Enterococcus faecium
  misc_feature (B) LOCATION 1...211
  hypothetical: YES
ISAKDNGGKNMIFAYNKAHVGDTLMVIIADDKGTENTVERKWNVARIKDEQGQVVAWNFFHISDHLTIEGNGQVSLTDEELAKLNRLIKEAGFEEQLEADHEPKIVVGYVKTCVPHPDSDHLSITETEVDNGTVLQIVCGAPNIEAGQKVVVAKPGAMMPDGMMIWPGTLRGVDSYGMICSARELHLPNAPAKKGILVLPEDAVVGEAFPK

SEQ ID NO: 5030 - protein, 179 aa, Enterococcus faecium
  misc_feature (B) LOCATION 1...179
  hypothetical: YES
MQAKEVVDQVTMKRALTRITYEIIERNHSIQDIVLVGIKTRGIYIASRIAERLKQLEDIDIPVGELDITLYRDDKKENPEEPELHSSDIPVSLEGKEVILIDDVLYTGRTIRAAMDAVMDFGRPRKISLAVLVDRGHRELPIRADYVGKNIPTSRAEEILVEMQELDGQDRIMILKEED

SEQ ID NO: 5031 - protein, 94 aa, Enterococcus faecium
  misc_feature (B) LOCATION 1...94
  hypothetical: YES
VKAKMTENSESKKEKIFFTKNKLADRSILFTTRRPSATTSGMREKSESIKTTCEACMAASLPEAIAILQSASFMARMSFTPSPVIATVLLRFSN

SEQ ID NO: 5032 - protein, 167 aa, Enterococcus faecium
  misc_feature (B) LOCATION 1...167
  hypothetical: YES
SRANKKSRIAPTDSINPTHLLYHIKERFDLMQLLREVDFKQTRCNARDVLKNFRRLERMAGRSLIDIKSPIITDMPKAPKHGNKAEDAIIQMMDIETERDAILAALMALSLISRQILYYSFCVPDSFSNYRISREVGYSERSIQRMKSEALIEFAEAYKHGKIIAYK

SEQ ID NO: 5033 - protein, 396 aa, Enterococcus faecium
  misc_feature (B) LOCATION 1...396
  hypothetical: YES
IMAKEHYDRSKPHVNIGTIGHVDHGKTTLTAAITTVLGKKGLANPQDYASIDAAPEERERGITINTAHVEYETEKRHYAHIDAPGHADYVKNMITGAAQMDGAILVVSATDGPMPQTREHILLSRQVGVKYLIVFLNKVDLVDDEELIDLVEMEVRELLSEYGFPGDDTPVIKGSALKALQGDPDAEAAIMELMDTVDEYIPTPERDTDKPLLLPVEDVFSITGRRTVASGRIDRGAVRVGDEVKIGRIKPETQKAIVTGVKMFRKTLNYGETGDNVGVLLRGIQRDDIERGQVLAKPGSITPHTKFKAEVYVLTKEQGGRHTPFFNNYRPQFYFRTTDVTGTITLPEDTEMVMPGDNVTIDVDLIHPIAVENGTTFSIREGGRTVGSGIVTEIEA

SEQ ID NO: 5034 - protein, 264 aa, Enterococcus faecium
  misc_feature (B) LOCATION 1...264
  hypothetical: YES
SMAKQNIVVVGAGYAGVSATKYLAKKLKKEDVAITLIDRHSYHTMMTELHEVAGGRVEPEAIQYDLQHLFARQKNVQLVTDTVIGIDKERKIVKTKLGSYPFDQLILGMGGEPNDFGTPGVKAHGFTLWSFEDSVRIREHIEKTVAKAALEPDDELRKAMLTFVVCGSGFTGIEMIGELIDWKNRLAKDYKLDPNEITLMVVEAMPTILNMLDRNDAAKAERYLRKHNVELLLNAPIVEVAADHIKLKDGRNIPTHTLIWTAGV

SEQ ID NO: 5035 - protein, 287 aa, Enterococcus faecium
  misc_feature (B) LOCATION 1...287
  hypothetical: YES
GVANMHYLVTGATGGFGGYALEFLKKMVPQNEIYVLVRSEEKGEALKEAGFNIRIGDYDDLDSMKEALKGIDRLLFVSGVPGNRQAEHKNVVKAAQAAGVSYIAYTSFADADHSISVLAPDHQFTEKMIKDSGISHTFLRNNWYVENELPIIGQALKTGQFVYAAGNGKTGWALKREYAEAAAKVLVESDSPEILELSGNLTDYEELAKALERATGKELEIIEASDAAFVENLKEAGFPQEAADMFLAIQHDIKKDQLAISSDDLEKVLGKPLTSLEAALKEILDQE

SEQ ID NO: 5036 - protein, 182 aa, Enterococcus faecium
  misc_feature (B) LOCATION 1...182
  hypothetical: YES
YIQKRSYLQRPLSKDPRARSVAVMKMILNKVLEILGAVLLVGMVAVVLWQVFSRTVLGNPNTVTEELVRFGLVWFAMLSSAYVVGQKAHLAVTVLSEKLTGKKSKILEVVVQSLFLVFAAMIMVYGGWNAVTLTMGQISPSLSIPMGYVYLSVPVSGVLIIIYSLINLIDTLSNKPAIQEKI

SEQ ID NO: 5037 - protein, 498 aa, Enterococcus faecium
  misc_feature (B) LOCATION 1...498
  hypothetical: YES
TNQNQGREVRKMGKYQLIAATGCPTGIAHTYMAQEALEQAARKKGITIKVETHGQIGIENELTAEEIKQADAVIIAADKDVHSERFAGKRVIDVSVSTGIKDAKRLIDEVLAGKGAILADNEAVDTLESETISGANFGRSIYKNLMNGVSHMLPFEVAGGVLIAISFAVWGIYSFDPDHAQYNATAAMLKTVGDAAMGMMVPVLAAYIAEGIAKRPGLVVGFVGGIVAMNGGTGFLGGILAGFLAGYFILFLQKLLPILPKQLDGLKAIFLYPVIGVAFIGIVMSLLADPMKAINEGMMSFLAGFEHSNPLVLGVIVGCMCAFDMGGPINKAAYVTGTALLAQGNTTFMAGVSAACIAPPLINGFATLLFGKYFDTNDRNAGLVNFILGSTHITEGAIPFAAKDPIRVLPTMMLGSSIAAVLTYLFGVQVPAPHGVFLVLPVVTGKIQWVTAILIGSIVGGVILGLIQKKRVTDKDKKRDNKAANRTVIEEGRAGGLS

SEQ ID NO: 5038 - protein, 97 aa, Enterococcus faecium
  misc_feature (B) LOCATION 1...97
  hypothetical: YES
TGQNNNIKNLMTGTRSLNAPYMLAHENDIAAYIKETNHHVRYRVTPHFEGNELVARGVQLEAESIEDKKIEFNVFIYNVQDGYTINYETGQATKTKN

SEQ ID NO: 5039 - protein, 71 aa, Enterococcus faecium
  misc_feature (B) LOCATION 1...71
  hypothetical: YES
SGQNVDFTVSSLNGVLLPTPRSQVTIFNKHEKLFFEIVPCDSELNGRLTTSFLNGVQKLASAVISSTKRKL

SEQ ID NO: 5040 - protein, 246 aa, Enterococcus faecium
  misc_feature (B) LOCATION 1...246
  hypothetical: YES
NYQKRKIKMMTNVLIIEDDPMVAELNRTFVESIPNMNVIESFRNVEEGKKYFRQKNADLLLLDVYMPGESGIHFLSWLRQQGNDIPVILITAADDIETIKNVIRYGALDYLIKPFTLQRFQLAIEKYLAFSQTIQTTEKADQKLIDQVFNHTTPIHEIPSFIDLPKGLSKLTLKKISAFILKEDTIFSTKELAQKSSLSRISVKKYLNFLVEQDILNERIKYLEIGRPLTCYELTKNGRKKLTDYC

SEQ ID NO: 5041 - protein, 543 aa, Enterococcus faecium
  misc_feature (B) LOCATION 1...543
  hypothetical: YES
VYQKLVAKLIDTGIASGEASVIKKIGVEMLLVAFLGTIAAVASSYFSALASARFGFQTREKYFRKFQQLSMKDISRFSSGSLLTRMTNDVDNVQQMIVLFCQMILPAPVICVFTILMMFRYSLLLTWVTLISVVFYVWIVYRLMKRGAPLSLSIQPKMDRITITLREFFTGINMIRAFDNQSYEEKRTNKSFADYANQMIKVNRIFAWVTPIAFLLMGIVYASILWFGGNLVAEGALQIGVVTAVVEYSMLTLAYLMIAAMVLVIIPKSFASLRRIEEILQAEIEIEEETIKTVAEPTFDQTNAAAFEHVTFKYTEISDPVLEDIDFTIPKGKTTAIVGGTGSGKSSLAKLLLRLSDPTIGKVTLGGIPLTQMTQEQIRSHISYVPQKAFLFSGTILSNLQMGNEYASTEELSKAIKIAQLEELVDTLPDGLDSFVAQGGSNYSGGQKQRICIARALIKPAEIYVFDDSFSALDYKTDAALRAALHKHMSEKTLVIVAQRLSTIQQADNIIVLDEGKIVGQGTHEELLSNCQTYQEFAKSQGI

SEQ ID NO: 5042 - protein, 80 aa, Enterococcus faecium
  misc_feature (B) LOCATION 1...80
  hypothetical: YES
LIQNYYLLIALKDCKNILVNLSRCNQMDLKTFTAQIELMHQEALRQSASYEDKWLNTFHGGRESALDQVLKLLKGECRDE

SEQ ID NO: 5043 - protein, 190 aa, Enterococcus faecium
  misc_feature (B) LOCATION 1...190
  hypothetical: YES
QPQKIAKAIQRAITMSYRLCALAQESINVVLSVLVREIRALDENITELDKAIEQVIVVIPEYQCLTSIPGVGKVYAAGLIAEIGQIERFEDQTKLAKYAGLSWKVNQSGNYQSQNTPLTKQGNRYFRYYLVEAANSVKNYLPEYKAFYQSKYKEVPKHQHKRALVLTARNLRVWWIRYYVNTNSIRHQGV

SEQ ID NO: 5044 - protein, 364 aa, Enterococcus faecium
  misc_feature (B) LOCATION 1...364
  hypothetical: YES
MAQKKRPTKKRKKTKKTKKQKQQQEQMLTIGVGFALILFAVFGFLKLGFLGILIANGFRIIAGNTYQILCLLLAVLGFWIVIKNTEFSIGKNRRWFGGILFYFGILLLLHAHLFGKLHTGEPNIMGTTWDLLASDIKQSQVDNNVGGGMIGAILYHFTYFLIAQPGSYLAAVLLLAGGAFLFSNLEGYQLLNGIQSIGERVQELLEGDPAKQARKQAAKEERMKQRAEAKEARRLAAKEAAEKEAAEYEKKKAVSQQRENTADEWQEPENTEPEQLSFVPIDSFQENIHPANLEKPVPDTPKQTNTAEGFSDELPEDDGTSLEFEIEAEQENQDYELPTVDLLDSIPTVDQSDECIKIEKISAY

SEQ ID NO: 5045 - protein, 89 aa, Enterococcus faecium
  misc_feature (B) LOCATION 1...89
  hypothetical: YES
FKQKGWHLFCKIIRVFFYKFYKNKLFLILEHARLKHVIIFESWRKMEKKKMNGLTQQEVVQKMASGQQNDYQEDASKSTKQIFSDNILT

SEQ ID NO: 5046 - protein, 146 aa, Enterococcus faecium
  misc_feature (B) LOCATION 1...146
  hypothetical: YES
FEQKGESLFMLKVYIDASTKGNPGPSGGGILIVYQGKQEQLSIPLSIXTNHQAEFEFFLKTLEFLKKNDLQNXTIFCFSDSKTLVSTVDKNATKNELFLPYLQRIQELLSEFSLLILQWLPENKNKGADNLARQALHKQLKEKKTL

SEQ ID NO: 5047 - protein, 67 aa, Enterococcus faecium
  misc_feature (B) LOCATION 1...67
  hypothetical: YES
GGQKYYELLNKINENTSNTVLPATYSDATSYLTTAAYNYWQTGDFENSYLKEAENFAHKYGVKLTGD

SEQ ID NO: 5048 - protein, 490 aa, Enterococcus faecium
  misc_feature (B) LOCATION 1...490
  hypothetical: YES
MLQKLLKANEFIEKNAQTVNQEYRNKFHLMAPIGWMNDPNGFVYYQEEYHLFYQYYPYDSIWGPMHWGHAKSKDLIHWEHLPVALAPGESYDKEGCFSGSAIEKDGKLYLIYTGHNVVEGQVRQVQCLAVSEDGIHFEKYAGNPIIAEDHLASVATTEDFRDPKVFQRKEDYFTVVATKTADARGQIVMFHSKDLLTWEFYSVLLEGTPEQGIVWECPDLFELDGKEVLILSPIQMTPQGNAYQNTNSTVAFIGTVDWQTGKFLVENFHEIDGGLDFYAPQTCENEAGQRIMIAWMQMWQRKIPTNDLGHGWSGSMTLPRELRVADNQLLQRPVSSIYQVIDPQKRIEWAKTEENRFLLKDLVYDQHYLRLEINLKQATKLELHYAKGPDHTLLLNYDVERECFTASREHMPYDLSGAEKEVLKKRSVTIPLENNCLTIEIFRDTSAIELFLNDRLTMSTTFYETEKGQDFLLLADSEVTFSLESGLINL

SEQ ID NO: 5049 - protein, 344 aa, Enterococcus faecium
  misc_feature (B) LOCATION 1...344
  hypothetical: YES
RMQKKISIITIFFICVLTSWVIQHQAALYEVPVIEIEKVRIKEDHQLITGKLMNTDQKGESIYLSVPYQKNQIETANIKARQMYLVQMHGDEWQLVAKKNDGWLFFFTSIFIGAMLLIGGKQGLFALGSLIINIVLLLLLLLIFTKTEGISLLNISILFVVIGMIISILALDGWNRSSIIKISAAVTSVFLAFFICLLTMNHWKDQGLRYEELNYLTRPYRSVFLSSVLIGTAGGTLDTVITVIATLEELTKRQPEITAKQLWLSGRQVGRDVIGSMTNILLFVYISGSVPSLLLYLGNQWSFKETIEQHLSLEFLRVIAGSLGIVLSIPISVLFFLTVRRLKR

SEQ ID NO: 5050 - protein, 780 aa, Enterococcus faecium
  misc_feature (B) LOCATION 1...780
  hypothetical: YES
YAQNSFVQGRARTRPTICTPPFRGRLRRYRRLKTKQQAKQAKNLQAAKKELKKEKSDLKATLRLTPDAKLNSRDKRRLAASVSKAKRDGRLPKTAQQTIPYQEMCRDGICIVGDRYFTKQIQFYDVNYQLAQNEDKNLIFENYCDFLNYFDSSIKVQLSFLNQRADMEEYQKSIHIPEQTDAFNGIRREYSGMLKGQLARGNNGLTKTKYITFGIEADSLKEAKPRLERIEADVLANFKVLGVRAHSLDGYERLAILHRMFHPADNQKFKFAWDAIWKTGLSSKDFIAPDSFTFKSGQYFQIGRTYGAVSFLQILAPELTDRMLADFLDLENSMVVTLHIQSIDQSAAIKNIKRKITDLDRMKIEEQKKAVRAGYDMDIIPSDLATFGSEAKTLLEDLQSRNERMFLVTLLVMNHARTRQKLENNIFQAAGIAQKYNCALRRLDYQQEQGLMSSLPLGLNQIAIQRGLTTSSTAIFVPFTTQELFMNGEALYYGLNALSNNLIMADRKKLKNPNGLILGTPGSGKSFSAKREITNAFLITQDDIAIIDPEQEYSPLVQRLGGQVIDISPASDQYINPMDLTLNYSEDDNPLTLKSDFILSLMELIVGGKAGLEPVEKTVVDRCVHMVYRDYLQDPKPEKMPVLGDLYRLLREQPEAEAQRLATALEIYVTGSLNVFNHQTNVEIKSRIVCYVIKNLGKQLKKFGMQVVQDQVWGRVSENREAHKSTRLYIDEMHLLLREEQTAAYTVEIWKRFKKWGRIPDRNYPKCQGFAGKPGNCEHF

SEQ ID NO: 5051 - protein, 304 aa, Enterococcus faecium
  misc_feature (B) LOCATION 1...304
  hypothetical: YES
NLKKSRSHILSENLNSLVQFIEKWCKDYTVSLLCRLLEIPRSVYYFYKNKPLTATEIRNNKLKKKISTIFFTNKQRYGATKIHQVLLKEGISVSLKHVQKLMKQLNLRSIVVKKYRPQRSNKPIISKENLLNQDFSTETICEKWAADITYIPTKKNGWCYLSSIMDLHTKKIISYTFSKRMTVDCVIQTLNKAKIHYHIPEGMILHTDLGSQYTAREVEQWLKTNKIRHSYSRKGTPYDNAGIESFHASLKKEEVYTTSYSDFEEANRALFSYIEGFYNRNRIHSSIHYLTPQEFEELAKEKMA

SEQ ID NO: 5052 - protein, 106 aa, Enterococcus faecium
  misc_feature (B) LOCATION 1...106
  hypothetical: YES
IIKKHIGGFFMPRLQRRTYSKEFNKQIVDLYLDGKPRAEIIREYELTPSSFDKWMKQAQSTGSFKERDNLTPEQAELIALRKKNKQLEMENDILKQAALIFGRKDK

SEQ ID NO: 5053 - protein, 353 aa, Enterococcus faecium
  misc_feature (B) LOCATION 1...353
  hypothetical: YES
SVKNEKNFRSGKMNYRVAVLGPGSWGTALAQVLAENGHDVRIWGHRASQVEEINTQHTNQRYLPDHYLPDSIQAFTNMEDAVKDADAVLFVIPTKAIRSVAKELVPKLNTKPVIIHASKGLEQGTHKRISDILLEEIPAEKRKAVVVLSGPSHAEEVAKHDITTITAASTDAKAAKYVQELFMNNYFRIYTNPDVIGVEMGAALKNIIAIGAGAIHGLGFGDNAKAAIMTRGLAEISRLGVAMGANPLTFIGLSGIGDLVVTCTSVHSRNWRAGNLLGQGQPLEEVLANMGMVVEGVNTTQAAMELAQMMEIEMPITQTIYEVLYEQKEIKTAAKEIMLRDGKKENEFSLTIF

SEQ ID NO: 5054 - protein, 441 aa, Enterococcus faecium
  misc_feature (B) LOCATION 1...441
  hypothetical: YES
KVKNAGMLGSRKGVNAPGVSISLPGITPKDADDIRFGLDNDIDFIAASFVRKAQDVLDIREILEEKDMTHVQIFPKIESQEGIDNIDEIIKVSDGVMIARGDMGVEIPAELVPMVQKRIIKKCNAAGIPVITATQMLESMQENPRPTRAEASDVANAVFDGTDATMLSGESANGDYPVEAVSTMARIDQEAENALSELGTFQLNEFDKTDVTETIGLSVARAAKNLGVKTIVAATESGYTAKMISKYRPDADILAVTFDERTKRGLMLNWGVYPTVAEKPSTTDEMFELAAKKAVELGFASEGDLILITAGVPVGERGTTNVMKIQMIGSKLLEAQGVGQKSVVANAVIASSAEEAVKKAKDGMVLVVPSTDKEYMPAIEKAAAVIVEEGGLTSHAAVVGIAQDIPVIVGAKGATTTITEGELITVDSRRGIVYRGETTAI

SEQ ID NO: 5055 - protein, 200 aa, Enterococcus faecium
  misc_feature (B) LOCATION 1...200
  hypothetical: YES
MSKKGSVLQKCLQIMPIIGLFFFFVLILYAYHHGIFRSSTSLQAFIQQFGKYAVMIFVLLQVIQVIIPILPGGISSVAGMLMFGNGFGLLYSCIGLVIGEAIGFLLVRYYGVAFVQLILSPKKYQKFDELLTRKTKDIKKVLVVTLLLPFAPDDLICLVAGLTKLSFREFMQIVIFLKPWSVGVYSMIMLFLFHQAQGHL

SEQ ID NO: 5056 - protein, 294 aa, Enterococcus faecium
  misc_feature (B) LOCATION 1...294
  hypothetical: YES
GAKKMFLSIEELVDQAKAYPSVAELMIAVEMEMSGRSRSHIIEIMEKNLSVMEQSINEGKEGVTSVTGITGGDAKKLDDYLNEADFLSGETILKAVRNAVAVNEVNAKMGLICATPTAGSAGVVPGVLMAVRDRLDLTHEQQLEFLFTAGAFGLVIANNASISGAEGGCQAEVGSASAMAAAALVCAKNGTPHQAAQAVAITLKNMMGLICDPVAGLVEVPCVKRNALGSSQAFISADMALAGIESVIPPDEVVAAMYQVGRQMPSIFKETAEGGLAVTPTAKRLAEEILNKRA

SEQ ID NO: 5057 - protein, 106 aa, Enterococcus faecium
  misc_feature (B) LOCATION 1...106
  hypothetical: YES
NNKKHTGGFFMPRRQRRTYSKEFKQQIVDLYLAGKPRAEIIREYELTPSSFDKWMKQAQSTGSFKERDNLTPEQAELIALRKKNKQLEMENDILKQAALIFGRKDK

SEQ ID NO: 5058 - protein, 106 aa, Enterococcus faecium; identical to SEQ ID NO: 5057
  misc_feature (B) LOCATION 1...106
  hypothetical: YES

SEQ ID NO: 5059 - protein, 106 aa, Enterococcus faecium
  misc_feature (B) LOCATION 1...106
  hypothetical: YES
NNKKHTGGFFMSRRQRRTYSKEFKQQIVNLYLAGKPRAEIIREYELTPSSFDKWMKQAQSTGSFKKRDNLTPEQAELIALRKKNKQLEMENDILKQAALIFGRKDK

SEQ ID NO: 5060 - protein, 127 aa, Enterococcus faecium
  misc_feature (B) LOCATION 1...127
  hypothetical: YES
YNKNKEVTIVITKPDKNKTRQKRHRRVRNNISGTAERPRLNVFRSNKNIYAQIIDDVAGVTLASASTLDKEISGGTKTEAAQAVGKLVAERAAEKGIKVVVFDRGGYLYHGRVQALAEAARENGLEF

SEQ ID NO: 5061 - protein, 384 aa, Enterococcus faecium
  misc_feature (B) LOCATION 1...384
  hypothetical: YES
ENKKELLFVVHYKTFDPDLWAAIAKEEERQEHNLELIASENFVSEAVMAAQGSILTNKYAEGYPVHRYYGGCEFVDIVENLAIDRAKELFGAKFANVQPHSGSQANTAAYLALVEPGDTILGMDLSAGGHLTHGSPVNFSGKTYHFVAYGVDPTTEVIDYNVVRILARKHQPKLIVAGASAYGRTIDFAKFREIADEVGAKLMVDMAHIAGLVAAGLHPNPVPYADITTTTTHKTLRGPRGGMILTNDEALAKKINSAVFPGIQGGPLEHVIAGKAVAFKEALDPAFKEYSEQIIANAKAMVKVFNQAIGTRVISGATDNHLMLIDVRELGINGKEAESILDSVNITVNKNSIPLETLSSIKTTGIPIGTPAITTPGVQKKKML

SEQ ID NO: 5062 - protein, 154 aa, Enterococcus faecium
  misc_feature (B) LOCATION 1...154
  hypothetical: YES
MNKKLMQGTFWLTFANLLCKVLGVVYLIPWLSMMGNNQDGMLATTLYNVGYLPYGLFLMLGTVGFPNAIAKKVAVATKEGDNAACRLIFRSTINIMFVIGIASAALMYLFAPLLAGISPIANVNNGILAIRSLCPSLIAIPILSAIERIFPRKK

SEQ ID NO: 5063 - protein, 291 aa, Enterococcus faecium
  misc_feature (B) LOCATION 1...291
  hypothetical: YES
TNKKGAESMNSLTSTYRLSNGYEIPVVGFGTWQTPDGDVAVSSVKEALAAGYRHIDTAQGYKNEESVGQAIKESGIPREEIFLTTKLWNANHSYELVMSSFEESLKKLQTDYLDLFLIHWPNPVAFRDNWEQANADTWRAFEELYEAGKIKAIGVSNFLPHHLDTLAKTAKIMPMVNQVFLAPGELQTTVVEYAKKHDMILEAYSPLGTGKIFDVPEMKQIAEAHDKTIAQVALRWSLQHEFLPLPKSVTPSRIKENTELFDFELTEEEMKQIDQLDGVVGKAKDPDTTQF

SEQ ID NO: 5064 - protein, 366 aa, Enterococcus faecium
  misc_feature (B) LOCATION 1...366
  hypothetical: YES
KDKKKRKRKEKMKKLVALEPRIAGFKDYEDREIEKNEVRIRVIFATPKPGTEIVDFRGLSPFIDEEFSEEWRLFLPREEGSQRGVVFGEFQLGNMIVGTIEETGSLVTEYQKGELVCTYGPIRETLITNGVDNYKLRKLDRLDQWKNAVCYDPAQFALGGIREAHVRAGDAVAIFGLGAIGQIAIQLAKKAGATTIVGIDPIAQRRELAEKYGADYTLDPMKADVGFRLKELTDKRGVDSVIETSGSAAALQASLRGIGYGGIISYVAFAKPFPAGFNLGREAHFNNAKIVFARASSEPNPDYPRWNRKRIEDTCWELLMNGYLDCEEIIDPVVPFAESAEAYMRYVDQHPEESIKMGVQVRGGEQ

SEQ ID NO: 5065 - protein, 94 aa, Enterococcus faecium
  misc_feature (B) LOCATION 1...94
  hypothetical: YES
KCKKLLSDTLEKVQHLFRPGFEKVYIVSFEDCPIIPELEATPLLKCGKWYVSTGKEWICHSDLELSAFEWEFLQSLDVEIRETIHFEVNYLPFQ

SEQ ID NO: 5066 - protein, 115 aa, Enterococcus faecium
  misc_feature (B) LOCATION 1...115
  hypothetical: YES
KCKKIKGVLKMAKKTIMLVCSAGMSTSLLVTKMQKAAEEKGMEADIFAVSASDADNNLESKNVDVLLLGPQVRFMKAQFEQKLAPKGIPLDVINMQDYGMMNGEKVLAQAENLMK

SEQ ID NO: 5067 - protein, 710 aa, Enterococcus faecium
  misc_feature (B) LOCATION 1...710
  hypothetical: YES
ESKKVGVKSSRYFLLLFYERRILMYFTIAGNTKTDKELIKKATKEVGKRTSFLPKTIKYSVIETEEQLHVLGKVLEHESRSSVKLTLTLHDTEGKIEKAGTEYVFGPLDYQISEGFYPTLMDLIRLDVFKETDETMSVEESYRNEKLLQVLEEELESDQRKVNQGSEVEVNEEVPWERPIFPKKESKEKETVYVDEQADIPTQKSIFKKENDVMGQLEVDPFEETMEDEETAEVEVDPVEANEESIWTEGDSQEYIEPLISEEVEKNETEIQKATVFDYILDQYPPEHEWMKEKNKLFLNGLYSKYQLPQTYQAFLESKEELISQGKGTLLEQLESVQSTNWHELAQEDLLATFEERQQETDQEINEYATEQSSNWEKAKEELNKEEQRVIEEEVQKIKERYEKKRDNAYSLCVAKINNFTQTNQEALSKEKENLLKERIKERKEEFYRGLRTDKLKISKELNEQLNKLYQTTTEVLMEKYEKIQQELQVQIPKWKKEYEIQQQELKEQEEKQRQKEKEREQLELKKREQDLAEQQMAIEKQRLNQEKEKEAAARKERQEQMDTLRQAQLNYLAQPQPTPSVAAVQTPMNNQTNLTPSPQRSFNGWMVGCIASLSLLLGGGTVFAFNHINQSSQADSVATTTSIKEEAQEQARKEYEQQLEELLNRTNQSTTESSMENSKESDPSKAKEGSSDSTVQSNTSESSESNEVK

SEQ ID NO: 5068 - protein, 183 aa, Enterococcus faecium
  misc_feature (B) LOCATION 1...183
  hypothetical: YES
FGKNQWELYFMFLWSIALQYLIYTICILLIDHHIRYKYLFAGVILISCILIGWVYSILGIFTALIAIGMLMLTFFFFSTSRQQLVYALPFGLLTSLLGDHLTSIGDFFVLKSSVIEPGDSLQYFHIVLSAFLSALLAFCLKKSLETWFHTVDRRMIGTIGTLILFTYYIIPVVLVNFFLQENV

SEQ ID NO: 5069 - protein, 97 aa, Enterococcus faecium
  misc_feature (B) LOCATION 1...97
  hypothetical: YES
SIKNCGRICGKSVSKSFVSSLTEQLEPMVNEWQNRLLSEKNYPYLMTDVLYIKVREENRVLSKSCHIAIGITKECDRENIGFHDSKWRKRRDLDNIF

SEQ ID NO: 5070 - protein, 105 aa, Enterococcus faecium
  misc_feature (B) LOCATION 1...105
  hypothetical: YES
INKKTHIVVSKLPRNEDYLTNYDGYVVTTEHFDLANPVTKVDDIPDYEMYSQTIDSLNKRFGNRVLKGIEIGYIASEKDRIIDYLADKDYDLKLLSVRPSPQFVY

SEQ ID NO: 5071 - protein, 271 aa, Enterococcus faecium
  misc_feature (B) LOCATION 1...271
  hypothetical: YES
INKKTHIVVSKLPRNEDYLTNYDGYVVTTEHFDLANPVTKVDDIPDYEMYSQTIDSLNKRFGNRVLKGIEIGYIASEKDRIIDYLADKDYDLKLLSVHHNGQFDYLDDEVKDMDPAIVIPQYFAQLSEALVVIEADVFAHFDYGFRVFGLSVAEFKQYEAQFLPILDQVIKNKLAFELNAKSAYLYDNLALYEYVIDLYLSRGGTLFSVGSDGHYLEHFRFHFDDLFALLKAKGVTELAIYQKGKRIMVPLPVQKNVLSIKSEDVFLDFFF

SEQ ID NO: 5072 - protein, 253 aa, Enterococcus faecium
  misc_feature (B) LOCATION 1...253
  hypothetical: YES
INKKTHIVVSKLPRNEDYLTNYDGYVVTTEHFDLANPVTKVDDIPDYEMYSQTIDSLNKRFGNRVLKGIKIGYIASEKDRIIDYLADKDYDLKLLSVHHNGQFDYLDDEVKDMDPAIVIPQYFAQLSEALVVIEADVFAHFDYGFRVFGLSVAEFKQYEAQFLPILDQVIKNKLAFELNAKSAYLYDNLALYEYVIDLYLSRGGTLFSVGSDGHYLEHFRFHFDDLFALLKANGVTELAIYQKGKRIMVPLPV

SEQ ID NO: 5073 - protein, 107 aa, Enterococcus faecium
  misc_feature (B) LOCATION 1...107
  hypothetical: YES
LNKKKGDEYMAKLIVLGGLIYGGYWLYKYMLAHPNIDKGKVIKTVGVIIVGLIALTKKNNTNSPKIMRTYRCRGCGREISTSFNPSESPQGRDRCHTGYRHYWERID

SEQ ID NO: 5074 - protein, 175 aa, Enterococcus faecium
  misc_feature (B) LOCATION 1...175
  hypothetical: YES
TLKKGLRSFFGKEGFWNILRGVIPICWAFHHKSAVSTLVERLSKAIIALKPEGRKAVDIENSINEWLQSVPKNLFKSITFDCGKEFSNWKSISNTNDIDIYFADPGTPSQRGLNEHSNGLLRKDGLPKEMEFNQVNQGFISSVASKRNHIPRKSLNYQTPLEVFLSYVNGKFCLA

SEQ ID NO: 5075 - protein, 104 aa, Enterococcus faecium
  misc_feature (B) LOCATION 1...104
  hypothetical: YES
IVKKIRGRNSRIRGRRSKCYLNEKLGWLPYIETPETIQQQKEALKQEARADQLRAAIVEKEQRQIRRYFGSKEGFGQAIHEFLMNYLGNENPNNQSNEGGSEYE

SEQ ID NO: 5076 - protein, 476 aa, Enterococcus faecium
  misc_feature (B) LOCATION 1...476
  hypothetical: YES
FTKNIERLLYSRGGLAMKPNLSLTSERIRKIIESKGLTLERFGDLIGDTPISSVNNWLRGVSLPNKNRLLTIANIGNTSVDWIKWGTLEEYIASYLIDSGYELYIKDFPEIPYKVFKDIQEKYSDTFSLDKDYELLNPIIKFTIGGVTLNRIKFYIDSSKKTIKQISTETGINYTTLTNYYRGERNPRNTETWNILADYFHVPVSYLMGLDETNVELKNLNIGNNIKNIRKSKNMTQTDFAELMGLSRSYIGDLENNRSNPSIKTLEAIARALDVPIVALINDSSTDNIVEPYESLTAENILLKQENEELKYEVESLRKRLYEIQQVVNQGAEKMIPNLKDVSKRIKYIRKKLGMTMEQFGSHLSNSPKSTIATWESGRNIPSQKKLQLIAIVGETTTDWIKWGTLEEYITSYLIGIGYELYIKDFPEIPHKVFKDIQEKYSDTFSLDKDYELLDSIIKNIFTKYYSKEFEVTQIP

SEQ ID NO: 5077 - protein, 254 aa, Enterococcus faecium
  misc_feature (B) LOCATION 1...254
  hypothetical: YES
QKKNYRDMTWKLEGTIMNILMIEDNQSVSEMMQMFFLNEGWEATFKYDGKEGLDAFLENPQHWDMITLDLNLPTMDGMLVGREIRKVSSTVPIIMLTARDSESDQVIGLEMGADDYVTKPFSPLTLIARMKALHRRSELAEAREEAAVSDDHFDIETSHFKMNTKTREAYLDNRPIEGLTPKEFDLLFTLAKKPRQVFSREQLLELVWDYQYFGDERTVDAHIKKLRQKIEKVGPQVIQTVWGVGYKFDDSGVA

SEQ ID NO: 5078 - protein, 392 aa, Enterococcus faecium
  misc_feature (B) LOCATION 1...392
  hypothetical: YES
YEKNSSRRKGKNDSHSKEKKMSILKNITQFKKIQSRAITPENPTGEKGKAAMLPSELGPSRKGRGAIPLTSGEETVIADITGTGIIRHMWMTIRDRTEFGSFVLRDLILRIYWDGSDSPAVESPLGDFFCNGFGERCEVNSLPIVVNPTGGFNSYFEMPFQTSAKITIENLHPKDMSSFFYTINYALVDELEENSLYFHANWHRERITKLQEDYKLIDRLKGQGYYVGTYLALTCLERYWWGEGEFKFYIDGDSEYPTVTSTGSEDYFGGAWAFHEYDEFGRPHAKNYSTAFLGYPYQSNRDATRDRFETGKLNAVHAFGDDAMPRHGLYRWHLQDPICFTEDLSVTLQQIGNDDVRLFERQDDVASVAYWYSTEASGNTKRHFTDRERLPR

SEQ ID NO: 5079 - protein, 519 aa, Enterococcus faecium
  misc_feature (B) LOCATION 1...519
  hypothetical: YES
MEKKGKIKKLDKTQIYFILKGIFVGLLTGIVVSLFRLSIEKLSDLVRSIYEMSREQPIYLIGLAICCILAAFFVGYLVKNEPDIKGSGIPQVEGQLRGELSMNWFSVLWKKFIGGVLSVGAGLFLGREGPSIQLGASIGQGAGQLFRSPSSEEKILISSGASSGLAAAFNAPIAGLLFVLEEIHHSFSPLVWLTSFASAITANFVSLYFFGLRPVLYLGDLPSLPLKYYGSLVILGVLLGILGFIYQNVLLALPKFYNRLPLPAYFHGFVPFLLILPIGYLWPSTLGGGNQIVLAFGHASLPIIMIIGLFVLRFVFSMISYGGGLPGGIFLPILTLGALIGSFYGNIMVDFGMDPIYIKDFVVIAMAGYFTAIGKAPLTAIILVTEMVGSLNHLMPLGLAALVAYIVNDLLGGNPIYESLLERLLGNTQTASLKGARTTFDFPVTAESSLDGLMVRDFNWPKNMLLISIRRGNQEILTHGDTIMNVGDILVILTDEANLPRIKQEIEAKSSITNLKQSF

SEQ ID NO: 5080 - protein, 334 aa, Enterococcus faecium
  misc_feature (B) LOCATION 1...334
  hypothetical: YES
TEKKEERQMATIKDIAQLAGVSPATVSRVLNYDPELSVGLATKQKIFEAAERLNYTKHRKNAANAKQTLRLIQWYDDTEELEDLYYLSIRLGIEKKAEEANVTLLKETWDSISELPADGTIALGKFDEAQLLDLKQSQQALLLVDSDGTSQGIDSIVVDFKSSVQKVIEHFVSQNAQHIAMLAGTEYTKKNHQRLRDPRIMAFQQVLAEKGYDEGSIIEADFSVESGYQAVKKYLKTNEQIPDALFAANDALAIGALKAIQETGLAVPEDISVMGFNDVSVAKYVTPSLSTVKVYTEWMGELAVETILQLSNSKAPVSRKIIVETELIVRESTK

SEQ ID NO: 5081 - protein, 203 aa, Enterococcus faecium
  misc_feature (B) LOCATION 1...203
  hypothetical: YES
RRKNMLERYTRPEMGNIWTEENKYRAWLEVEILADEAWAELGEIPQEDVKKIREHASFDIDRILEIEKLTRHDVVAFTRAVSETLGEERKWVHYGLTSTDVVNTAYGYLIKQANDILREDLKRFTEIIGEKAKEHKYTVMMGRTHGVHAEPTTFGLKLATWYSKMKRNIERFEHAGKGIKPGNISGAVGTFANIPPFIERICL

SEQ ID NO: 5082 - protein, 498 aa, Enterococcus faecium
  misc_feature (B) LOCATION 1...498
  hypothetical: YES
RRKKMGEFLLSIWTYFATNILTQPAYLIGFIVLLGYILLKRPLHECIAGFLKATVGYFILTVGSGGLVNNFRPILVGLKERFNLDAMVTDPYFGQNAVDAGLMETFGRTFGDVMILLLIAFVLNILLVRFQKYTKLRSVFTTGNVQVQQAATAFWILLFCFPDLGRIQVLIFMGLILGCYWAVASNLTVGITQELTEGAGFAVAHQQMFGIFIFAKLAEWMKKRDEKKNRSIKQDKKIEDIKLPGFLSIFNENMVATSLLMLFFFGIILIVLGKDYLIQAQFMQEGQSFLFYIMTTSLNFAVYLAILQLGVRTFVDELTQSFQGISNTILPGAVPGIDVAATFGFGSPNAVTIGFLFGALGQFLMIGLLILLKSPTIVIAGFIPLFFDNAVIAVYANNRGGFKAACLFPFLSGIIQVGGSALFATWIGMSTYGGYIGMFDWATAWPLFTVIMKVLGYAGIAVVVIGLLAIPQLQYRKNPDGYFLIVEDYDTYAEKQRV

SEQ ID NO: 5083 - protein, 656 aa, Enterococcus faecium
  misc_feature (B) LOCATION 1...656
  hypothetical: YES
GGKKLKAYLQRMGRSLQLPVAVLPAAALLVGIGNWWASYSNDIVAHFLQAGGNAVLGQLPLLFAVGLALGMSVDKSGAAALAGLVAFEVPVNVLKTDSVATLLNIKPESVDPSFAQISNVFIGIIAGLIAAALYNRFHEAKLPMALSFFSGKRLVPILAAFVMLLISAVLLLVWPPVYSALVSFAKFILSLGWGGAGLYGFFNRLLIPTGLHQAMNSVFWFDVAGINDIGKFLASEGTKGVTGMYQAGFFPIMMFGLPAGAYAIYRNARPENKAKTASLMLAAAFASFFTGVTEPLEFSFMFVAWPLYVLHAIFTGISLAVSAFFHWTAGFAFSAGFVDYFLSLKNPIANQPLMLIVQGLVTAVIYYFGFNFAIKKFHLMTPGREEADLSDDDTATTNSDNKYAAQASKIYAALGGADNVTSIDNCTTRLRLQVKDTGLIDQNKIKATGVPGMKIIDGKNAQVIVGTEVQFVADEMAKLHGGAAARPAQTNTVVKTETFAGETIEQDIYAIANGKLIPITEVSDDVFAEKMMGDGYAVLPENGEIFSPIAGTITNIFPTKHAVGIQTDAGIEVLLHMGINTVDLKGEPFTLYVEEGQKVARGQLIALVDLAAIQSAGKNTDMVVVFTNGDKVQSLEIEPARDVKANDKIGSVSNKA

SEQ ID NO: 5084 - protein, 374 aa, Enterococcus faecium
  misc_feature (B) LOCATION 1...374
  hypothetical: YES
LLKNKTIILGGFTEMKKAKLFGLGAVALAAGLFLGACGNNGSTDSSGGKSSSDTTTAALITDTGGVDDRSFNQSAWEGLEKWGKDQGLSRGNDGFQYFQSSNESDYIPNIDQALNAGFKTIFGIGYKLKPAIQEQATNNTGTNFVIIDDVIDGLDNVVSATFKDNEASYLAGVAAAYTTETNVVGFIGGVKGEVIDRFDAGFKAGVDAGAKELGKEIKVLNQYAGDFSAPDKGRSIAQGMYAQNADIIFHASGGTGNGVFQEAKSLNESGDKKVWVIGVDRDQSDEGEYTLNGEKKNFTLTSTLKAVGTVVEDLAQKSADGKFPGGEHTVYGLKEDGVGLTEGQLSDEAKKAVDEAKEKIISGDVKVPETPEEN

SEQ ID NO: 5085 - protein, 105 aa, Enterococcus faecium
  misc_feature (B) LOCATION 1...105
  hypothetical: YES
FMKKALIICAAGMSSSMMASKTTDFFKQKREEVLVDAVSATEGDNMIKNSDFDLFLISPQTTMFLDKFKKLGESVGKPVVSIPFQAYVPIPTGIQKLAEVIEENI

SEQ ID NO: 5086 - protein, 129 aa, Enterococcus faecium
  misc_feature (B) LOCATION 1...129
  hypothetical: YES
VMKKFLCLSALMGVLLTSGGIVSATEALNLDVPEDHTAIYGGGMEATEEGFSSSKLRYAAGGGDFNCGVNGFKVYANYYHARAKHSATAKNGRGGQVRSVQKAGVRAYATCNATLTGNTGWWNGSVAKF

SEQ ID NO: 5087 - protein, 445 aa, Enterococcus faecium
  misc_feature (B) LOCATION 1...445
  hypothetical: YES
NMKKLLFTGLLASSALFLLGGCGSSNASDASSSAANSSEKTSDGRKNIDFWSFWGSGARKEAIEEIIEDFNQSQNEIHVNYKYQPWGDIWTKSLSAITAGNAPDVIVQDINSVAQRAEAQQATNLSKYVEKDTSKDFYPQLWDTVEYEGDPYAIPFNTDTQVIFYNKKLFKEAGISEQDLPTTWDELEETARKLDKKEGKEFTRIGFYPLWNLGADVWALNADNGTSWFDKDEKVKIDTKNKVEALEWIQDWQDYYGKNTINKLEAEFGSGVSDPFISGLVAMRAQNINYYSSLMENAPDDFDFGVMQLPEKEEGSGHWSWGGGFVLEVPYGAKDPEASYEFIKYLSSPEVQEKFGEKSFDIMASKTANENLVNNDNLTDKGKMIYQMADENFKNTVITPVPLDAPDYTTLVNEQIDQILLGTKSPKEGLADAQKAVENLVKQNQ

SEQ ID NO: 5088 - protein, 177 aa, Enterococcus faecium
  misc_feature (B) LOCATION 1...177
  hypothetical: YES
TMKKQLLIVDGYNMIGSWPELVQLKKQDKMADAREALLHRLSNYAKYEGMEVIVVFDAQLVPGIQQNYKKYQLDVVFTKEDETADSYIERIAGQLNDRLTQVTVATSDLAEQWMIFSQGALRTSAYELYKTIKKTEKTIAQENKDMHFIDFRRNSPWNEEQLKKLSQKLDDLMRKNK

SEQ ID NO: 5089 - protein, 375 aa, Enterococcus faecium
  misc_feature (B) LOCATION 1...375
  hypothetical: YES
TMKKLKVMTVVGTRPEIIRLSAVINRLDQSEAIEHILVHTGQNYDYELNEVFFEDFKLKKPDYFLNAATGTAIETVGNILIKIDPILEEVKPDAFLVLGDTNSCLCAIAAKRRHIPIFHMEAGNRCFDQRVPEETNRKIVDHTADINLTYSDIAREYLLREGLPADRVIKTGSPMFEVLNSRKDDIQHSDILNRLVLKEGQYFVVSAHREENISSETNFLNLVDSLNTIAETYQLPIIISTHPRTMKMIEAKGIKFHELIQTMKPMGFNDYNKLQINAKAVLSDSGTISEESSILNFKALNIRQAHERPEAMEEASVMMVGLEKERIMQGLEVLETQQKDTLGHVADYSMPNVSEKVLRIILSYTDYVNRVVWGR

SEQ ID NO: 5090 - protein, 114 aa, Enterococcus faecium
  misc_feature (B) LOCATION 1...114
  hypothetical: YES
QMKNYDPNIRLGTHTIKVSFQRWDYKGFVTFRRGGNCKGLDVLALNEDDLYDQTLTDNPIGFGLLPEDDEGNEWFKMTLMNDNGDELSVEDTWSYLSDYIVSVEIIEFVADKEE

SEQ ID NO: 5091 - protein, 363 aa, Enterococcus faecium
  misc_feature (B) LOCATION 1...363
  hypothetical: YES
KMKNKFRKIVGTIAILTASILLSACGNSGSADDSTGYVGIAMPTKSAERWIADGNNMVSELEKLGYKTDLQYGEDKVENQVAQIENMITKGVDTLVIASIDGSALTDVLAKAKEADIKVIAYDRLLMNSENVDYYATFDNFGVGVSQAAYIEEHLGLKEGKGPFTIELFGGSPDDNNALINYNGVMSVLQPYMDNGQLVVPSGQTSFSQIATLRWDGSTAQARMDNLLSANYTDQTLDAVLSPYDPISLGIISSLKGVGYGSESKPLPVITGQDATVAGVKSIIAGEQTQTIFKDTRILAKNTIEMIKAISDGEEVPVNDTETYDNGVKTVPTYLANTVSVDKDNYQAELIDTDYYKESDLKN

SEQ ID NO: 5092 - protein, 170 aa, Enterococcus faecium
  misc_feature (B) LOCATION 1...170
  hypothetical: YES
RMKKMMFGVAALIVIGITGMTGLLNAAFHMDDISDQEYRISLKKAAAIVKNETKEHNISAIHFAVEKDLENPTNATYEYQFFCEGQVIAVNPSTGKTTVRNDTEKAAEHLFDIEKTEEFKQPQAAMKEAVSYYGKKAKVKEWTLLVKDERPYYKVRLIDGEQDRQVWISA

SEQ ID NO: 5093 - protein, 144 aa, Enterococcus faecium
  misc_feature (B) LOCATION 1...144
  hypothetical: YES
RMKKNIRWQPELAHTIIYWSLTLIILFFSLILSLENTGPYWKSNFVLGIFLVFLFLGLRRSFILKSNSVIIRYAAFWKDREISVGQIRSLTPTNTGVQMMLQDEKAPSVFMMRKKDQVVLFDHFEKNGPKSESIPYPYTKKRKS

SEQ ID NO: 5094 - protein, 700 aa, Enterococcus faecium
  misc_feature (B) LOCATION 1...700
  hypothetical: YES
VMKKCPNCGSKKMEQNTICPDCGHQITAEDQQIKESIEETNTDAAMQDKSTEDAVFPDTELNDPIEWSELKDLPLESVMELFEKAEPEDEEPPAHDQVTNIEKNEQKKATVHETSEESGKNQEETLESKQKRRVAELKEIVDNEEENSILSAYIKAHREDTKEEHAKELLKMISEKIAQENKVEPEKEQETEKDSDRENATGKETVKIKDVKTDITEKTEVFTEKQLEKEKTNKLPEAEKKEILENTDKKSTEPDEINSESDAENQSVSKEGTDLEAKIEKEENQPKLFEAEAKSITIVPDTEKTHQESNLEKTDPDKAQKKKSKKVPYLVLAAVLLLGGGSWAYYDHHQKVEAEVAAEAKRQQQMEELHEKLAAFYTDDHHQFIRADMIHQDLSKLKNDLSSLKNEKGYSELETTYQDIQSKIRDIQKVNEWFIAPAIVDDHLADDIKLKADKEIQAIETDNTDFGKLIQQAQTEAKNQYAELQTAKEKTAIVFKDGKVVDSATRDQYKTAKEAVEKVKNTDLSAQLNEQLKQVDKMLTDKEKKEEEEKKKAEEAKKAAEEQAKQAAQAAAAAQAAQQAAVAQAAQQEAASSTPSSSNSANQPIKSARASDIADASNPAWTWAPGVQSKVIATCIQRGYIVEGGYRLEKARIENGEGYYNLYATSTKSALMKGIGESALPFYIVTINCKTGWFGGNGSN

SEQ ID NO: 5095 - protein, 525 aa, Enterococcus faecium
  misc_feature (B) LOCATION 1...525
  hypothetical: YES
RVKKSLISAVMVCSMTLTAVASPIAAAADDFDSQIQQQDQKIADLKNQQADAQSQIDALESQVSEINTQAQDLLAKQDTLRQESAQLVKDIADLQERIEKREDTIQKQAREAQVSNTSSNYIDAVLNADSLADAIGRVQAMTTMVKANNDLMEQQKQDKKAVEDKKAENDAKLKELAENQAALESQKGDLLSKQADLNVLKTSLAAEQATAEDKKADLNRQKAEAEAEQARIREQQRLAEQARQQAAQEKAEKEAREQAEAEAQATQASSTAQSSATEESSATQSSMTEESSSATQSSATEESTTPESSTEESTAPESSATEESTTAPESSATEESTTVPESSATEESTTVPESSTTEESTTPAPTTPSTDQSVDTGNGTGSSTPAPTPTPTPEQPKPVTPAPAPSGSVNGAAIVAEAYKYIGTPYVWGGKDPSGFDCSGFTRYVYMQVTGRDIGGWTVPQESAGTKISVSQAKAGDLLFWGSQGGTYHVAIALGGGQYIHAPQPGESVKVGSVQWFAPDFAVSM

SEQ ID NO: 5096 - protein, 738 aa, Enterococcus faecium
  misc_feature (B) LOCATION 1...738
  hypothetical: YES
YKKKTRYVHCQEVNGLTIKWEKYLRGVYSFMMLSVGAPIFVAANQLQNSYPLILTIGILCLIVCCIPKKWVRLLLSLPVMIGCLFTYFPSKTISLLWVVQFFSSVTEEFFHLSQGKLHYLPEKTAFFLILLLIYLFITLTVDYDYWYAPFLALMGYFMMLTVFREKELLYEMIAVVAVLCVYLAARQFFSLRLLSGNARFQSLTTILLICLFTFSAILPLYLPKVYQSLEETSEPIREYLNDEGLYDRLHEYQLTGSARTGFSENDEQLGGPLYDNGEVVFTANQKVNGYWKIENKNHYTGSGWVEDPDAPIQPIQEFPVDITSYQTVMEEKENITLTLKNQAFLPYPYGNTTLTDFSLASGQTLYYLPESQRFIPVPNESTRLASLQTERLAFTREELKSSQLEADDLEKQQTNLQLPKGLPQRIEDLAIELTKNEATLIRKVEAVEQYLKTSGNFRYSKTDTGHTPKERDYVDYFLFDSKVGYCDNFSTSMVVLLRTLGIPARWTKGFTDGIRTGTDEQGNEEYSILNSHAHSWPEVYFPGFGWLPFEPTPSFANPTVSQPAAETTETVQSAEEQPKESENIVETISSEKPETISSDNTTLTPSYKIVLFSLGVCLSVLLFFLLLFRKSLRWTSYLIYLHFFASTNAVAYQKLLHHLETLVPRTPAESLQAYSQRIEQTFNLDQRFTRLTAQYEAEIYGRQADPVKFDKKTYLELTHIIRKTVSKKVMTKGSSFKK

SEQ ID NO: 5097 - protein, 79 aa, Enterococcus faecium
  misc_feature (B) LOCATION 1...79
  hypothetical: YES
IKKKFKQQFKKILTAEIDVAISQSSTKYDPAFQKLIDKCLFIIKIKEKFMSAFFIKVVMIIRLLIVFFRKYGIIVLTKR

SEQ ID NO: 5098 - protein, 430 aa, Enterococcus faecium
  misc_feature (B) LOCATION 1...430
  hypothetical: YES
MKKKYVQVGLGGRARFFYEAIASTYHQTCELVGFCDVSQTRMDYANRILVNKYGQKKVKTCMPSQFEQLLDDVRPAEVIITSVDRTHHDYIIRAMKKGYDVICEKPLTIDEEKAQEIITVQKQTGRSLRVTFNYRYAPYHTKIKELIESDVIGDVFSIHFEWLLNTQHGADYFRRWHRNKHNSGGLLVHKSTHHFDLVNFWLNSRPQKVFAFGGLNFYGMHNAEKRGVEIFYSRCYGSELAKADPFAIDLSANEELREMYLEAEKDSGYIRDRSVFSDDISIEDTLGVTVKYETGAILTYSLNAYMPWEGFNVSFNGSKGRIEMKVIEKSYINAGGDKKDEGAAVLQSIHVYPMFGEPYEVIVEQEAGGHGGGDPRLLDDLFGEEKEEDPWNRAATHVDGILSILTGIAANHSIASGKAVVIDELVSLKE

SEQ ID NO: 5099 - protein, 120 aa, Enterococcus faecium
  misc_feature (B) LOCATION 1...120
  hypothetical: YES
REKKMNDLLATIFTGIIIDENEKNYFVQKNGQTFGLSKSEGEHKIGEAVEGFGYQNQKHENRITTQIPKSRIGHYAFGIVTATRKDLGAFVDIGLPDKDFVVSLDELPTMTELWPKKGIA

SEQ ID NO: 5100 - protein, 164 aa, Enterococcus faecium
  misc_feature (B) LOCATION 1...164
  hypothetical: YES
GWKKVSILLNDVSNYKTILRINKQRFKCKHCGKTFLAEDSVSDRRCSIARRVKQAILELLSEPLSMSLIARMKHISPTTVIRILRSLRPKTISLSQLLPEVVCFDEFKSVKNVSGAMSFVMMDGKTHQLIDIVENRQLNPLRHYFLRYPIKVRDDDMSNGRKDK

SEQ ID NO: 5101 - protein, 430 aa, Enterococcus faecium
  misc_feature (B) LOCATION 1...430
  hypothetical: YES
KRKKSEKRNEKMTELIIGGVTASTLAEKYKTPLYVYDEEKMRQTMLSFKRGFVSKRFDTKVLYASKAFQTIEMLHLVREYGFGLDVVSGGEIYTALQADFPRDTIYFHGNNKTPEELIYALENDLLHIVADNLMEVELLAELSQRYLKKICIMLRLNVGVEAHTHEYIVTAHIDSKFGMSYESKECQQALQLIKESSYLELEGFHAHIGSQIFDVTAWLAEIDKLTNYLTDFDQPLSLNLGGGFGIRYTQNDQPIPVEEALKKLIEYTEEALEKRKLTIRQLLIEPGRSIVGEAGTTLYTIGFIKKTPHKKYYFVDGGMTDNIRPALYQAEYDCDLAAKLSEEKTEKVTIAGKMCESGDVVIKEAYLPKAESGDLLAVYSTGAYGYSMSSNYNRATRPAVVFVNNGQSRLIVRRQAFSDLLRGEVSYDPS

SEQ ID NO: 5102 - protein, 246 aa, Enterococcus faecium
  misc_feature (B) LOCATION 1...246
  hypothetical: YES
VRKNHWESIMNKIKLFIFDMDGLLLETGRLAYRANVKSAQKYDYEMRKEVYYLLTGQTEMAIREQMGILYGEDVPYIKWREAINQYKEKIVKEDKRVYTKKGAEEILSFAKERGIHTIVASSNTRVKVEMYLKMENLYALFDQIISGDDVKKGKPEPEIFLKACSKMNIPPSEALVFEDSIAGIEAARRAGILSFLIKDHLIGLPDHNGKHKLKVDVSLYESNKADYEFYDLHQAKRFLESKGLYL

SEQ ID NO: 5103 - protein, 189 aa, Enterococcus faecium
  misc_feature (B) LOCATION 1...189
  hypothetical: YES
RRKNRMTKKIGFFIGSLRKDSYNKKVAEAFAKLLPEGYESVFVKFDDLPFYNEDLETPEKAPAEWTRFREEVSGLDGVVFVTPEYNRSVPAVLKNALDVGSRPYGHSVWDHKPGLVVTASPGGIGGFGANHHLRQSLVFLNVPTLQQPEAYIGNVTNLIDENGNIVEGTLSFFQTILDAYLDFSNKLAE

SEQ ID NO: 5104 - protein, 885 aa, Enterococcus faecium
  misc_feature (B) LOCATION 1...885
  hypothetical: YES
RRKNMPQKTKNTPMMEQYLSIKAQYQDAFLFYRLGDFYELFYEDAIKASQLLELTLTSRNRNAEEPIPMCGVPHHAAQGYIDALIEKGYKVAICEQVEDPKTTKGMVKREVIQLVTPGTVMDSKGLSAKDNNFLTAVVSQGNEFGFAYADLSTGELKTARLHDEEAVLNEASALQTKELVLGSEITDTLREQLSGRLGLVFSQQNEMEENAEFSFLTSELVDPLEKEATGKLLTYLSVTQKRSLAHIQKAVEYQPDHFLKMDYYSKFNLELSQSIRTGKKHGTLLWLLDETKTAMGGRLLKQWLDRPLIQAKQIKARQEMVASLLDSYFERIDLQSALTKVYDLERLAGRVAFGNVNGRDLIQLKTSLEQVPMIRGLIEGIDQGQWQSLLSEMQPMDHLVQLIDQAIQDDPPLQITEGNIIKDGFNEQLDMYRSAMRNGKKWLAELEAKERQETGIKNLKIGFNRVFGYYIEITKANLGNAELEKYERKQTLANAERFITPELKELETQILEAEEKSVDLEYQLFLAVREEVKKAIQPLQVLAKAISAVDVLQSFATISERYQYVRPELVSDKHQLLIKDGRHPVVEKVLGHQEYIPNSVEMAEDEMILLITGPNMSGKSTYMRQLALTVLMAQMGCFVPAKQAVLPIFDRIFTRIGASDDLIAGQSTFMVEMMEANQALRYATPNSLILFDELGRGTATYDGMALAQAIIEYIHRHVQAKTLFSTHYHELTVLEKELPQLKNVHVGAVEKDGEVVFLHKMMDGPADKSYGIHVAKIAGLPSNLLERAADILHTLENGDNGHHTVPAEVEEKTKTAKQEQIKPPAEKVNQDHIQDRVKEENQQLSLFSELSENETEVIESLKQINLLEMTPMDALNTLYELQKQL

SEQ ID NO: 5105 - protein, 383 aa, Enterococcus faecium
  misc_feature (B) LOCATION 1...383
  hypothetical: YES
ELEKKEGIDMKKRYKLVIALLNITLLFSLSACGKTNEEVTANIADPMIKKATTLEVYVANGKLTNYVENAAKIYNRKTGANIDLKIVNVASGTATVQMITPKLVTHEDMPDIISMADTSAAGVLEKFQDAFYSADEYGFYDKYGDQFYDQKLNILRQQTSNETIIPWASDFTPALCYYQPKKFAEIGVDFEEISSWEEYIQVAKALKEKTGSFGIALPESGDQELFINMLAQQNQSLLDEEGNIRLNTKEAKHAAKLIKEMIDSDIVHFYGAQDAEKAFQESAMFVAGGWYATNMSLNFPDASDKWRMAPLIPFSKENPGKGAVSGGSSFYVPKDAKNPQVAQQFLTFMLTDEECLANALELGVATSNSLAYQTEAAEKKFDY

SEQ ID NO: 5106 - protein, 101 aa, Enterococcus faecium
  misc_feature (B) LOCATION 1...101
  hypothetical: YES
GYEKPLVLNNKKALQRFYDKEKAELSISSAFLYLGRIQINRNDCNFPSYMQSTVLNFFMLNKNFVFVTSSTFETSLVPIQFSDVYVIQLLRIALLLVSDTS

SEQ ID NO: 5107 - protein, 430 aa, Enterococcus faecium
  misc_feature (B) LOCATION 1...430
  hypothetical: YES
EDEKMKTLIKNGQINTRKNMTTPAEIWIEDGRIKAIGTGFSEAEFDEVFDAKGQLITPGLVDVHVHLREPGFTYKETIEAGTRSAARGGFTTVCAMPNLNPVPDTAEKLRQVYDIIRKDAVVKVLQYAPITENLRSEKLVDQEALIEEGAFAFTNDGVGVQTAGTMYLAMKEAAKNNKALVAHTEDESLLFGGVMHAGKKAEELGLPGILSVTESSQIARDLLLAEATGVHYHVCHVSTKESVRVIRDAKKAGIHVTAEVSPHHLILIDEDIPEDFGFWKMNPPLRGREDREALIEGLLDGTIDCIATDHAPHGLEEKSQSFMKSPFGIVGSETAFQLIYTHFVETGRFTLEQVINWLAVKPAEIFGLNAGTLTVGAPADVAVFDITQTCTIDKEDFLSKGENTPFIGWKVKGETQMTFVNGKLVWQKGE

SEQ ID NO: 5108 - protein, 350 aa, Enterococcus faecium
  misc_feature (B) LOCATION 1...350
  hypothetical: YES
TGEKIVIIYLEMRCTMLPEKMEQGFNQNLEAIQLLQNALGTSFLEAYVENAENLIDDYQVRVVDGVPTKETTQRITALYEELKKLSFEPEEWRRLSQLLLLKGSQTEHLQANHQLTPDSIGFLFVFLIEQLYTNKKAPVKILDIAAGMGNLLLTVLLNLSNAGYQTEGIGVDIDDTLLAVAASTSDLTQANVQYFHQDGLQELLIDPVDFAISDLPIGYYPNDEKAKEFLTSTEEGHSYAHHLLLEQSMKYVKPDGFGLFLMPSGFLETDQSEEIKKWFKEEGYLQGMIQLPDELFRNKQSQKSILILQKKGPQAQQVKEVLLVKLASLKEPEKVTEFFNEFKNWKSSAL

SEQ ID NO: 5109 - protein, 299 aa, Enterococcus faecium
  misc_feature (B) LOCATION 1...299
  hypothetical: YES
EVEKMKLGFIGTGVMGSAVARHLLEAGHEVAVYNRTKAKADPLVTEGAIWADTPKAVAEQSNILFTMVGYPKDVEEIYYGQSGIFSADISGHILVDLTTSTPSLAEKIAKTAKEKGADALDAPVSGGDLGAKNGTLTIMVGGEEAVYDQVLPLFKEFGTTFTLHGSAGKGQHTKMANQIMIAGTMTGMTEMLVYAQKNGLDLKKVIETLSGGSAANWSLSNYSPRILKEDYTPGFFVKHFIKDLKIALEEAEKMDLVLPATTQALKLYEELADKGFENDGTQALIKLWWPEGKIPEKKS

SEQ ID NO: 5110 - protein, 609 aa, Enterococcus faecium
  misc_feature (B) LOCATION 1...609
  hypothetical: YES
KNEKFHKQVAKRDWKDEKMLNTLKPLINQLKKKHTYFILGIALLFTIIRLYLYSKAIYGTDMSATYDDQLLIRYAQNILDGKWLGEYTTTTLSKGISYSLFLVLAHKLHLSYAVLFGMFSIFASILVALAFKPIVKNKYLLLSIYFYFLFSPISFTHEYSTRTYRNALVIPAVEIIIACLLAIYYRKYGSSRKLLPWFLGLSVAFPFFWFIREDSIWLLPFTVVALGISFVQILLGQDFSFKEVKKLKKRLFLLSKREWLKLSLFLLPIVGFSIVYQWIEYKNETTYGIATINDRSSGEFGRLMKQLIRIDDETNLNKENSEIWVSHAALNKALAASPTFHTVSTRIDELYTTHAWTQGGKVKELPGDIIFWALRDVVSESGYYQNNAKETNDFWKKVNQELEEAYHKGTIKKKKEFYLMGSGDGKTMSDLPIVFDFLQSGYAYAWRYKDFHQGGNYSFGTQEQVKQAQELLNLPLMENWIDSNEPRTPNFQLTKSAKVANVIIKIYQVLAIPVLIASIAGILLMILGTVFAKADRAYYSSSLIVVTGLILTQLVFLFGVSWFCSYAPEKKDYFLSVYTGAGVPLTQFIVVTSMLVFSKLNLKKALSSK

SEQ ID NO: 5111 - protein, 160 aa, Enterococcus faecium
  misc_feature (B) LOCATION 1...160
  hypothetical: YES
NSEKESSPDLKLKKAYADQSDGRNVIKANLQNPNASYMFGLTTSVEIYKKETKEPYLSIKKEKIDVAPNTNFDLLVPLEGKKLAPGHYQAVVKGAWKEKRWNLHTDFEITDDAADQLNEKDIDLKNQPETFDWRWLILVGVILIGLFAGLFILKERRKKK

SEQ ID NO: 5112 - protein, 70 aa, Enterococcus faecium
  misc_feature (B) LOCATION 1...70
  hypothetical: YES
RSEKPDRKEQRKFGRKVPDRTRIYRIKTRNDPSPIQTFFWYNRIEKTIKDRQKFAASLIVFFLNMRGIQF

SEQ ID NO: 5113 - protein, 282 aa, Enterococcus faecium
  misc_feature (B) LOCATION 1...282
  hypothetical: YES
RGENQRNESVGTKMIKLVAIDLDGTLLNEQKLISDENKQALAQAKQQGVKIVLCTGRPLAAMAHYLQELGLVDEGDYSITFNGGLVQKNDTGEIMEKKVMEVSDIQRLYKLAQQLDLPLDVLSDNVVLQLPSAPRKQSLYNVLNKLLQFQPADISDITDEFVLNKAVIAYDQEELDPKIKEIPAEFHEMYEIIKTRSMLLEFMPKGVTKAYGISLLAKDLGLKQEEIMAIGDEENDLPMIQYAGLGVAMENAVPFVKEAADFVTASNEENGVAKVIQKFVLE

SEQ ID NO: 5114 - protein, 278 aa, Enterococcus faecium
  misc_feature (B) LOCATION 1...278
  hypothetical: YES
FLEKGRRKIMYDAFVVALAVFIGVAGHEMFGMSMLSRPIVVAPLAGALMGDLQTGLIVGASLEAIFMGVVNIGISSTAEPSLAAGLATAFAIKMGGNVDAIIPIVFPLAVLGLQLMNMIFSFVCGPMAAKFFKFAKSGDQKGIINLHFFMWFVHYALYALIPFFAVLFGADVVKSVLDNIPEVIMNGLTVAGNLLPAVGMAMLLRMLWSKNIAVWFFFGAVVMAYLELPLIAIAAVGTIIAIVIAQRDLQLKNISVHAVQSDAAVNATLDQEEEDFFQ

SEQ ID NO: 5115 - protein, 62 aa, Enterococcus faecium
  misc_feature (B) LOCATION 1...62
  hypothetical: YES
DLEKLTKQRDMKNFNNCVVLIIITELTLFTNIYYIHEAQSSLIEDWAIFMAKEGKEMFQNKG

SEQ ID NO: 5116 - protein, 106 aa, Enterococcus faecium
  misc_feature (B) LOCATION 1...106
  hypothetical: YES
FLENLFKQSRRGGGNMSLQIIDSIVSIQVEQQVKEIITVLKPMLEDIISGVTLEYMDYQQASEYLGVSVGTIRKYVSQYGLPVIKIDTVIRFKKSDIDSFMERYKG

SEQ ID NO: 5117 - protein, 355 aa, Enterococcus faecium
  misc_feature (B) LOCATION 1...355
  hypothetical: YES
NIENEHYWREFVMDSKTRKQLQEKLKQRTHLLPSVFQQFLEENRSSLSLGSRYEYAKDFHLFTDYLRKVFSEEVDDQLIIHLEKQDYQNFLAKIYRHTRSFQTTANQETEQLFENSYYGISRKQYSLNHFLRFLYQKGLIEEEISLLGTSLPETTKAAPRYIDAELFKDFEHLFIPIEGFQTSREASFEEKNRPRNLAITAILLYCGLKIHEVVELKRKDVSLTKQILNLNRKENRLNKVPIPKEAMPFLENYFKLTAQNTDENSFVFRSSHDQQISPRTIRQILSKITVYKNVSPELCRKTYRYYAELYLDDADAVNYLCGNRYLSSHSFQDIWEKMVDFSYHELAAFVRVSSI

SEQ ID NO: 5118 - protein, 686 aa, Enterococcus faecium
  misc_feature (B) LOCATION 1...686
  hypothetical: YES
NIEKYRRKLDIYCSQLLFCIDLFLFFYYIGYIYSLKIEHNNFIMLSIPIFGGVLMDRYLDLLSEKFPTTEDVITEIINLEAILQLPKGTELFLSDIHGEFPAFDHILRIGSGNLKEKIKDLFSEQMTETEISQFTIFTAYPEYVLTTDWYKKQDKSQLIHRLIDLLRFTTVKYTRSKVRKGLPKEYSYIIEELLYIDDRINGKKDYVKKIIEQLVLMKEEEKFLTKLAQTIQKSVIDHLHIVGDIFDRGTQAAKVMDRIMDFSSVDIQWGNHDILWIGAYCGSEACLLTLLRIAARYNYLFELEKEYGLNLRPLFSFAHQTYQKNPVFTPKNRKDLSEREQEELEKIHQALSILQFKSEHQLLNRRPEFKMDDRKLLEKINYEESTIVLEGQLYELKGTCFQTIQPDDPKKFLEEEQKVIDSLMYSFQHSLRMQKHMTFLIEKGGMYLTNNQHVLFHGCIPVDEKGQLLAFELDQSYRGKELLGFFEKQITESAKDLTANEDLATDLIWYAWSGPFSPLFGKSKMATFERYFLTEPHTHVEKSNPYYHLRDEEWFSEKILAEFDAKEEGSAIINGHTPVKVKKGESPIKANGKAFVIDGGLSKAYQKTTGIAGYSLLCNSYGFQIVTHYPFLPIEQQFAKKSDQTNVKKVIEQQLPRKLNRNTTKGMELQQQITQLQRLLDYRKDD

SEQ ID NO: 5119 - protein, 470 aa, Enterococcus faecium
  misc_feature (B) LOCATION 1...470
  hypothetical: YES
TTEKRKREILMAETIVKTGQTVPLKIKRLGINGEGIGYFKRLIIFVPYALPKEEVLVKITKATPRYAEGELIKVKKTSKDRVVAPCPVYYECGGCQLQHLAYQAQLDFKKDLLLQALEKFKPAGFRSYQLLPTIGMDEPWHYRNKAQFQLRKNKQTQKIEAGLYEANSHQLVPITDCLVQEPRTQKVMNTVVQLLNKFDAPIYDERTNSGIFRTIMVRIGVKTGELQVVFITRSKKFPQKNAMIREINERLPEVVSIMQNVQAQKTSLVMGDETIHLWGKEAIEEQINEVTFDLSPRAFFQLNPQQTELLYGEGIKALDVQPNETIVDAYCGVGTIGLSVAKQAKEVRGMDTVPQAIADAKKNAERLGYHNTRYEVGTAEQVLPKWLNEGFQPDGIIVDPPRTGLDNALIQSLLKYPPKKLVYISCNVSTLARDLVNLSKKFKIEYLQSVDMFPQTARCEVVVKMTRLAD

SEQ ID NO: 5120 - protein, 65 aa, Enterococcus faecium
  misc_feature (B) LOCATION 1...65
  hypothetical: YES
GTEKGAYSTIIGFSCPLMLLSPDTVRILVSMGRLKWHFIYPIYSFLLVFQEVFGSSIKFFKQDIH

SEQ ID NO: 5121 - protein, 84 aa, Enterococcus faecium
  misc_feature (B) LOCATION 1...84
  hypothetical: YES
IAENSFFTLILFARKSQIYPASTPPIIPPRKPEPPVEASNPATIPGAKPAFPAIDVAIPAPNAGTIMANAVSPPILENAAANTL

SEQ ID NO: 5122 - protein, 319 aa, Enterococcus faecium
  misc_feature (B) LOCATION 1...319
  hypothetical: YES
NKENVRKFVMMKTLYNNPIVRQRADPWVYKHTDGYYYFTGSVPGYQVIELRRAKSLNELEHAASLIVWQAHEEGPMSELIWAPEVHYINGKWYIYFAASNHKTIRDESHHHRMFVLENQHIDPMNTDWIEKGQIKTKRETFSLDGTTFSSQGKLYYVWAQQDPEITGNSNLYLSEMDNPWTLKGKQILLSIPEYEWEKRGFSVNEGPAVLTRNGKIFITYSGSATDENYAMGLLWADEHKNLLLKESWHKLSEPVFVSSEKNKQFGPGHNSFTVSEDGCFDILIYHARPEKNQKGDPLDNPNRHAKAQCFKWNEQGFPK

SEQ ID NO: 5123 - protein, 333 aa, Enterococcus faecium
  misc_feature (B) LOCATION 1...333
  hypothetical: YES
IKEKELKTKMCRISIIVPVYNVEKYLKKCVDSILGQTFTDFELLLIDDGSTDNSGSICDELAKTDNRIKVIHKENGGLSDARNIGIEVAKGDFIGFIDSDDYIDEDMYAFLYNNILKYDAELSMCGIYDVHKNKEIKKLTPFSQLVTKSEAIELVLDGKLVVANAVSKLYKKELFENVRYPKGKIAEDAAVILKIINQCNKIHVDTSQKYYYYHRGDSITSKKFTKKDFDIIDVWNENEKWIIKNYPQMYDKVHTRVCWAYFVVLDKLVLTEEKGLYQEKKQVREYLIDNFFFIIKNKRLTFQRKISMLLLTFGIAAYKIPVKYQYKKVKAVN

SEQ ID NO: 5124 - protein, 82 aa, Enterococcus faecium
  misc_feature (B) LOCATION 1...82
  hypothetical: YES
TKEKGEMMEIRRAVKEDLPQINQLITDHPESFVKVKTAAELHDRNKLLIVAVTKENRIIGFAQADEQQSEERVDQRPAGFSP

SEQ ID NO: 5125 - protein, 103 aa, Enterococcus faecium
  misc_feature (B) LOCATION 1...103
  hypothetical: YES
EEEKMKNRLIVACGSGVATSQTIASKIQSMLEDDGIAFPVEAVDYKSIQNELLTAGIYVYVAQPDEEVLEQAKDLGIEVFPGIPFLTGMGVEPIYDSIKELVQ

SEQ ID NO: 5126 - protein, 73 aa, Enterococcus faecium
  misc_feature (B) LOCATION 1...73
  hypothetical: YES
EEEKMKQQFSIEGMSCNHCAARVEEAVSALDGVQKVKVNLKKANGTVKFDETKVQSEKICQAINGLGYKAVVI

SEQ ID NO: 5127 - protein, 68 aa, Enterococcus faecium
  misc_feature (B) LOCATION 1...68
  hypothetical: YES
IRENRIPTTPPTKIAIHGVIEPSDGLIVKLKTMELKAPMTMIPSSPTFTIPLRSEKVPPSDVRISGVE

SEQ ID NO: 5128 - protein, 150 aa, Enterococcus faecium
  misc_feature (B) LOCATION 1...150
  hypothetical: YES
KGEKNMAQNYYDEFVKLPLDKMAQKMEDMTFLYNETRVPKKHYKEKLSVAVEEMIESGVEMNLIATYYRTLEELKKQNAKWFFQALLCLEIGVKPSTIKPSEYQALELTYAKFIETKKAKTVSSEWLDYFENINKYGAYYTMKKEDNENE

SEQ ID NO: 5129 - protein, 161 aa, Enterococcus faecium
  misc_feature (B) LOCATION 1...161
  hypothetical: YES
KGENFMSIYNFETTLEDGTVYSLKKYAGKPIIIVNTATKCGLAPQFKQLEELYQAYQTQGLVILGFPSNQFKQELDSATEAAEACKTTYGVTFPMHQLIDVNGENTDPLFTYLKNEAPGTVTKAIKWNFTKFLIDRNGKVIERFAPQTSPLKMTAAIESVL

SEQ ID NO: 5130 - protein, 114 aa, Enterococcus faecium
  misc_feature (B) LOCATION 1...114
  hypothetical: YES
HMEKELSTLDQYLIDPDWGKPKIEETSGRKIRRNLLTNEELAWDQDDLGNHVTIWDHVYLIHLSKHSNKPEYIYVIEDGLIDALEEYDRDNLIDISYYGPGKKYIAEMEAEFDE

SEQ ID NO: 5131 - protein, 306 aa, Enterococcus faecium
  misc_feature (B) LOCATION 1...306
  hypothetical: YES
NMEKVLVIVGPTAVGKTALSVELAQLFGGEIISGDSLQIYKNLDIGTAKIKEEEMNNVPHHLIDVIEPTQRYSAADFQHSGRQLITEIANRGHLPIIAGGTGLYIQSLLYDYQLGATEEANPEIRKKYETLAETIGSQALWNQLKEKDPAAAEKIHWNNQRKVIRALEVLETTGHSITAPKEEPKQLYDYLMIGLDTKRSILYERINQRVDLMLAEGLVAEARKVYELGEVQASQGIGYKEFFPYFEGKETLEEATEQVKLHSRRYAKRQLTWFRNRLDAQWFDLISEPNQKSQIEQTIKKWLEAE

SEQ ID NO: 5132 - protein, 357 aa, Enterococcus faecium
  misc_feature (B) LOCATION 1...357
  hypothetical: YES
IMEKAKDYFINFVLFLIYFVIVFFALVFNNSLGWFLLAFFTLYVSWSVFSLSTFLKKLSVTCTVQPVVYRKKSIQVIFSIAKKGAFSFPLPRLQIVFPEIFAEKKQEILILTNKPQEVQVLWQPKERGFHEALTVIFTAYDSLGLFRKRTRRELSFPVTVLPAFHKTQAETLQRVLEKKQQLNAYQKGLDFREHRSYRPGDSFNRIDWKLSAHSQEWLYREYEYQEEYSPLLCFWGSPSLKFDHLLDLYFSLWHLRKEKQPELLILGDRTFHGKDPGYTYFASLNAGDEKTFLAHLKKQAKKQIVLFIPEHSPEVSEAVETLSKDRTVYLVYFAEKQIMIQEKDKVCSLSGGEWIDD

SEQ ID NO: 5133 - protein, 303 aa, Enterococcus faecium
  misc_feature (B) LOCATION 1...303
  hypothetical: YES
RMEKLLVFYNKSSGKDEGEKLARWFQDYVKEKQPELYVELAETGPSIDDAELVKKAEAIEADTLVIIGGDGTIHHIVQAFQKTLSQYHVGLLPGGTVNNLARVLEIPLKKEEAADVILEGNVRKIDYGQVNDEVIISTLTIGILADTAVWISQEEKQRYGSWIFIKKFFKLLLKKKKYHLDLETDEEHWKGKSQLLTVTMSNSVGGFTNFDDSATLDDGKFHVTIVPSLDIFRFIFYLPRIMRGKFYTIPGITYFTAKRMKIQAQEKSVGTRTDGDTTDDLPVELSVVSKGLTVYSPKKEEKA

SEQ ID NO: 5134 - protein, 673 aa, Enterococcus faecium
  misc_feature (B) LOCATION 1...673
  hypothetical: YES
KMENIARKERRRLEQTKRFRKAKRGAAIVGTAMVGCSVAAPLVQPVPVQADETPVQFSARINTAAFITEIATYAQPIAQANDLYASVMIAQAVVESGWGSSALSQAPYYNLFGIKGSYQGQTVYMDTLEFLNNQWVNKKEPFRQYPSFAESFNDNAYVLRNTSFGNGYYYAGTWKSNTKSYTDATACLTGRYATDPGYAGKLNNIIATYGLTQYDTPASGNAGGGATTGGNNTGSAGSTGGSSNSGNTNSGSATSTTYTVQSGDSVWGISNKFGITMDQLIQWNNIQNNFIYPGQKLTIKGSQENGSSTNNSGNNTNSSGNAGTSNGGQTTGAKYTVQSGDSVWKISNDHGITMAQLIEWNNIKNNFVYPGQQLIVSNGGSSNAGANTGSNTGNTSGSSSSSSSSSNTASGTKYTVKAGDSVWSVSNKYGITMAQLIQWNNIQNNFIYPGQQLTVSNSGSTNSTSGNTGSSTNTNNSSSVNTGSSSSQGTYTVKAGESVWSVANKNGITMDQLIEWNNIKNNFIYPGQQLIVKGGTSANTNTGSTTSAAKPNTPNTSATTSTSSTGNTMYTVKAGESVWSVANKHHITMDQLIEWNNIKNNFIYPGQQVIVKKGSSQSTNQQSVTGSKTYTVKSGESVWSVADSHGITMAQLIEWNNIKNNFIYPGQTLIVAK

SEQ ID NO: 5135 - protein, 436 aa, Enterococcus faecium
  misc_feature (B) LOCATION 1...436
  hypothetical: YES
WMEKERIKMNIRKLIAGVVCLAAASGFLTGCGSASSTADKEEKVTVWAWDETFNIKAVNEAKKVYENEETEIEVVTMSQDDIVQKLNTALASGNTEGLPNIVLIEDYRIQGYLTSYPDAFANLSAIVKEDHFAPYKFAVNKVGDKIYGVPFDSGVTANFYRTDLMAEAGYTEEDMENLKWDEYIQVARDVKEKTGKKIAEVNPSDLGRVRMIMQQAGEWYTSEDGETVTIQDNASLKYGLELFATLLKEDLVEQTSDWNAGVTAIQSGAVASSPTGAWYSSTIQGAENQCGKWKIAPIPALPENLQKAQASNIGGAGWYVIKGVAGEDSAKDFLEATFASNEELMGTLAKEIGLVSTMLSANEQEAYQEASEFYSGQKIFDDFSTWTSEIPEVNYGHETYAIEAVVAEALHRIINGEETDKVLADTQKQVEAQLAN

SEQ ID NO: 5136 - protein, 196 aa, Enterococcus faecium
  misc_feature (B) LOCATION 1...196
  hypothetical: YES
CTEKGERLMLQTALHFSHTLLQEILQPGDHVVDATMGNGHDTVFLAEHIGKTGHVYSFDIQQQAIDATRERLEQRQLEERVSLFLQGHETLGEVIAEQQNLKAGIFNLGYLPKSDKAIITMPETTRTAMEEILKRLVPRGRLILVVYYGHEGGEKELDMVDSFCSKLPQETYNVLNYRFINQKNQPPILYCIEKKR

SEQ ID NO: 5137 - protein, 61 aa, Enterococcus faecium
  misc_feature (B) LOCATION 1...61
  hypothetical: YES
KAENQFQNFIWLVGNLIFFIRQIRKWYLLCRNKAWRSPLNKDLAIITGSSGTNGFNVHWRG

SEQ ID NO: 5138 - protein, 192 aa, Enterococcus faecium
  misc_feature (B) LOCATION 1...192
  hypothetical: YES
KKEKISMEAETPFQKVETFHKTFDPRRPEIPTAFTENEAHTRAAFKIEELVEFVAATSPNKEQLHEAVMLLHEALDKAEEKILGKTQWGSDPLVEQVDALTDILYFTYGSFSLLGIVPDRIFEIVHQANMGKLFPDGKPHYDPVTNKVLKPENWQMEYAPEPKIAAEIQRQIQEAIAKKKSADIGMCTNEKE

SEQ ID NO: 5139 - protein, 109 aa, Enterococcus faecium
  misc_feature (B) LOCATION 1...109
  hypothetical: YES
KEEKKMELKFVVPDMAETFGKLSYAGEGEVLTEGYGRNTTVIGRSYHLYSSKQRADDIEVVVAAEAGEKDFDQDQPLKAVNPHLVAKGYEIENRGFTDYVLYVDDLVKA

SEQ ID NO: 5140 - protein, 714 aa, Enterococcus faecium
  misc_feature (B) LOCATION 1...714
  hypothetical: YES
MEEKKMKRFVRMGIDVGGTHTKAVAIDNATHEIIGKSSVKTTHDDVRGVAAGVVQSFQNCLRENNISPEDVVFVAHSTTQATNALIEGDVAKVGVIGMAKGGLEGFLAKRQTRLNDIDLGNKKKIEIVNAFLPVKHLNVDRVSETISSLERERAEVLVSSMAFGVDNGEPERVVYEAASVKSIPTTMASDITKLYGLTRRTRTAAINASILPKMLDTATSTEDSVREAGVNVSLMIMRGDGGVMEINEMKKRPVLTMLSGPAASVMGSLMYLRASNGVYFEVGGTTTNIGVIKNGRPAIDYSIVGGHPTYISSLDVRVLGVAGGSMVRANQSGIIDVGPRSAHIAGLDYAVFTETEKIKGPKVEFFSPKEGDPADYVKVVMEDGEEVTITNTCAANVLGLVQEEHFSYGNVPSARKAIQALADYCHTTVEDIAEQIMEKSYAKIEPVILELADKYHLEKDQISLVGVGGGAASLITYFSNKMGVKYSIPENAEVISSIGVALAMVRDVVERIIPSPSKEDIRSLKNEAMNKAIESGATPESIEVHVEIDPQTSKVTAIATGSTEVKATDLTKEITTEEALELAAEDMRLNKNEVCLLENTPFFYVCGEQNRSKNAGSLRIIDQKGFIKVQRGHASCMKTTAANYMTAVEQLWEDMAVYQTELIARPEFYLCLGARVSDFTATDLEQLQLLMDLEVSTMEPEEEVIVVAGNIKQT

SEQ ID NO: 5141 - protein, 793 aa, Enterococcus faecium
  misc_feature (B) LOCATION 1...793
  hypothetical: YES
EWENVKNKRYLMLQWIKEHSLILKLIFFGSVLVFVANQVANIANGMSWQDIWQRMGQQSRMTILLMILAGLLGVTPMLLYDWVTIRVLEKQGKPKMERKEFLLAAWVTNTINNLAGFGGVVGASLRASFYGKQTNRKMVLATVSKVALFMLTGLSVWSFLTFIDVFFIQSESIFRSYWIWLFGGSFLAPVIFFFAYLKRKTLFFEFYPKGLLGLLLASFGQWTGALAVFLIIGKLMRIDISMLSIYPMFMIATLIGMLTMVPGGMGTFDVLMILGMSQLSVRQDVAVVWLLYYRLFYYVLPFMTGLLLFITHTGVKINRFLDNIPRLFFQKVAHIVLVSAVYFAGIMMVLLSTITNLSAISRLFQVLLPFSFNFLDQTVNLLVGFLLLGLARALSVKVKKAFLPTIALLSFGILNTITRTLSWQLILVYVLILLAVWLSRTEFYRTKFVYSWGAIIFDASLFGFLFIVYAIAGYHSGRFLVGRITGNHFILFPSDDVWFSGLIGLGISLLALVALYQYLAEDTTKLGSEYEKDRFDRLLETYGGTATSHQLRLSGYSYFYYQEDDQDQVVFGYQIKGNKCFVLGDPVGNPKMMRAATNQFMKQADCLGYQLAFYKISESYVVMLHELGFHFTKVGEAGIVDLATEDLSRLSQQLEYQRLMKEGYHFTWYDQLPEELHQAVNEVSQKWLQGAREKYFSVGRFDKSYVLSSGVGIVRKDQKVVGFITAQPMTKKQAGYDLLRVLPKESEELADYLLANLFIVYEKMGYSEANLGLAPLANVGETDFLSFEQRSCI

SEQ ID NO: 5142 - protein, 246 aa, Enterococcus faecium
  misc_feature (B) LOCATION 1...246
  hypothetical: YES
TRENQFDLYAQRSNDLWWSDPTEKELEITLDKELGVDYFLERRELGVINIGGPGFIEIDGQKEEMKKQDGYYIGKETRHVVFSSQDAENPAKFYISSVPAHHKYPNVKISIDQVKPMETGEGLTLNERKIYQYIHPNVCESCQLQMGYTILEPGSAWNTMPCHTHERRMEAYVYFDYANEDTRVFHMMGKPDETKHLVVDNEQAIISPSWSIHSGVGTSNYSFIWAMCGENITYTDMDMVQMDQLK

SEQ ID NO: 5143 - protein, 277 aa, Enterococcus faecium
  misc_feature (B) LOCATION 1...277
  hypothetical: YES
GREKIMLMHATMAALAVFICFAGNYLTGQSMMERPLVVGLVTGILMGDMKTGILMGASLEAIFLGNVNIGGVIAAEPVTATTMATTFAIISNVETKAAMTLAVPIGMLAAVVVMFLKNVFMNIFAPSLDKAAREGNEKMVVALHYGTWVIYYVIIASISFIGILAGSGPVNTFVENIPQNLMNGLSAAGGLLPAVGFAMLMKLLWDNKLAVFYILGFVLTAYLGLPAVAVAVLGVVICVVSAQRDLQIRDIESGAVAHSGNNGAPMTKEDEEEDFFA

SEQ ID NO: 5144 - protein, 339 aa, Enterococcus faecium
  misc_feature (B) LOCATION 1...339
  hypothetical: YES
CSCFAGCEHQEDNVMKVFDYEDIQLIPNKCIVNSRSECDTTVTLGKHTFKMPVVPANMQTIIDETIAEFLAENGYFYIMHRFDEAARIPFIKKMKKRGLITSISVGVKKEEYSFIEKLAEESLNPDYITIDIAHGHANSVIDMIQHIKKYLPETFVIAGNVGTPEAVRELENAGADATKVGIGPGKVCITKIKTGFGTGGWQLAALRWCAKAARKPIIADGGIRTHGDIAKSVRFGATMVMIGSLFAGHEESPGETKVENGIVYKEYFGSASEFQKGEKRNVEGKKIWIQHKGSLKDTLVEMQQDLQSSISYAGGRDLEAIRKVDYVIVKNSIFNGDTI

SEQ ID NO: 5145 - protein, 86 aa, Enterococcus faecium
  misc_feature (B) LOCATION 1...86
  hypothetical: YES
FDRNNPRDIAYPKRRKRKTSSCRSRAWTHGRRSETKTVGFNPIDHLSLVTRTNAQQQFITTVDGRFSYLSSNFSIGVYFSFILLCP

SEQ ID NO: 5146 - protein, 241 aa, Enterococcus faecium
  misc_feature (B) LOCATION 1...241
  hypothetical: YES
FNRKYHYRSVTMKGIIFDFNGTMFLDSHLHEAAWLHMIHDHTKDGLSDEDILKNIHGRTNTEILKHFISEHLTASEIAVLSEEKESYYRMLCLQNENELQLTKGLEATLDQLTDQQIPLTIATATVKENVAFYFDIFDLARWFDWDKIVYDDGSFPGKPQPDIFLKAADKLSLAPADCLVIEDAYSGLLAAKRAGIGTIIAIDPFGKNKTVFEQAQLNKDGTIKDFTGFWTEHLSATSVNS

SEQ ID NO: 5147 - protein, 164 aa, Enterococcus faecium
  misc_feature (B) LOCATION 1...164
  hypothetical: YES
KTRKCYPYRKERQEGSLIMSGGEIAGLIAAIAFAILVVFIVRVLLQVSKTLEKVDQTVAEANTTIEIVTKDVDLLSRQVEGLLVKSNELLLDINGKVATIDPLFTAVADLSESVSELNHSSKNIATKVGGIGKTTAKATVAGKVGGTAMKFFKNKKHTETTGGK

SEQ ID NO: 5148 - protein, 1067 aa, Enterococcus faecium
  misc_feature (B) LOCATION 1...1067
  hypothetical: YES
RKRKKASCKRCLFREGRRMKISHREEAEVEEQLIRVLGEGHNQWTYRPDLKSEEDLWVNLRQKIISNNQAELNDSPLTDKEFETIKTELLLRTKTPFDAAKWLKGENGMARITIERENPQLGSVSLILYSNQDIGGGISTYEVVHQIAKRGSNIEARDRRFDVTLLINGLPIIQIELKQVTAKDGFYQAFNQIKKYAEEGMFRNNIFSTLQLFVVSNEQTTRYFANALPKDLHPKFLFSWRTKDNKKVENLYEFCKQVLNIPDAHRLIADYTIVSEDQDNKTLMVLHPYQVHAIQALFIAANKHQSGYVWHATGSGKTLTSFVSTKLLARKSGIDRTIMLVDRKDLDNQTTTEFTKFASEFNTGVSSGNAKANSLIVGTGSAKELSETLLADANANVVIITTRQKLDAALKYAKKQEEKKGTNRFQKLMGQHIVFVVDECHRALSAENMEEIKKMFPKSTWFGFTGTPIFPENRKQAKGQLARTTHDQYGEVLHTYTIKNALEDGSVLGFQVEHENTVEPTSLENKIYRKLKEVETYAEYSPEQINRMIDQMESVKKESYLDPTVFEAEEHIQKVIHKMFRPDNAYTKFDFRNGRPTKSAILTTSSIDMAKKYYRAIKEMTKESDWLIKEFPNQPIREGRTMEDPDFPRIAITYSLEENSRDSSAQQEEMQKIIEEYNQYYDTAWSLADIERYNGDINNRLARKRAEFKQFGKQIDLVIVVDRLLTGFDAPTIQTLFVDRNLEYAGLIQAFSRTNRTYPEKTKGLIVTFRKPATMEKNVEDATKLYSEAKEESGLIYPSYQESKKRFKQAYGKLKEVSSMESIDEHTPLEIRIEYVKAFQELNRAYESLVTYDDYNDDMVQSSTLNNQIQLLEEQIGVYETVKGSLMEEEPEKEGEDFSTIEFYSENTTKLYDIDSTYIDQLLGTYAANSSDAREEIEKALAKLNKTEGVKEVYRQILNAFDMGTLDSNEDIFVIKRRYFTQASDDLIHAFSNEWFVSEKELHASNLQYMPGEDPIPNMKAIINSKDYEGYKAKHPEAKPFKYPQEMKRAWRKMLDDELIPLENELR

SEQ ID NO: 5149 - protein, 84 aa, Enterococcus faecium
  misc_feature (B) LOCATION 1...84
  hypothetical: YES
EERNMGFIWSLIVGGIIGAIAGAITNKGSSMGIIANVVAGLVGSALGQALLGSWGPSIAGMAIVPSLIGAIILVLIVSFFARKL

SEQ ID NO: 5150 - protein, 1231 aa, Enterococcus faecium
  misc_feature (B) LOCATION 1...1231
  hypothetical: YES
IMRKMKTMDGNTAAAYISYAFTEIAAIYPITPSSTMAELVDQWSAAGKENVFGQPVKVVEMQSEAGAAGVVHGSLKTGALTTTYTASQGLLLMIPNMYKIAGELLPSVFHVASRAVTTNALNIFGDHGDVMAARQTGFAMLAESSVQEVMDLAPVAHLASIEGEVPFLNFFDGFRTSHEIQKIEVLEYEELAPLINQEKLASFRKRGMNPNHPTVSGTNQNPDIHFQQRETINPYYDKLPEIVQKYMKEINRLRGTSYDLVTYYGADDAEEVIVSMGSVAQTIEQTIDYLNANGRKTGFLNIHLYRPFPVETFVQKLPHTVKTIAVLDRSKEPGAGGEPLLLDVQSALYDSELRPAVIGGRYGLGSKDVTPDQISAVFDELKKDPSIRKKRFTIGIVDDVTYQSLEPKESLDLTEPQTFQAKFWGFGSDGTVGANKSAIKIIGDHTDKYAQGYFYYDSKKSGGLTVSHLRFGDTPIRSAYLVEHADLVACHTPAYLHSYDLVKGLKPGGIFLLNTLWSDEQLETHLPLKLKRYLAENNIRFYTINAMRLAQEVGLGRRINTAMETAFFKLADIIPFDEVLPLLKEEALKSYGHKSMAIVEKNIQAIDRTTELLHQVAIPDHWRTLEMPEKINKRNTGYIQEILEPVNAQEGNQLSVGTLVANGMTTGEMPLGTASMEKRGVALEVPEWISDRCTMCNECAFVCPHAAIRPFLADEEEMEEAPEGFIVREMRGADGVKYRIQVSVEDCTGCGLCVEACPAKEKALVMKPYEEQKEQAVNWAFAMTLRQKANPVKGKNTVLSTQFNQPLLEFSGACSGCGETPYVKLLTQMFGDRMMIANATGCSSIWGGASPASPYTTNECGQGPAWSNSLLEDNAEFGYGMLLAAQTRREALASSIKEVLPKVSEELRELMEDWLVHMFESEGTQQRAAKLQAAIESERSIFPELEDIYKRKDLFVKNSQWMIGGDGWAYDIGFGGIDHVLASGADVNILVLDNEVYSNTGGQTSKATPASAIAKFSASGKYASKKDLGMMAMTYGNVYVAQIASGANQMQTIKAFEEAEKYPGPSLIIAYTPCITHGLLGGMKESLKEAKEAVSSGYWSLYRYNPTMVEKNKNPMTLDYKKPDFSAMPDFMRKQVRFSSLDNANPNLAKALFEKTVHDAKTRFYNYAALTGELEKIKKRLEPEESIDVPVKTRKEKTTDLEAEERRAARRAARAERRKKMEQATKEKKEK

SEQ ID NO: 5151 - protein, 174 aa, Enterococcus faecium
  misc_feature (B) LOCATION 1...174
  hypothetical: YES
SMRKIIFYGAVSLDGYLATKTDDLQWLFDTPTGEQTTYEAFYETIDTTIMGRKTYQEAKKYLETEAIYPEKKNFVFSTNAQLQLPDAEVVHEEPVAFLKNLQMTEGKDIWVVGGGRLIKPLVEHQMIDEWYIQIAPVLLGDGIPLFQKGTYEARFELLDTTRFGEFIELHYIRK

SEQ ID NO: 5152 - protein, 291 aa, Enterococcus faecium
  misc_feature (B) LOCATION 1...291
  hypothetical: YES
KWRKLLEIIKIIFLNRRKQMTKLSEMLQETTQFILDKGVKEIDFGLILGSGLGELADEIEDAVMISYDEIPFFPVSTVVGHAGKLVYGSLAGKKVLAMQGRFHYYEGHSMQTVTYPVRVMAGLGAHSVIVTNACGGVNESFVPGDLMLITDHINFTGENPLIGPNEDAMGPRFPDMSQAYTPDYQATAKAAAEKLGLDLKEGVYMGYSGPTYETPAEIRMSRTIGADAVGMSTVPEVIVAAHSGLKVLGISCITNLAAGMQANLSHEEVVETTQRVKQSFKALVKETLTLL

SEQ ID NO: 5153 - protein, 294 aa, Enterococcus faecium
  misc_feature (B) LOCATION 1...294
  hypothetical: YES
CFRKIILKGSRNMVIFKTVNDVRSQVKEWKKQGLKVGLVPTMGYLHEGHESLIRKASKENDKVVVSIFVNPTQFGKNEDLGSYPRDLERDIEVCTRGRATAIFNPEVEEMYCDNASTFVNITGITEGLCGASRPIHFRGVCTVVSKLFNIIPADRAYFGEKDAQQLAVIKRMVRDLNIDIDVVGCPIIREEDGLAKSSRNTYLSLEERSSATILNKSLTLAKEALNNGERDSLKIIEIISKNINTYNLAKIDYVEVVDSLSLQRVNYIEKSVLVAIAVFIGKTRLIDNFTFELQ

SEQ ID NO: 5154 - protein, 114 aa, Enterococcus faecium
  misc_feature (B) LOCATION 1...114
  hypothetical: YES
TFRKVVLSMNTYEIIKDLAKRKKISIRQLEINFGYSNGYLAKWKNNTPNSDELSRIADYFDVSVDYLLGREERETPKHVDLSEDDTVFSFDGKEISKETMRKAIAIAKALEENE

SEQ ID NO: 5155 - protein, 62 aa, Enterococcus faecium
  misc_feature (B) LOCATION 1...62
  hypothetical: YES
QFRNYNVYLYKITPCTAKDTGVICTFLTNYYTSSVVFVIAGNLNIEGFLFVYILLNSNFFGT

SEQ ID NO: 5156 - protein, 147 aa, Enterococcus faecium
  misc_feature (B) LOCATION 1...147
  hypothetical: YES
ATRKGCPMDQYLTVNVVTPAGLVYDHHAAIVVARTTAGELGILPKHAPIIVPLTIDEVRVKRTDSDTHVDWIAVNGGIMEVRDNVVSIVADSAERERDIDVSRAERAKQRAERQIEEAKAKQDTNELKRATVALHRAINRIKVSKHS

SEQ ID NO: 5157 - protein, 271 aa, Enterococcus faecium
  misc_feature (B) LOCATION 1...271
  hypothetical: YES
KNRKEKMMMKKQIITIAGGGSTYTPGIVQAILNNEKRLPLSEIRLYDIDEERNMDMYLIVKFMLKRKGFSNIRIRATDDPKLAFTGCDFVFSQIRVGGLEMREKDEKIPLKHGLVGQETCGLGGFAYGMRSIKGLLEIVDHIQDYAPKAWILNYTNPESIVSEAVRRKYPNVKMINACDMTISIEETIAVNYGYDRKNWIVTYYGLNHFGWYTSIYDKELRREIMPEIIEKLITKEMQVADFNIGDKTWQKTFQMMSVITKNFQVISRIIT

SEQ ID NO: 5158 - protein, 102 aa, Enterococcus faecium
  misc_feature (B) LOCATION 1...102
  hypothetical: YES
GGRKMKLKDGFYASSHGIGGLMLDMPTKNPKTRKKPKVKVGDMVRCEAEEFIYPFRGYVEHVYNHSAIIRIENTMECDKLLAKSKENLAVARLVDIELIESK

SEQ ID NO: 5159 - protein, 153 aa, Enterococcus faecium
  misc_feature (B) LOCATION 1...153
  hypothetical: YES
KIRNWLVIWMLREMRLEDAEALREINADQLGYDIPLTVTVRQMKKLLKEPEKNFFLVYEDPTSKKAAGYVQAESYESIFSDPMFNIMALAVSKYAEKRGIGKALMTGVEEEAKKRGITTIRLNSAEYRVEAHQFYEHIGYHSDKMQKRFLKIL

SEQ ID NO: 5160 - protein, 62 aa, Enterococcus faecium
  misc_feature (B) LOCATION 1...62
  hypothetical: YES
RHRKYRVSDFSTTSKNYCFFPLKCLQKVGSGRIYWQNQGEGSLNKEKNHRKYKVITYKTSFL

SEQ ID NO: 5161 - protein, 115 aa, Enterococcus faecium
  misc_feature (B) LOCATION 1...115
  hypothetical: YES
LDRKIKVCRLEENIPGGIFMSKRTRRTFSQEFKQQIVNLYLAGKPRVEIIREYELTASAFDKWVKQSKTSGSFKEKDNLTPEQKELLELRKRNQQLEMENDILKQAALIFGRRDK

SEQ ID NO: 5162 - protein, 115 aa, Enterococcus faecium; identical to SEQ ID NO: 5161
  misc_feature (B) LOCATION 1...115
  hypothetical: YES

SEQ ID NO: 5163 - protein, 115 aa, Enterococcus faecium; identical to SEQ ID NO: 5161
  misc_feature (B) LOCATION 1...115
  hypothetical: YES

SEQ ID NO: 5164 - protein, 115 aa, Enterococcus faecium; identical to SEQ ID NO: 5161
  misc_feature (B) LOCATION 1...115
  hypothetical: YES

SEQ ID NO: 5165 - protein, 238 aa, Enterococcus faecium
  misc_feature (B) LOCATION 1...238
  hypothetical: YES
RSRKKMITAIIIAGGVGKRMGQDIPKQFITIEGKPIIIYTLESFQHHPQVDRILVVCKSGWEETMWAYIKEFNISKVKWVITGGSKGQESINNGVQFLKDYSEDDDTIIIHDGIRPLVDELVLSDVIVKCKEFGNGVTSLPYNEQIFIKKTEETTEQYVDRNTLRRVSTPQAYQYGKLRAAYDRAVKEDIGMTDSSYTNTMMVDLGETLYFAAGSDKNIKLTTTDDLELFKAYLKMKD

SEQ ID NO: 5166 - protein, 159 aa, Enterococcus faecium
  misc_feature (B) LOCATION 1...159
  hypothetical: YES
EARKMKFQQTKEVLNQLVADLSQMSVVVHQTHWYMRGPGFLTLHPMMDEFMDDLNAQLDEVSERLITLDGSPYFTLREFADNTKIPDEIGRWDRTIPERLETLVAGYRYLADLYQKGIEVSGEEGDDPTQDIFIEFKTATEKRIWMIQAHLGKAPEIDA

SEQ ID NO: 5167 - protein, 60 aa, Enterococcus faecium
  misc_feature (B) LOCATION 1...60
  hypothetical: YES
VKRNKEVFTMGLKFERTDNLDKLFESFAVDPEKTVAPKEEIDRFLKPQPQNEKKKDKKQK

SEQ ID NO: 5168 - protein, 385 aa, Enterococcus faecium
  misc_feature (B) LOCATION 1...385
  hypothetical: YES
EERNMHIQTKLIHGGISEDPTTGAVSVPIYQTSTYRQDGVGQPKQYEYSRSGNPTRFALEELIADLEGGVRGFAFSSGLSGIHAVFSLFQAGDHILLGDDVYGGTFRLFDKVLTKNGLEYTIIDTSNLDKIEQSIKPNTKALYLETPSNPLLKITDLEKSATLAHQHGLIVIADNTFATPYFQRPLDLGSDIVVHSGTKYLGGHSDVVAGLVTSNHKDLADQIGFYQNAIGAVLGPQDSWLLQRGIKTLSVRMEEHQKNAFVVADFLFSHPAVEKVYYPGLPDHELHGVAKQQMSGFSGMISFTLKNEESAIPFVESLQLFTLAESLGGVESLVEIPSVMTHASIPKEKREEAGIKDGLIRLSVGIEYGQDLINDLAQAFDRIKN

SEQ ID NO: 5169 - protein, 236 aa, Enterococcus faecium
  misc_feature (B) LOCATION 1...236
  hypothetical: YES
EERKMARTQKQKAAQTHAVSLVTLTNPSSPIAEQYRTIRTNIQFASAAGQQIKTIVVTSSGPGEGKSTTAANIAVVFAKSGQRVLLVDADLRKPVIYKTFKLNNASGLSTVLSSSGSVADEIQRTPVDNLSILPSGPKPPNPSELLSSPRMDQILAEARQLFDVVIFDMPPVVAVTDAQIMSSKTDGTLLVVRENTSRKESLTKAKELLDMVQARVLGVVYNGAEHSRDAGYYYGN

SEQ ID NO: 5170 - protein, 219 aa, Enterococcus faecium
  misc_feature (B) LOCATION 1...219
  hypothetical: YES
FLRKKRHQKRSMLCLESVSQTKVYGQKSRCVLLCREILISLYKEKTKSRKIGVGGKKMKKKDLLTYLDEIIEKQVTDYDVALDWDTKNHTIEIVVRLFAENKAQFEIDDAEGIVSQEPIIEFEDGVLLFNPQKSVFDERNYLAVIPYEGKKGLAKSVADSLVEYLNEVLAQGQSDLLDFLDEDDDEAVFELHWDNQQLAELVEVKQQNEADTYLPYPSY

SEQ ID NO: 5171 - protein, 247 aa, Enterococcus faecium
  misc_feature (B) LOCATION 1...247
  hypothetical: YES
NMRNIKLTIEYDGKRYSGWQRLGDDDKTIQGKIEKVLHQMTNEEIEIIGSGRTDAGTHARGQVANFKTNTEIGLAEMIDFMNRYLPRDIVIKRIEEMPERFHSRYNAVGKKYSYYVWNNVIPSAFERNHSFYFPQELDMDKLNAACEKLVGTHDFIGFSALKKSKKSTVRTIDELSIERKGEMLHFTFVGDGFLYKMVRIIMGTLLEIGTGAMPIETIDEIFESKVRQHAGETVPAQGLFLDEVYYR

SEQ ID NO: 5172 - protein, 74 aa, Enterococcus faecium
  misc_feature (B) LOCATION 1...74
  hypothetical: YES
LKRKKVIHLKKIIPLLLVLFVGEILMRDSAAVQLNLAVFLVILVFCLIFWRFVLVLVSLLFKMIAAIFFMGLFR

SEQ ID NO: 5173 - protein, 74 aa, Enterococcus faecium
  misc_feature (B) LOCATION 1...74
  hypothetical: YES
PKRKKEIHMNKIIPLLLVLFVGEILMRHAAAVHLNFVVFLAILVFCLIFWRFVLALVSLLFKMIAAIFFIGLFR

SEQ ID NO: 5174 - protein, 239 aa, Enterococcus faecium
  misc_feature (B) LOCATION 1...239
  hypothetical: YES
VKRNKYLFLFPSNECVILMDERSFGYQGGMHMHIERLKTGMIEENCYLVYNEEALLIIDPGEDAERIKQEIKKTNQQPVAILLTHTHYDHIGAVEPLRAYYQIPVYVSPLEQKWLGDPILNLSGLGRHDDIADVIVSPAEYEFEMKTYTLGNMSFRVVPTPGHSIGSVSFIFDDFVVSGDALFRGSIGRTDLYTGNLEQLLHSIRTQLFVLPDEFAVYPGHGDATTIEQEKRTNPFFNR

SEQ ID NO: 5175 - protein, 387 aa, Enterococcus faecium
  misc_feature (B) LOCATION 1...387
  hypothetical: YES
GERKMRAVHFGAGNIGRGFIGEVLAANGFEITFVDVNHTIIDALNERKEYEIELADESKEKITVKNVKGINNQTNPEKVIQEIAEADLVTTAIGPNILPFIAELIAKGIQEREKEGSTTSLDIIACENMIGGSAFLEKEVYKYLPETSFTDKYIGFPNAAVDRIVPLQHHEDPLFVQVEPFKEWVIDDSQRKNKKIQLKGVLYVDDLEPYIERKLFSVNTGHATVAYTGALLGYQTIDEAMQDALVVAQLKSVLQETGSLLIAKWGFDAEQHHAYIEKIIHRFQNKNISDAITRVARTPLRKLGYQERFTRPVRELQEHNLTCPHLTATMGIIFNYYDPEDEQSRQLHEMKIHENLEQLIQEVTGINDPKTIGNIKQNVNRYAKQVA

SEQ ID NO: 5176 - protein, 119 aa, Enterococcus faecium
  misc_feature (B) LOCATION 1...119
  hypothetical: YES
RERNFIVSEERIYIPKKGDIVWIDFDPSVGKEIQKRRPGLVVSRYEFNRKTMFSVICPITSTIKNLPTRYSLPEELDIKGQVIITQLKSLDFKERKLKKIENLPLQDMAKIDQIIQYMF

SEQ ID NO: 5177 - protein, 219 aa, Enterococcus faecium
  misc_feature (B) LOCATION 1...219
  hypothetical: YES
IRRKNMENKTLKIVLTAAISVSLIGNIALFWQLKEEQATNTYKIEEVAKNASEKLKKNSSSAQAKIDKLNQTINEKNQEIDQLKQQDGTKAKEEVNEAQSKTAEEFGKLAIDKSLSRNELTEKLKDVATQEVIDKLSPADDDHQHDDYGSYSFTLGDVQTYAQTSSVKEEQNFVVFVDYTIGNPQFKDVKPQKIKGGLTVTEKQVDGQWKVTDFSYFTR

SEQ ID NO: 5178 - protein, 74 aa, Enterococcus faecium
  misc_feature (B) LOCATION 1...74
  hypothetical: YES
LIGNMKKGESMKTTLVLFYKKHPYFTLLINILLASVIGISVEYLINKDFIGSCFYTALFLGLLEAFSIYKKSKK

SEQ ID NO: 5179 - protein, 354 aa, Enterococcus faecium
  misc_feature (B) LOCATION 1...354
  hypothetical: YES
KTGKHKEAIESHKSTRKHTKQRHSNIDDWDKYFLVFVPNPILIFKGEQIMENWSKKLAKSIMERTPRLYEEKWYKGKWSYDYGVVLKGFQLLWERTQEKIYFDFIKDNIDYFVQEDGTIRGYSVEEYNIDHVNTGKLFFLLYKETGEEKYKKAAELLSQQLANHPRTSEGAFWHKEIYPYQIWLDGLYMGSPFYAEFIQNFSEEKDYQDVLRQFEISYKHLFDPKTNLLIHAWDEKKVQPWADPKTGLSHHFWSRSIGWYLMAAADTYELLHEETDCSLLKEILEKTLAALLPYQEENSGTWYQVTTETKRKGNYLEASGSSMFVYAMAKGIRLGLLNKEEWLPQSEEITSRIT

SEQ ID NO: 5180 - protein, 278 aa, Enterococcus faecium
  misc_feature (B) LOCATION 1...278
  hypothetical: YES
QRGNTRSLKQLVFLLISENRSISWKRILAQAYDRLTSGFGFETRYYENKASHLTFEANIQDSRVTTVKVLQTGPADIAPFYLGMTMQDLTKITTIYTNFTFEYHDTEVGIELMEEDMNYRPLIAFDNDTFAILFFDQTTNGLFSVVYLDKDSLLKLLPYQVFGEGLPHYQADKSADWESINRVKERKSTTLLNMLRREDELPIYNQTLAFQNHSQLLLHDFLTRPEEILSEERMADWQKSLGSAQTTVKFSLTNDELEKLISKQKLENPEWAIYSSGD

SEQ ID NO: 5181 - protein, 66 aa, Enterococcus faecium
  misc_feature (B) LOCATION 1...66
  hypothetical: YES
FNGNVCMILCSYPFVPPDVRPVTKFFCKKKNNRQIGSAIKIAPAAKRETLWFVTSEINVCKPTATV

SEQ ID NO: 5182 - protein, 287 aa, Enterococcus faecium
  misc_feature (B) LOCATION 1...287
  hypothetical: YES
KEGKTMVVAWHRPTKAVIHKKAITENVANEVARLPQGKELFAVVKANGYGHGAIETAEAAVAGGASGFCVSNLDEGVELREAGFTQPILILNMVPYDALTVAVAHDLSVTAGTREWLQAAAAVLEKSKLETPLSIHLKADTGMGRIGFCTPEEVKEAAAFIKESRVLEWEGLFTHFSTADQADDTYWNLQKERFIEVLKKLPELPRYVHVSNSATALWHDETIGNMIRYGVAMYGLNPSGHALPEVYPLQPALELVSELIQVKKLPAGEGIGYGETYITPEAEWIGT

SEQ ID NO: 5183 - protein, 175 aa, Enterococcus faecium
  misc_feature (B) LOCATION 1...175
  hypothetical: YES
KRGNWMYIRQTRKEEVEEVVEIINAAADFIASQGSPQWQNGQKPTKETILNDIERKESYVLIVEDQIAGTAALVSGVDPVYTKIDGSWKESTGPYLSIHRVALAESTRGKKLAKPFLEHLLTIAASKNIQDIRIDTYPANEPMEKTIYSAGFTYQGMIEFPFEHGERKAYQIIIN

SEQ ID NO: 5184 - protein, 394 aa, Enterococcus faecium
  misc_feature (B) LOCATION 1...394
  hypothetical: YES
IGGKKMFMFSKEELRKLGAENTTREIRQQPELWHETFDRYQETVADLDRLFTDAKQHAGERPIRVIFTGAGTSQYVGDTLIPFLTSQGNTNQFIFQSIGSTDIVATPKEYLIPDETTILVSFARSGNSPESLAAVKMANQLVNKIYHIVITCAPDGLLATQMPTKKENLVLLMPNKANDAGFAMTSSFSCMTLTALLIFDQASNQQKERYVHQLSRLGEEVIQRESEIQGYLASDFHRIIYLGSGSLGGLTREAQLKVLELTAGKIATVFDTSLGFRHGPKSFVNEQTLVFLFVSNDSYTQKYDVDMLEEIKNDGIAQRVVGIGQKGSLFSGDSFELVADSLLPDGYLALADIMVAQTIALLCSVKVGNTPDTPSPSGTVNRVVKGVTIYPYEK

SEQ ID NO: 5185 - protein, 79 aa, Enterococcus faecium
  misc_feature (B) LOCATION 1...79
  hypothetical: YES
KGGKTVDLMGRLEGYLKYRRAKHSEKLRAKNLKSGKKKTKGWGKMVDTGFGGLNNLNPVDTKEFIKEEQKRNGKIKSHY

SEQ ID NO: 5186 - protein, 230 aa, Enterococcus faecium
  misc_feature (B) LOCATION 1...230
  hypothetical: YES
KGGKGMRTLIIISHPTIEESLNQQFFKEASAGLPATWHHLESSYPDGQIDIETELQLLTQHDRIIFQFPFYWYSSPAHLKIWQDNVLERAAHVLKGKELGIVLTTGVAEKEYQAGGKEEYTISEFLRPYQRIANKFHMTYLPPFVLAQFMYLSQEKRWEKLIAYQQYLSLEGKPSLTQRIDWFIQRVQENQKMQEEESEKQAYIVEALTEAKEQIEDLTFTLQEMKGTSL

SEQ ID NO: 5187 - protein, 182 aa, Enterococcus faecium
  misc_feature (B) LOCATION 1...182
  hypothetical: YES
PMGKLKWDHIQQLLSLPSVKKQWIAIYGQLPQEKEVEELYQQFEHYLFKDLVKHSTLKPDTLETIERLRNAGINIGSTNGFNAPMMTIVAETAKKERYSPDFMATFEDVEGYGRPFPYMIHKNMQYFKNKSVDEVIKVGDTVSDIQEGKNAGVLTVGVIEGSSLMGISYDEYQKLEMGKKIV

SEQ ID NO: 5188 - protein, 117 aa, Enterococcus faecium
  misc_feature (B) LOCATION 1...117
  hypothetical: YES
NQGKKIVATKNVTINEDFFQGHFPDNPVMPGALILETLAQAGSILILKSEEFLGKRAYIGGINKAKFRQKVVPGDVLKCHFEITKMKGSVGTALSAAYVDDKKVCECEFTFIVNQNA

SEQ ID NO: 5189 - protein, 130 aa, Enterococcus faecium
  misc_feature (B) LOCATION 1...130
  hypothetical: YES
EQCLNHLAITNGGSKKMAEKQTAGRDQLGEFAPKFAELNDDVLFGEVWSREELSPHQRSIITLSALISEGNFEQLPAHLKIGKQNGITSEEIAEIITHLAFYVGWPKAWSAFSLAKEIYLEENSEDKKEA

SEQ ID NO: 5190 - protein, 95 aa, Enterococcus faecium
  misc_feature (B) LOCATION 1...95
  hypothetical: YES
NKCFTGCSFNLSIQISNPKIYIPDSTRGKRPIMRDDPEEKSIIRSNKINPSSISKSKVSGSQRLKSVRNNTPGRKRNLNTGAISNVKRLPKIGHS

SEQ ID NO: 5191 - protein, 365 aa, Enterococcus faecium
  misc_feature (B) LOCATION 1...365
  hypothetical: YES
TPTLFFFLFPSFVFALCINRCFFENYFVLSFFLIEWMGKELDAMTTKDKVLQLLKKTPDFLSGEKLAQQLEVSRTSIWKAIKELEKAGYRFEHGPTGYRYLPSDVLDAKEIQQELRSFIPDLKVQTMLTSESTMKDAKLAAAQGDSVSKLFVADTQEQARGRFGRPFFAEPGRGIYMSLLLHPDKRFDELPQYTIIAASACVKAIESVTGRSASIKWVNDIYMDGKKVCGILSEAVSDMESGRISHIIIGIGLNFSVPQNHFPADLQEKAISVFPDGQASVTMNQLISRIWQELFTYLSHPEKALDFYKEKSFVLGKTVSFNQKGTTYVGLAKEIGDHGELIVQTNEQKMSLSSGEISLTSIRTQ

SEQ ID NO: 5192 - protein, 303 aa, Enterococcus faecium
  misc_feature (B) LOCATION 1...303
  hypothetical: YES
IFLKSLSVQELSKNFGHKQALSDVSFSLSPGKIVGLVGPNGAGKTTIMKAILGLIHYSDGTICIGENEISPSSHKGLEQVGALIEYPGIYPFLTGYDHLKLFSETNDVSAIDTIVNQLKMEKYIHKKAKSYSLGMKQKLGIALALLNHPSIVILDEPMNGLDPQATRDVRKIITDLATQGTSFLISSHLLSELEKMVDELILINQGKIIKQCTMAELNQTAQDFIVISTTNDLAARTILTEAGYTLEDPDKIKLLKENEELLGTVIQLLSAQNIHVTDVQHLTNDLESSLLEILDSVKGEEEK

SEQ ID NO: 5193 - protein, 126 aa, Enterococcus faecium
  misc_feature (B) LOCATION 1...126
  hypothetical: YES
NLLKKRMIRLTDNRPIGFIDSGVGGLTVIKEALKQLPNENILFVGDTARCPYGPRPAEQVFQYTWEMTDYLVEQGIKMLVIACNTATAVALEEIKAALSIPVIGVILPGTRAAVKKTQNKQVGIIR

SEQ ID NO: 5194 - protein, 282 aa, Enterococcus faecium
  misc_feature (B) LOCATION 1...282
  hypothetical: YES
FVLKIITINDVEYAVFAANEGTSKPQPHIIETKSGTIPEGKQLSLLKEYLKQNDISPIKGATTYWCIDKVLKLDSSKEKTISETIHKQKYLSLTEENIEKQHKFVGASSNYGKEGLIIHDVLNAFPLHNDLNTIAMKIAVIDVTNSTHLSQYKSRLSLYDLAKVILEIPNFDDRLAKGDPQLINIIARNIGAVNMFSFASKYCTYHNVEVCGRDDYSIFDGIVKNTLPHYIQGLTTNKIDTWRRSFDYEAFNECVGKLLDENNIHIPFRRRKLDHFLWYANR

SEQ ID NO: 5195 - protein, 178 aa, Enterococcus faecium
  misc_feature (B) LOCATION 1...178
  hypothetical: YES
ISLNELWMDIEGYEGVYQVSSLGRVKSNRPNYVINKGYVNKEGFIMKPSDNGKGYQIIFLSGKGFRDRRYVHRLVAFHFLKEAYFEGAEVNHKNGDKSNNTVENLEWLSSDDNKKHARKNGLTNLKGPSKLTDLQALAIKRLYTNKLMSSGEIMKLFNVSRHTVLNIASGKTFSFLED

SEQ ID NO: 5196 - protein, 206 aa, Enterococcus faecium
  misc_feature (B) LOCATION 1...206
  hypothetical: YES
EKLKNEKKAVMITKKAGEDMLNNEQFEEKTISRKEIYSGKIIDVAVDEVRLPDGGTSKRELVFHPGGVGIIAFDEQDRLLLVKQFRKPLEKVILEIPAGKIDPGEGQNPEMTAARELEEETGYRAKSLSHLTSMYLSPGFANEVLHIYHAQGVEKVENPLAQDEDEVLELYHLTLEEAQQAMKDQLICDAKTIYAIQYWELLTKGK

SEQ ID NO: 5197 - protein, 170 aa, Enterococcus faecium
  misc_feature (B) LOCATION 1...170
  hypothetical: YES
SMLKKETMKYYLPIVLFFLMLIDGHLTRMLGEWSKGTYMSNAHFLILALLCCSMAFEKRYLLITTIVLGAIYDAYYIGVIGIYAVALPLIVWLMYVMKDVIHVNIFTEFFSMIIFVTGYELFTMVVQLIFKLAVVNNTYFITRFLGPTLLLNMIIFVLFIFPFKKLFSDE

SEQ ID NO: 5198 - protein, 278 aa, Enterococcus faecium
  misc_feature (B) LOCATION 1...278
  hypothetical: YES
FKLKVQAMTKRKGLMDVSELNAYQVAYGKPLDYRDYLNYVGLPCLFMGGFSFALCYYWWIALICGVIGGVYGFKVIMPKSIKRSYELKSLQERNKFINNMTQILTDDSKTVTRALSIAKQRTKGELREDIQILESRLQGADKFQIAEAFREINNKYYSDVVFTQYFEQLETAIYEGRNNSDTMKQIKSYHNDVKRKTEGFMKIKDGYLQDMKQMMFIVAVFIGAITFAFGFSTFYEGFARSPIGWVFGSIYFLIMVSFMKSFFKHYFDDEIMSLGVSN

SEQ ID NO: 5199 - protein, 219 aa, Enterococcus faecium
  misc_feature (B) LOCATION 1...219
  hypothetical: YES
NELNLFQDNEYVITYNGALVQQTKSGKIIARHGLTHEDFLEIEVMARRVGSHLHSIDDKAIYTPNRDISAYTIHEASLVKMPLKYRTPAEMTPDMNIVKMMMIDEPEILDAAIARLPQTFRDKYTTVKSAPYYFEVLNKEASKGAAVAYLAQHLGIDQDEIMAIGDNENDLSMIEYAGLGVAMGNAVSLVKEAANVITSSNHEHGVPEQPESQLTTEPW

SEQ ID NO: 5200 - protein, 734 aa, Enterococcus faecium
  misc_feature (B) LOCATION 1...734
  hypothetical: YES
QELKIMKVNYEEKTVVTQQPETSQMKVIKRDGRHVDFDEQKINEALIKAEKKIHGSLSPLTYEKIQMIADLVVQEIKSRFAENVKIYEIQNIVEHILLEKNEYELAEEYINYRTKRDFARSKATDINFSIEKLINKDQTVVNENANKDSNVFNTQRDLTAGIVGKSIGLKMLPPHIANAHQKGDIHYHDLDYHPYTPMTNCCLIDFKGMLNNGFKIGNAEVESPKSIQTATAQISQIIANVASSQYGGCSADRTDELLAPFAELNYKKHLKDAEEWIDSPERQKEYAKAKTKKDIFDAMQSLEYEINTLFTSNGQTPFTSLGFGLGENWFEREIQKAILQIRINGLGSEKRTAIFPKLIFTLKKGVNLNPEDPNYDIKQLALECATKRMYPDILNYDKIVELTGSFKVPMGCRSFLQGWKDENGQEVNVGRMNLGVVTLNLPRIAIESKGDQNKFWQLLSDRLEIMKDALLYRVERCKEAIPANAPILYMYGAFGKRLSRTDSVNELFKNRRATVSLGYIGLYEVASAFFGGEWETNPEAKAFTLDIVKELKANADAWGDEYGYHFSVYSTPSESLTDRFCRLDTEKFGIIENITDKEYYTNSFHYDVRKNPTPFEKLEFEKDYPKYCSGGFIHYCEYPMLQQNPKALEAVWDFAYDKIGYLGTNTPIDHCYQCGFEGDFKPTERGFECPECGNHDPKTCDVVKRTCGYLGNPQARPMVHGRHKEISSRVKHMK

SEQ ID NO: 5201 - protein, 90 aa, Enterococcus faecium
  misc_feature (B) LOCATION 1...90
  hypothetical: YES
SRLNLMIKAWSDDAWDDYLYWHEQGNKSNIKKINKLIKDIDRSPFAGLGKPEPLKHDLSGKWSRRITDEHRLIYRVENETIFIYSAKDHY

SEQ ID NO: 5202 - protein, 125 aa, Enterococcus faecium
  misc_feature (B) LOCATION 1...125
  hypothetical: YES
MSLKRIALHRLQKNGGNLSRNKIAGTVFFFLNQRSALFYKKTKGDTHQTIFSTALVSNDHTPAHKVHSTADFSVDKKVVIESEKQKGGRVRYILDHKLTERFSYEESAGLDSRFLPNVLDADQLF

SEQ ID NO: 5203 - protein, 213 aa, Enterococcus faecium
  misc_feature (B) LOCATION 1...213
  hypothetical: YES
KMLKIKYNTIGTNWKVKKSMAQLFFKYGAMNSGKTIEILKVAHNYEEQNKPVVLMTSGIDTRDGLGVVSSRIGLKRNAMPIFEETDVFDVIQKMESKPYCVLIDEAQFLKKKHVIAFTRIVDELDIPVMAFGLKNDFRNELFEGSKYLLLYADKIEEMKTICWFCHKKAIMNLHYIDGNPVYEGDQVQIGGNEAYYPVCRKHYFHPSMITEGE

SEQ ID NO: 5204 - protein, 71 aa, Enterococcus faecium
  misc_feature (B) LOCATION 1...71
  hypothetical: YES
RRLKDTVIVDEHISSIENYPEVGSVSNRSGVYKISMVRMFYKELTKQRMYGSKFELCRNAKVREIVAGVAK

SEQ ID NO: 5205 - protein, 696 aa, Enterococcus faecium
  misc_feature (B) LOCATION 1...696
  hypothetical: YES
RRLNKMAKDLLLEIGLEEMPAHVVTPSMKQLEEKTAKFLDENQLTYDTIETFSTPRRLAIKVTNIPERQADSEEEVKGPAKKIALDADGNWTKAAEGFVRGQGLTTDAITFRELKGVEYVYVTKYTHGKEAKEVLTGLADVIKSLTFPVTMHWAEYDFEYIRPIHWIVALLDDEVIPFEILDVKTGRASRGHRFLGEDVTFAHAKEYEEKLNEQFVIASPQKRQEMIVTQANELAEKNHWVIDLDEDLLEEVNNLVEYPTVFSGDFEEKYLSVPEEVLVTSMKEHQRYFEVRNDQGMLLPHFISARNGDRVKLENVVRGNQKVLTARLEDAEFFYNEDKKASIDQYVEKLKTVTFHEKIGSIYEKMQRVQVIARIIGEQVGLSEEELMDLQRAAEIYKFDLVTNMVGEFPELQGIMGEKYALLKGEKPAVATAIREHYMPISSEGELPQSTVGSVLAIADKLDSIFSFFAVGMIPSGSNDPYALRRQAYGVVRIIESKKWAFPLSVLQETISDVISKDTDRFGIGLSEGQQQVIDFIKGRLRQLLTTKNIRHDVIEAVLNAEQKDLTKVFAAAQLFKQHLADEDFKPSMEALTRVVNLAKKAELEKQSEVDPELFENEAEKELHKAVEAMKKSFADQTINENYDQLVSLRPLIENYFDQTMVMAEEPAVRKNRLTQLSQIAAMALSLASLDQIITK

SEQ ID NO: 5206 - protein, 111 aa, Enterococcus faecium
  misc_feature (B) LOCATION 1...111
  hypothetical: YES
TFMKIILAIIQDKDSNRLSNELIDANIRATKLSSTGGFLKAGNSTFIVGIEDDRVEEALEIIKKTCESRKQFVSTPVTLDISMDGGVPYPVEVEVGGATVFVLPVEGFHQF

SEQ ID NO: 5207 - protein, 228 aa, Enterococcus faecium
  misc_feature (B) LOCATION 1...228
  hypothetical: YES
FIMKKNMIGTLLLSTLLLGGLATPAFAEGQATSKGDITFTEPTNTVEPLNPTDPSKPVEPADPENPATGQTGSLTLDVVPELPFGTHEIESGTKTYQVDASKNDTPYLQVSDRRGVGADGQAQGWNVTVSVSDFVNGSQVLQGAELDFGTSTVKSTSDNESTGPTSQTVTGLSKASAATPIFTAAKDQGLGTWLSVYDPANITLKVPKAAAGTFTADLTWNLVAGPVA

SEQ ID NO: 5208 - protein, 716 aa, Enterococcus faecium
  misc_feature (B) LOCATION 1...716
  hypothetical: YES
FIMKNKKTIRLLAATWLIAPSVLSTNTVFAVDNQIADQTVTTDTTTSSSATSETTDSFTEDPTGTTNSTTGSTEPTEIDPADPSENEKPAETYSLTIAPSLIGKIQLTASTADSPEQQPLDITESGTVEGLLAETKVTYTITPAEGEQIASVAVNGAKEVNYDAKTFTVGTNNLSITAEFKAGPDTSTEKPTDPSEEVPSTPDPETPNKPDVGNNNNNNGSNNSNNNNNNSNSGNSSNQTNPSGSNNNGNTQREPNHPNNGSSNGGTNNASSRPNTANQSGIENPSSASSDFVVKSPIDAVLPTNTTNVQQAIVREAFKHLGKPYVWGAKGPNTFDCSGLTYYVYMKATGHYIGGWTGEQQYAGTQIPVSQAQPGDLVFWGPSSGVTHHVGIYIGNGQFIHAPQPGDKVRVTSISDFTPDFAVRVNLAGLPAASGSLTGGSSILDGLDGSFHFSQNQTTDQFLKKIADDAQEIGQKEGIYASVMMAQAILESGSGNSLLSSEPNHNLFGIKGSYKGSSVTFNTLEQDSSGQSYQIRAQFRKYPSYKESLEDYADLIKNGLTGNPDFYKPTWKSETKDYKEATKYLEGRYATDRQYSQKLNAIIEAYDLTKYDEPKKEAATTEEANAEILNMSKRFDVPIKWTTDGVPITGLEFSTIKRVNNASSIFRVASIWDLWNNFTARQIPETTTRTVKAATVPVLTLLSLDKSFWLDLPLKK

SEQ ID NO: 5209 - protein, 120 aa, Enterococcus faecium
  misc_feature (B) LOCATION 1...120
  hypothetical: YES
CVMNDTIAILSDSLIDLDKTSTDYMIIEEQLKNKNPEFDIQEKSLRIELPKFKQKKLITILFEIIERYGLTYYQIWTDKKDGQYTKGVSIEAVREDDQVSIKAVQPLMGYNEELLNCLNV

SEQ ID NO: 5210 - protein, 144 aa, Enterococcus faecium
  misc_feature (B) LOCATION 1...144
  hypothetical: YES
FSMKMDVISLVGKLKQKYNSANPFTICEKMDIQIRYVPFLNNPKGQFQELLGRSVILLNHELKYSEERFYICAHELGHAIFHQGLSSYYVSTRSSRSKSESEANCFAANLIISLYKEDNDQYPRKIEDLTNLYGLPKNSYRFLI

SEQ ID NO: 5211 - protein, 169 aa, Enterococcus faecium
  misc_feature (B) LOCATION 1...169
  hypothetical: YES
TPMNYDAKQPPANLADSIQQKETVQALYDLLDKNMADFDASLAGMDKAETADLKEVSDTREIYDFIRYHYGEFGQREAELLLRMENPLNFIVENWPCHNLETLAMNYLADKTIKEPNKKEMPQSGHDTKDAEKPSILKQIKTNQGQIKPNRQEPPLFFSGRPTGGGAPL

SEQ ID NO: 5212 - protein, 185 aa, Enterococcus faecium
  misc_feature (B) LOCATION 1...185
  hypothetical: YES
RYMKKMSIEKQECLKRLTDEAGIISALAIDQRGALKKMINQYKEATSEDIIQFKQMVSQYLTPYASAILLDPEYGLPAAALREKECGLLLAYEKTGYDAKMPGRLPDLLNSWSVKRLKEVGADACKFLLYYDVDEPVEINVQKQIVIERIGSECEAEGIPFFLEILSYDATIGDPSWSSTSNDQL

SEQ ID NO: 5213 - protein, 186 aa, Enterococcus faecium
  misc_feature (B) LOCATION 1...186
  hypothetical: YES
NNMKSFWPTLRGRYSQKGVQGAAERHYATMSMEDLCSLPISRFAAPDCALFLWSTFPQLPEALHLIRAWGFTYKTVAFVWLKQNRKSLTWFYGLGFWTRGNAEVCLLATKGHPKRRRADIHQFIISPIEAHSKKPDEAREKIVALMGDLPRVELFARQRVPGWDAWGNEVEPSPGLAEGLAPENPT

SEQ ID NO: 5214 - protein, 205 aa, Enterococcus faecium
  misc_feature (B) LOCATION 1...205
  hypothetical: YES
ADMNSNRGNKMEYNGSMRIVQIIFWITSGIVIIGGVFLMLPSLIFPFFALISPKIPEPEITYGEFPFRIEYELDGQINIIEDTVIAEFNGCEFSAGSMKRERRWRSRLASGREDLPFGDDLGIYFSRGSAQYYMGENVQSMSLKPHIALRNLEEGFKREVDFILGESGYIRTVLNFGEAQEVLTQYGITLINWEISEPIVNNFGD

SEQ ID NO: 5215 - protein, 212 aa, Enterococcus faecium
  misc_feature (B) LOCATION 1...212
  hypothetical: YES
THMKKIEPIPPSLPLLTKGEFYLEDEEIFSGLLINGGDQSYLDAKNMVLRESHIQKLTMQKTVLRHFECSNVIFEKCDFSNLEWIGGSFHQVVFHQCKLTGTNFAESYLRDCTFTDCIASMASFSSTNLKAVSFDHCQLEDSEFYEVTWKNLFLSDNQLTGSNWFRTSLKGLDFTTNFFTAIALSQDSLAGLIVNQEQALVIAQALGLQIKD

SEQ ID NO: 5216 - protein, 243 aa, Enterococcus faecium
  misc_feature (B) LOCATION 1...243
  hypothetical: YES
QNMKQLTVDEAAKEILAYQQITFLTGAGVSTPSGVPDYRSLSGIYHGMEQPEYLLSHQAMVNEPDKFYQFVKKIYHPEAKPNIIHLEIAHLAKEKNVWVVSQNIDGLHAKAKSPQLVNFHGSLYQCHCRKCQQTVDWKEYLHSDKHQACGGQIRPDIVLYGEGFQDGVMEQAAYAVSQAELIVIVGTSFQVHPFCDLVQFRQPSAKILVINQTPVYLAEPYTFIQEDGAVVFKKIQELGADYD

SEQ ID NO: 5217 - protein, 577 aa, Enterococcus faecium
  misc_feature (B) LOCATION 1...577
  hypothetical: YES
VNMNNLLNYQLPVANWVENITEWFTTTFSGLFSFLQTIGQAVMSGITNLLLVIPAPLFILLLTVAAFFISKKRPGLTLFTLIGLWFIYNQGLWNDLMNTVTLVLLSSVISIIIGVPLGILMAKSSKAQSIIKPILDFMQTMPGFVYLIPAVAFFGIGMVPGVFASVIFALPPTVRFTNLGIRQVPKELVEASDSFGSTSRQKLFKLELPLAKSTIMAGINQTTMLSLSMVVIASMIGAPGLGRGVLSALQRAQVGNGFVNGVALVILAIIIDRFTQHLNQPNNKKAAGATTQKSKKRQGLIIGAVVVVILGAIGIGSFSSAKETKRINLSYVEWDTEVASTNVVGEVLKQMGYDVTMTPLDNSIMWKSVSNGESDAMVSAWLPKTHGSQYAQYKDQVEDLGANLTGAKVGLAVPAYMDVNSIDELTDQAGKKIIGIEPGAGVVTAAENTIQKYDNLKDWKVETSSSGAMTVALGQAIKKHEPIVVTGWTPHWMFAKYDLKYLEDPENGMGSEEQIHTMVRKGLKEDQPEAYKVLDNFHWSEKDMEKVMLEINNGKDPQQAAKDWIKENQELVESWKK

SEQ ID NO: 5218 - protein, 322 aa, Enterococcus faecium
  misc_feature (B) LOCATION 1...322
  hypothetical: YES
FVMNKKIIGIDLGGTTAKFAILTPEGEIQQKWSIDTNILDDGKHIVPEIIESINHRLNLYNMKAEDFIGIGMGTPGSVDSDAGTVIGAYNLNWTEVQFVKKLIEAGTGIKFAIDNDANVAALGERWKGAGENDPDVVFVTLGTGVGGGIVAGGNLIHGVSGAGGEIGHITVDPEGFECTCGKRGCLETVSSATGVVRLGRYLAEEYAGDSKLKAMLDNGEEVTSKDIFEMAQEDDPFALMVVDRVCFYLGLACANLGNTLNPSSIVLGGGVSAAGEFLRSRVEKYFKEFTFPQVRESTKIKLAELGNEAGVIGAASLALKFA

SEQ ID NO: 5219 - protein, 487 aa, Enterococcus faecium
  misc_feature (B) LOCATION 1...487
  hypothetical: YES
LTMKQQIYNTALYFRLSRDDELQGESSSITTQRSMLRLYAKEHHLNVIDEYIDDGWSGTNFDRPSFQRMIEDIEAGKINCVVTKDLSRLGRNYIMTGQYTELYFPSHNVRYIAIDDGVDSEKGESEIAPFKNIINEWVARDTSRKVKSAFKTKFAEGAYYGAYAPLGYKKHPDIKGKLLVDEETKWIVEKIFSLAYQGYGSAKITKILREEKVPTASWLNFTRYGTFAHIFEGKPESKRYEWTIAHVKAILKSEVYIGNSVHNRQSTVSFKSKKKVRKPESEWFRVENTHEPIIDKEVFYRVQEQIKSRRRQTKEKATPIFAGLVKCADCGWSMRFATNKANKTPYSYYSCSFYGQFGKGYCSMHYIRYDVLYQAVLERLQYWAKAVQQDEEKVLNKIQKVGNAERIREKKKKASALKKAENRQNEIDRLFAKMYEDRACEKITERNFIMLSGKYXKEQIELEQQITNLREELSKMEQDMIGAVKVD

SEQ ID NO: 5220 - protein, 270 aa, Enterococcus faecium
  misc_feature (B) LOCATION 1...270
  hypothetical: YES
CQMNDVLTLENLHHTFEKGTINENHVLKGINLSLDPGDFVTIIGGNGAGKSTLLNSIAGTFSVDQGQILLNGKNITKKSVVERSKSISRVFQDPKLGTAVRLTVEENLALAMKRGKKRGFFRGVKPQDRTFFKDQLVRLNLGLENRLSSEIGLLSGGQRQAITLLMATLQRPELILLDEHTAALDPATSKTVMELTEKLITEQNLTAFMVTHDMEDAIRYGSRLIMLHQGRIVVDIQQEEKQQLTVPQLLALFKQNSGTALKDDQVLLSS

SEQ ID NO: 5221 - protein, 211 aa, Enterococcus faecium
  misc_feature (B) LOCATION 1...211
  hypothetical: YES
PKMNVEQSIAKDLLEIEAVFLNPSNPFTWASGIKSPIYCDNRITMSYPKVRKEIAKGLASKIKEAYPEVQVIAGTATAGIPHAAWVAEILDLPMVYIRSKAKDHGKGNQIEGRIFEGQKMVVIEDLISTGGSVLEAAEAAKREGADILGVAAIFTYELPKGKANFEKAEIPLMTLTNYSVLIEAALEDRYIDEQELTLLKEWKKDPENWQI

SEQ ID NO: 5222 - protein, 336 aa, Enterococcus faecium
  misc_feature (B) LOCATION 1...336
  hypothetical: YES
EKMNLKKVGVISLTFLTISFMGILMCVGLLFGEDSEGNGSSGTSPGGTSVSEEVLKHRAMVEKYAKESDITEYIPILLAIIQVESGGTMEDVMQSSESAGLPPNSLSTEASIKQGCLYFASLVKRSKELGCDQDSIIQAYNYGGGYLDHVGKNGKKHSFALAESFSKEKSGGQKVDYPNPIAIKENGGWRYNYGNMFYCLLVKQYLTTTQFDDKIVQEIFDEAFKYEGTAYVFGGSSPETGFDCSGLTQWCYAKVDLKLPRVAQDQYDAMTHIDLKDAKPGDLVFFHSTYDAGTYVTHVGIYAGENRMFHAGDPVGWTNLTENYWRQHLIGAGRYK

SEQ ID NO: 5223 - protein, 255 aa, Enterococcus faecium
  misc_feature (B) LOCATION 1...255
  hypothetical: YES
EKMKKMYTIGQVSELFDLPKSTIRYWDEQGLIRSSRQEENDYRLFDIDDIFMLYDIVFYRKLDIPIKQMKNLYGKTLTELYETLDETERRIHKELVVMKQKQKEIRERKKQLKLMIDTNEEEFPVEEIPFDCMISTEFEDIVEIKKFLPNYSSFGMMSMPASSSQTMYGFFIDPSEVHLFTQDVIWEKKDTAVYRRFLLKSEMNHAERNNILEIRERMYEKGWKTGEVIGQYLLTNTDENNIRTEYYHAWIEMKK

SEQ ID NO: 5224 - protein, 296 aa, Enterococcus faecium
  misc_feature (B) LOCATION 1...296
  hypothetical: YES
MKMNEKIRNMTIGLFCAATVSILLTGCGSGEATKQSAAADDSLDTIIEKAKEEGEIASLGMPDTWANWVGTWNDLEKEYGLSHVDTDMSSAEELAKFESEGKNGTADIGDVGISFGPLAESKELTLPYKTNYWEEIPDWAKDDDGDWLLSYTGTISFITDKENVKQAPTSWKELQEGDYQVSVGDVTIANQAQFAVLAAAIANGGDEKDIQPGLNYYKKMAEKGRLSTVDASVANLEKGEIDVAVVWDFNGLNYRDQIDSERFEVTVPTDGSIISGYTTLINKNAPHPNAAKLARA

SEQ ID NO: 5225 - protein, 301 aa, Enterococcus faecium
  misc_feature (B) LOCATION 1...301
  hypothetical: YES
MKMKETLQLGKTKFPMRGNLPNREGEWQKEWEENRIYQKRQELNEGKPSFVLHDGPPYANGNIHLGHSLNKISKDIIIRSKSMSGYRAPYVPGWDTHGLPIEQVLANKGVKRKEMSMAEYLEKCREYALSQVDKQRADFKRLGVAGDWEHPYVTLDPSYEAAQVRVFGKMAEKSYIYKGLKPIYWSPSSESSLAEAEIEYKDVKSPSIFVAFNVKDGKDILDEDTAFVIWTTTPWTLPANQGIAVNPKFTYVLVEADGRKFVVXKELLETVQSEIGWENVTVLKKFAGQGDGIYDCKSSIL

SEQ ID NO: 5226 - protein, 266 aa, Enterococcus faecium
  misc_feature (B) LOCATION 1...266
  hypothetical: YES
IEMKNERGGEELEKMIEVKHLSKSYGSKLSPVKALDNISFTVEEGEFVGIMGPSGAGKTTLMNILSTINLPTMGSVSIQGKEITKMKNSELSDFRRKKLGFIFQEFNLIDTLNAKDNILLPLAVERMTKEEMEKRVRHVAQLLNIEELLKRYPDELSVGQRQRIAAARALVVQPQVIFADEPTGSLDSKSATELLNYLKTMNQKEKATILLVTHDPYTASYCDRILFIKDGVIFSEVVRRGTRREFFEKVIDMQATIGGGGKMNAV

SEQ ID NO: 5227 - protein, 259 aa, Enterococcus faecium
  misc_feature (B) LOCATION 1...259
  hypothetical: YES
EEMKAQLFQVYKKILVSFEVEGIGISSPGVVNNEKQVIEGISAIPYIHGFNIFRDLETLFQLPVTIENDANCAGMAEFYEGAARDYQDVAFVVAGTGIGGALFTKGQINKGAHLYGGEFGLMFLNGDKTFSKLGTAVQMAWRYCERKGLDKNSYTGKDVFELAETGDAIAKEEVESFYTYLTKGLFSIQFSFDPEVIVLGGGVSAKEGLIDEIKSRMKKLTEQFDLHDFEPQILLCEYRNDANLVGAAANYLAVRQGEN

SEQ ID NO: 5228 - protein, 455 aa, Enterococcus faecium
  misc_feature (B) LOCATION 1...455
  hypothetical: YES
REMKKISTYENKKVLVLGLAKSGVSAAKLLHELGALVTVNDGKPFDENPEAQELLSLGIKVITGSHPIELLDEEFSLMVKNPGIPYSHPLVAKAQEMGIPVITEVELAYEVAECPIIGITGTNGKTTTTTMTGLLLNAGADQGIARLAGNIGYPASGVAQEAKSEDKIVMELSSFQLMGITDFRPHIAVITNIYEAHIDYHGTRKEYVKAKWNLQKNMTEKDYLILNWNQSELQELAQRTKARVLPFSTKEVLEDGVYADDYSIYYKKEKIMEISELGVPGKHNVENALAAISVAKLYGISNEAIRETLHFFHGVPHRTQYVGEIQGRKFYNDSKATNILATKMALSGFETSKVVLLAGGLDRGNTFDELIPSLKGIKAMVVFGQTKEKLMDAGKKAGIETIVTADSVEQAVPLALENSTDGDVVLLSPANASWDQYPNFETRGNRFMEAVNRLK

SEQ ID NO: 5229 - protein, 1044 aa, Enterococcus faecium
  misc_feature (B) LOCATION 1...1044
  hypothetical: YES
SRMKPKKLQLKNFGPFINETVDFSRLTEAPLFLISGKTGAGKTTIFDGITFALFGETSGRLRSGKEMRSLFATPDEETSVTFSFEHQQMSYEIERKPEQVLAKRKGNGTKKQAAKVTLTIFDGKGKEIKQITKRTEADQLIRELMNLDAKQFSQIVLLPQGEFRNFLVSSSSDKETVLRHLFGTQFFQQFNERLKEKAKQQQQKLDHLEQELHLLQKRFVLVKEEEPAAGFEAVLAQWTNHQAILEKQITEEKEALTELQEKQKQLENSYYRFESLKKSYEEKTILINKQKELAAQKDEIEEKKRWIGYYEFTQRLVEPIQRLQEIKVEKIELSQKSSEQTKKLAMTTQNYEEWQKNEANRVRRQTKIKEAAQKLQNKQMMVPIVESLRSKKQDAEQLTISLDKEELNAEKLYQNLAIYQERTRILQENLLDQEKLQEDRLAFGQLKYLDEKQQEIEKQKAKDTGSLAQIREELKKATEEITKNSQLLKEQTEQAEQLKSQWAKQQIARLQLFLRPGEPCLVCGSTEHPIQQLKHEQPNKEDILKVEQQLAEAESAVERTQQIIAKSEAHENNLQQQLSDLEQKIMATNIQLAEQEEHLQQALKKAFPEITEQKTKTTLVVIEQSLDRRKSKMANARIELEEIRQQAEKLEQQLAVYKQQQTEKNNQLQQLQGEIKSLEQQLQDTDSNCLEEEIRRLEKQLEEDSNQLAVEQKAGVQLLQDLHTLRTQLDLQHEQIEKIDEKIEKEQERIAKKLESQSYFSTIEEICAFAQQQAQYKENQRTVTSYHEEQLVTADRLRQLENIQLTETFPDTEEISQQLEEIRRMIEIKQEKIYGLQEQKISNQKIYDECLSIYHTSQTKLDELTQLQQLSQTFNGENPKKTSLERYVLQVYLQEVLQVANDHLQRLTKNRYQFELADTIGSYRGKTGLEINIYDDQAGMSRSAHTLSGGESFIAALSLALALADVIQTQAGGVAIDALFIDEGFGSLDEEALEMAMEALETIESEGRMIGIISHVRELKERVLQQIRIDTEGSGQSKIRYQLG

SEQ ID NO: 5230 - protein, 177 aa, Enterococcus faecium
  misc_feature (B) LOCATION 1...177
  hypothetical: YES
KGMKIKERRPLKKKQTKEKTINRVLLGLIVFLLAVIVISSIFYLRSSRPAVQAKKEAVEIAKKYANLEEADHFYWFTRKKTYFSLTGTNDKGKEIAVIIPKSGEKVKVLDQTKGLTENEAKQTIATAHPEIQIEKAALGMYDDQPVWEVVGKETNGKLNYYLIGFESGDEVKTIKGI

SEQ ID NO: 5231 - protein, 157 aa, Enterococcus faecium
  misc_feature (B) LOCATION 1...157
  hypothetical: YES
QLMKYSLQFSDAIHVLAYIEMFQDTRSLSSEMIASSIETNAANVRKIMSQLKKSGLIFTKTGKPQPSLAKSPDQISLLDVYRSIEGNTQLIQVDPKTNPNCVVGANIQEALEESYARLQKKAEEEMAKITLDSLIHKIAVLEKEKRPENTGLVERFL

SEQ ID NO: 5232 - protein, 75 aa, Enterococcus faecium
  misc_feature (B) LOCATION 1...75
  hypothetical: YES
DMMKKKLTKSNKNVVLTGTLAGIGEYIGIDPTVIRVLYVFLSLVAFGSPIILYILLALIIPILRVLHEQTLTILS

SEQ ID NO: 5233 - protein, 390 aa, Enterococcus faecium
  misc_feature (B) LOCATION 1...390
  hypothetical: YES
IMMNLSNRFSPRLSRIEVSKIRQFDQQISSIPDVIKLTLGEPDFPTPEHVKQAGIAAIEEDFSHYTGMRGLEELREAACIFQQQRYGLTYDPQTEVLTTVGATEAIASALLSVLEEGDKVLIPAPAYSGYQPLVELAGAELIPIDTSDTGFVCQPEQFERAFEQYGSAVKAVILNYPNNPTGTTLSAKQLKAIAEVLKKYPVFVISDEVYAELTYSGTHMSIATYLPEQTIVISGLSKSHAMTGWRVGFIFAQKALIDELIKVHQYLVTAATTMSQKAAAEALINGVKDSENMKEQYQTRRDYLVQQLAPLGFEVTQPNGAFYLFCKLPAAIQTDSWQFCVKLAEQAKVACIPGIAFGPEGEGYIRISYASSMEKLHEACKRIKDFLTEQ

SEQ ID NO: 5234 - protein, 718 aa, Enterococcus faecium
  misc_feature (B) LOCATION 1...718
  hypothetical: YES
EMMKDFMKKILNTSWLEKIRKGAQEPKNKTFRRSHVPFRLNFLFFIIFTLFVALIARLGYLQIVNGEEMEARVKSTSTITVQESTPRGMIYDSTGKALVTNKANQAITYTRGTQVTAKDLLEIATKLNSLIDVPVDENLTDRDKKDFWLADPKHLKEATKRLSAKEKQLGNSEQYSAMVNKVTADEINLNEEQLKIATIFKRMNSAYELNTVYIKNSGVTDQELAVVAERASELPGVSTGTDWTREYNAASSLKSILGSVTTEKQGLPADEAEKYLAKGYSRNDRVGQSYLEKQYEDVLQGTKTQYEVSLDNEGNVSNQKEIFSGEKGSNLMLSMNAEFQSKVEEILKRNYQTLINNGKAQYSPGAYAVAMNPQTGEVLAMTGFSHEQGSKEITENALGTITSAFAPGSVVKAGTLTAGWASNAISGNQVLIDEPIRLQGASEKSSVFNRSGQVALDAVKALELSSNTYMIKVALKMLGLDYTPGMGLPSLDEEAKAYQQLRDSFKEFGLGTTTGIDLPNESPGISRSVDYMKKFNADNGKEWYTPGNFTDLAFGQFDTYTPIQLAQYASTVANGGKRVQPHLVKAIYGNDENGNLGEVKKEIGTTVENTVNISAENMAILREGFHQVVHGTDPYTAAKPLASAKMDLSAKTGTAETVAEGHPDITTVNSNIVAYGPTDNPEIAISVVLPNLLDEQDHMNLTIAKEIMDAYYDMFMAK

SEQ ID NO: 5235 - protein, 232 aa, Enterococcus faecium
  misc_feature (B) LOCATION 1...232
  hypothetical: YES
KVMKKMQTSFHEGRTIGLLLTFIGGAMDSYTYIQYGAFASAQTGNIILSIIQAFDGEWLSVGKKVLSTLFFFLGILLTKYLIDYFRKKEKHFWRLFVLYYEAVIFFFVSLTPVHEHPALVTILIAFTASIQWVAFDKINGRAYTNLFTTGNLKGVATNLYDYCISKEKADFDRFFHYLSVVLAFIAGAIVLVFCHHLFGAHSILIVSILFLIMALTQTFHLWQFYHTNRFTI

SEQ ID NO: 5236 - protein, 492 aa, Enterococcus faecium
  misc_feature (B) LOCATION 1...492
  hypothetical: YES
YKMNNTYPDDSLTLHTDLYQINMMQTYWELGRADLHAVFECYFREMPFNHGYAVFAGLERLVNYLENLTFNDSDIAYLRGLEVYPEGFLEYLQNFEFKATVRSAREGELVFANEPLIQVEGPLAHCQLVETALLNMVNFQTLIATKAARIKSVIGEDPLLEFGTRRAQELDAAVWGTRAAYIGGADATSNVRAGKIFGIPASGTHAHSLVQSYGNDYEAFMAYAKTHKDCVFLVDTYDTLKSGVPSAIRVAKELGDKINFQGVRIDSGDMAYISKRVREQLDAAGFTEAKIYASNDLDEATILNLKMQKAKIDVWGVGTKLITAYDQPALGAVFKLVSIEDDEGKMMDTIKLSSNAEKVTTPGKKQVWRITRNFDGKSEGDYVTLWDEDPREEEAIFMFHPVHTFINKTVRDFTARPVLQDIFIEGKRVYELPALNEIKEYTKENLDSLWEEYKRDLNPQKYPVDLSTECWNHKMAIMERMKKSVAELHTEA

SEQ ID NO: 5237 - protein, 275 aa, Enterococcus faecium
  misc_feature (B) LOCATION 1...275
  hypothetical: YES
KKMKNSEIKNSKITKKELNHVFWRSFQMEFSWNYERQMNMAYVYAMIPILKKLYQSKEEMAAALKRHLEFFNTTPHIVTLILGITAAMEEENKDDPEFDVTAIDSIKTSLMGPLAGLGDSFFWGTLRLIATGVGTSLAMQGNILGPILFILIFNIPHILFRYLATGWGYRLGTGFLKKIQANGMMESLTLGASIIGLMVVGAMTATMITINIPLKIGSGENAVTVQSIFDDIVPNILCLGAFGIVFYLLKKEVKPLTILIGLAFFGIFGSWIGIF

SEQ ID NO: 5238 - protein, 230 aa, Enterococcus faecium
  misc_feature (B) LOCATION 1...230
  hypothetical: YES
LLVKEGKNMDHKLSETEQYLWNFIGHHILEIPNYSIVKLSEQANVSTATIVRTMKKKGYEGFTSFKHHLKEGENKNINFSFLDKVDKGIRRAILKNEQEVVRTINMLEIGNIEDALQRIKFTDRVFIFARGFSEMIGQEMLVKLQLTGKNCQMHTDPEIIKSISRKLTKKDSVIFVSLNGETKELVTAAKNCYDAEIGSILVTANHSFLYTQRLLRDKSRRFQIRRFLFP

SEQ ID NO: 5239 - protein, 340 aa, Enterococcus faecium
  misc_feature (B) LOCATION 1...340
  hypothetical: YES
FKVKRVLFFLALVVIAYQMMGCTPNTKEAPDPLVVGFSQSGTESSWRKKHTESIITALEKEYYQVLYRNGYMNQERQIQDIRTFIAYKVDMIIFTPLQESGWDSVLKEAKRAGIPVILVDRHIQTNDPELFVTHIGPSFKAEGNRAGLFVSNHFTNSKKQEIRILELAGSENSTPTKLRSEGFLESINRKPTLKKDGTIDHKPPMTIVHRIVGDFIRMKGKDQMKRYLETNDLSEIDVLYSHSDEMTHGALAAIKETSIKPGEDLIIVTIDGQEDMIEKLRSGIVNCVVECKPDVGWYVANTVTRYFGNIQTGKTLPKDIFISETVFSQQNIANIPTRNY

SEQ ID NO: 5240 - protein, 225 aa, Enterococcus faecium
  misc_feature (B) LOCATION 1...225
  hypothetical: YES
REVKQLDKMNVFQQFFYYFQENGSYIFAQFIRHFLISIYGVLFAAVVGIPVGIMISRRRKLANWVIRLANIIQTIPSLAMISILIIGLGLGVNVVIVTVFLYSLLPIIKNTYTGMIQVDKNILDVGKGMGMTARQRLFMVELPLSVSVIMAGIRNALVVAIGITAIGAFVGAGGLGDIIIRGTNATEGTSIILAGALPTALMAIITDWLLGILERRLDPASRTSR

SEQ ID NO: 5241 - protein, 1242 aa, Enterococcus faecium
  misc_feature (B) LOCATION 1...1242
  hypothetical: YES
RRVNQIPLKPQNERFTDDQWQAIFDQGDNLLVSASAGSGKTTVLVRRVIEKLKMGFDIDELLIVTFTEAAAREMKERIQEALQESVNSESDPVRRQHFTKQLVLLPTANISTLHAFCLTVIRRYYYLIDIDPVFRMLTDETETILMKEDVWDELREALYAENDERFFQLTMNFSNDRSDDGLTNLVFSLYEFARANPDPQKWLEQLSDNYRLPEGLAKSRLYQKQIRPLVLADIYQCVQLYEQMTQLAQGEGLEKMHEQVAGEQQQIKNIYEAFSQDRLEEAYAGLEQLTFSTFKSSRKAELKEISNEVKGMRDKAKKLIQQISKSYFPVSPSQMEELTDKALPLVEEMTKVTQSFMDGFSMRKREKGVLDFNDLEHLALQILTEKTKDVWLPSEASKHYRKKFKEVMVDEYQDVNQLQEAILYWLREPDDTKGNMFMVGDVKQSIYSFRLADPSLFIGKYENFSKKEGGRRIVLAENFRSRKEVLSFTNLIFEQLMDPAVGQINYDEAAKLIQGFSDFPENEQFEPEIMIYEKEQEESEIEIPTDDILEDKTEGELFMTGLKIRQLIDSSFMIYDKKSKKSRPIEYKDIVLLTPTKKNNLTILEIFKTLDIPLEMNDAQNYFQATEIRTMISLLQLIDNPYQDIPLAAVLRSPIVGLIEPELASIRLANRAHTYYDAVLAYQASNEDELAAKLEHFGKQLEHWRELARRSSITDLLWDIYYETGYLEYVVGLPAGAQRQANLYALVDRAKAYEQSSFRGLYQFVRFIEKMQEKDKDLAEPVISIEDNAVRVMTIHASKGLEFPVVFLLDMTKEFNLQDLRNRYAFEEKLGAGIRYMDPETRVLYDTLPFQAIKLAKQNKLLSEEMRKLYVGLTRAEQKLFIVGSYKNKEQMIQTWSEAADHEELVFDPALRLKGRSSLMNWIGYGLIRHPEMQKYLEEEISTSLLQHSNAQFSISWMNQQSIIEQRQLLAEKELVNLDQQMKEDETLLADSLQKRLAYEYPYQASSQTTSYQSVSEIKRLFEDPDDTQESRLTLESSQNKAASRQFRYTQEQLAEPKFLQKDRQVSAAAVGTATHALLQLLPLEMPTTESIHQKLQELVRKRLVDEKVAKKVDVSSIIWFFQTELGQQLIANKENVKREQPFSMLLPADEVFQDYPNQEDELLIHGIVDGYLEEKDHLNIYDFKTDFILHPDDPAEIDAIVQKYQGQLRLYQQAMSEALNKPVENVFLILLRVKQIININK

SEQ ID NO: 5242 - protein, 251 aa, Enterococcus faecium
  misc_feature (B) LOCATION 1...251
  hypothetical: YES
KGVNSLRTKQVLKGALVILFAVSTSVPQWTVYGESISSESESREVETTETTDAGNETKSSTSQTETNTETTVETSVTSTDQETTDTTDNQQTEEATATKMSNDESSSAKVSDKENGTENDDIGKGENFNGKEYLNYFGKQMTEILNGPTEDIKSKLIELLVTELAVNDYGVDKEIIKHLIATYLLYDIAFAKNSVLMSMLGGTDDGTTPTENTGFYPNTKQLHQTLLNKQDGQNDGMYMHIKSIRVQIKQS

SEQ ID NO: 5243 - protein, 208 aa, Enterococcus faecium
  misc_feature (B) LOCATION 1...208
  hypothetical: YES
LVVKTRDSLSKKCEPPSIKILFSLPSVVVGLFGFSVFVIQFQYGFSIISGALALTVFNLPLLTRTVEESLQAVHYTQREAGLALGLSRWETVIKVVVPEATPGILTGVILSSGRIFGEASALIYTAGQSAPALDFTNWNPLSVSSPISIFRQAETLAVHIWKINTEGTMPDGVSVSAGASAVLIIAVLLFNFGARAIGKRLYRKMTSA

SEQ ID NO: 5244 - protein, 533 aa, Enterococcus faecium
  misc_feature (B) LOCATION 1...533
  hypothetical: YES
PVVKTYDLSRFQKDLLAGITVAAVALPLALAFGVSSGADAAAGLITAIIAGIVIGGLSGGFYQISGPTGAMAAILMSIAATKGMQGVLLATFLAGLFLLAAGLFRLGTLTSFIPAPVITGFTSGIAIIIALGQIDNLFGVHSEGTNVIEKLSSYQTIGFPINTASLIMGGLVILGMFIYPKKWAKRMPSSLLSIILATAVMLLFHLPVATVGKIPQTLISSNRLNMGDFSFSALQQVAVPAISIALLGMIESLLCGASAGRMANKPLDSNQELMAQGIGNLLLPFFGEIPATAGIARTSVAIKSGAQTRLAGMIHAVVLLLSMLVFAPVMSQIPMPALAGVLIVTAWRMNEWETIKELFTNKYWSAVLLFILTMICTVIFDLSIAIVIGVIGGCVFFVVKSAAITISLETIDWQRMGLPETEKLNNWTVVYISGPLFFMSSEKLKNKLEELNHHDGVIFSMRGVPSIDLTARAVFDEFQEKAEQRGQTIIYTSLQPEVEKQLSHLWEHTFTHQHQTVAHALTALHAKYTAISH

SEQ ID NO: 5245 - protein, 96 aa, Enterococcus faecium
  misc_feature (B) LOCATION 1...96
  hypothetical: YES
SQVKKMKLEDKKVILKKIKRLPDQIDGYTICSFKKDRSIKAYTQNTEKGIIYFLHEEGYDTQTFMFTEKKEFHKQMKKLIEKEFPRSHKLYVNQQF

SEQ ID NO: 5246 - protein, 426 aa, Enterococcus faecium
  misc_feature (B) LOCATION 1...426
  hypothetical: YES
KQVKSMRKFWIITKDVYLKNVKSISFLIMILVPFIMLGIIYVAGNFAQQNSDVNKIGVLADNEQISQQMSQVKTDDFEFKAVDSEEKAQTRAFRKEKIDAYLVVSTENDKINGMLYSENSLGQSTQLLIQQQLTGLQSMLRASQLGISPEEVASLSQQASLTRQKVNFDSKGKMTVGEDNSTVQYVVSYVATIVLFIIILTYAQIIAQEIASEKGTRIMEVILSSTTAQKHFYGKLTGVLLVALTQMALYGIIFGIGYSQFKDMEMVKNILDGISLDNLIGPFLWYSLLFMIFGILIFSVLAALCGSLVNKAEDTAKAILPVTYLSLGGYMLGLILGASDPNNIVIRITSYIPFLSSYIMPVRLANETVGMGGALISLLVLVAVTFLLMILSANMYKSNVLVYSEGGLWSSLKQSISIMRNERKKA

SEQ ID NO: 5247 - protein, 476 aa, Enterococcus faecium
  misc_feature (B) LOCATION 1...476
  hypothetical: YES
FEVKELFEFNNVSFSYKDVKEQALVDLNFSIKKGSLTLITGSSGSGKSTLLKLMNGLIPRLYDGKLVGEILFENNSLQSLTQESISKNIGYVSQNPRGQFFTTNTTSELVFSMENFGFTKEHMDKRINELAELLDLSNILDKNIFSLSSGERQKISIGCSLSLNSKLIILDEPSSNLDFKATKKLADLLCDLKNKGFTIVIAEHRFYYLKELIDQVLFVKNRTVKTTTIQLLKTENNNALRKFDIFNSSIEVPYIEKVSADVLKVEEITYENILKDINFDVKVGDVIGLVGKNGVGKTTLLRILMKIIRPTKGKIIENKKNLSSPFLVMQEMDYQFFTESVRSELALGNEIVSKDQQEKILKKMELYKMKDQLPFDLSGGEKQRLLVSIASLSKTNLFLFDEPTSGLDYINMERIADLIKDLKEKGAVVIATHDPEFLYKTCNRIIYLKNGGIKKDIKLRVEDSTLIEQIFNDITK

SEQ ID NO: 5248 - protein, 564 aa, Enterococcus faecium
  misc_feature (B) LOCATION 1...564
  hypothetical: YES
EEVKFVSTIKIIPLGGVRENGKNMYVAEVGEDIFILDCGLKYPENELLGIDVVIPDFTYLEENIDRVAGVFLTHGHADAIGALPYLLSKISVPVFGTELTIELAKLNVSRNEAAKGFKDFHVVDEHTEIDFGETVVSFFRTTHTIPDSVGINLKTKEGSIVYTGDFKFDQTAIPMYQTDYARLAEIGKEGVLALLSESANAENPQPVASEAQIADEVFDTIKYWEGRIIVACVASNLQRVQQVLDAAEKAQRKVVLTGQDFERIIRTAMRLEKLQLPSEDLLVTLKDMKNYDPEELIILETGRMGEPIKSLQKMANGTHRNVKIEEGDLVYITTTPSIAMETIVAKTEDIIYRAGGTVKLISENMRVSGHANPNDLQLMINLMKPTYFVPVQGEYRELAAHADLAHAVGMPYKNIYITGRGDVLEYKNKRMSVAGTTSAENVMIDGLGIGDIGNIVLRDRKILSEDGIFVAVVTISRREKKIISKPQITSRGFVYVKASRDLMKESSNMIETIVEKHLESNDFEWSKLKQDIRDQLGRYLFEQTKRRPVILPVIMEATQRRNKK

SEQ ID NO: 5249 - protein, 209 aa, Enterococcus faecium
  misc_feature (B) LOCATION 1...209
  hypothetical: YES
LFSKAASSFVTFLFKGGSFFMGKNRVWVEGTIVAALAMVLSLIPIQIGSSFSISLGQIPLTLFALRRGTKAGMLAGFIWGILHFPLGQVYYLSVVQVLIEYPIAYTFAGAAGLMASNVQKGYVDDNTKQIRKSIVFGALIGALSRYFWHFIAGVVFWGAYALWGMNSWLFSFVMNGASGLSTAIVTIIVLLGIQQTTPSIFVPDKRQEL

SEQ ID NO: 5250 - protein, 374 aa, Enterococcus faecium
  misc_feature (B) LOCATION 1...374
  hypothetical: YES
LLSKVEKGTRQLSEEKLNLVLDSLQEEVVPVNRVLIDYLTIHFFSNQHLKLIEEIIEMPIERFEELDYAPKGYIGQYVWNQVITIRYSIDDAVKGTVMEFSGQGCKHLARWLKTRKTNWQQFFRKVLDYQGNFTRIDFTLDDFVGSLSIPELKHKVILGHVWTTFQVSESHGGTDIINNESNGETLYLGSKKSQCRFCFYQKDHEQRKRRGIPLEEAKVKNRFELRYRKEKAQSLAKIISKTHDLTKLFFELLNGAICFYDRDPNDLGAKVDAKWAAFISNYGAITISLDTIPQSFEKTMSWLIHGVSPSLVFIAQVDQTFHSSLLPLIIEQGEMNPRQIKLLQNMKADPEYYQEEVEYYERKLQSISNEKTSY

SEQ ID NO: 5251 - protein, 67 aa, Enterococcus faecium
  misc_feature (B) LOCATION 1...67
  hypothetical: YES
LISKKNTQKKTLRQLKKKNQKRKKASGIVYFKTKKHINFYMQKKLLIRLTSNRTICQKLFLLKYFRI

SEQ ID NO: 5252 - protein, 307 aa, Enterococcus faecium
  misc_feature (B) LOCATION 1...307
  hypothetical: YES
NQSNTRGEKMKLTKRHLILVLFPLLIAIIIYAGLAASIPKAGPLMKPVTTVREDPNKKEKLHYIAIGDSLTEGVGDQTKQGGFVPLVANDLKDRYNLTAVETENYGVNGERSDQILKRVKTKEEIRNNIKTADFITLTVGGNDLMKVIQNNLFGLTVNSFKKPLKNYQENVTELLEEFRSLNKTAPIYILGIYNPFYLNFPEITDMQTIVNNWNKGTETVTKKMPNCYFIPINDLLYQGLNQEVGVTEEGTDQTTSTTENLNGIKNNVLYEEDHFHPNNLGYQLMANAVRDQLIETQNQWLEKEDDQ

SEQ ID NO: 5253 - protein, 193 aa, Enterococcus faecium
  misc_feature (B) LOCATION 1...193
  hypothetical: YES
EIPNMTKLSELEALLFIVGEEGISNEELSGLLNLSEAEVTSLVKELKESYTQNSHSALHIFETESHYVLTTKKELAPLLKRYAQGTSNTLSQAAVETLAIIAYKQPITRAEIEQIRGVQVSGAVQRLAAHKLIEEKGRVEGPGRPILYGTTGYFLDYFGLKSLEELPDTQEMEISLEEDVSPDLFFDGMNKGE

SEQ ID NO: 5254 - protein, 85 aa, Enterococcus faecium
  misc_feature (B) LOCATION 1...85
  hypothetical: YES
EKPKKPTWKLFLETFKDAMVIVLLIVALIQMVMGDYIEFLVIFAVLMLNSIISVVQTKKAEGSLEALKNLSAPDARVIRDGKEKT

SEQ ID NO: 5255 - protein, 348 aa, Enterococcus faecium
  misc_feature (B) LOCATION 1...348
  hypothetical: YES
LVTNLILFVSNLMIGLFSGTVSIMADAVNTLSDTASSILTLIGFKIAAKPADQEHPYGHDRFEYITGLFVSIIITYVGFQFLESSAEKIIHPENVSLTPIVFFVLIISIFLKFAQGKMYQVIAQSIDSETLRATATDSYNDVFTTLAVLLSAAIEWVTGWRIDGYIGFALALYILYSGLTMLRNFVYELLGSRPTPAEIEEMEEHLNACDDILGYHDLLVHNYGPNKRFASVHIEVDESMNLNVAHKIIDLIEKDFKKSLDVELVCHLDPMPVDNEKYYNILRQLKQILLETGTGLNIHDFRVIHQGKTLQFDVVVPEKFQFVDTELERILRSQIEEKNRRLPIGNYV

SEQ ID NO: 5256 - protein, 1114 aa, Enterococcus faecium
  misc_feature (B) LOCATION 1...1114
  hypothetical: YES
ILTKKKAECKMFFPQLYTITSYSLLQSTIRIREYVQEAKKQGYTSLAITDKDVLYGAPEFYRICVEEGVQPIIGLHLSYTYEEKNYGLLAYAKDEIGYQQLMKLSSRKMIQEKLELAEMTETDHLAFVVPANHSVSEAFNKEDNFFGHWQFLLENVFTRNFYIGLTENTPDQLPEWYQYVIKENYSLCALHPIASLQQEELFALEVMKHIKEGSQIPLENLSASLPLTANVYLLSEQEMIKRLEKAGLSQSVIGAQRLAESISFEFQFHQKLLPHYPVPNGKQAGEYLRELCYSQVERRITDYTKEYQERLDYELSVIHQMGFDDYFLIVWDVMAFAHRDKIVTGAGRGSAAGSLVAYVLEITDVDPLEYDLLFERFLNPERFTMPDIDLDIPDNRREEVLNYVREKYGQYHMAQIATFGTMAAKMVLRDAARVFGLSQSEANRWSKAIPNQLKITLTQAYKTSHQLVELVQASEKNQLLFKTAVILEGLPRHVSTHAAGVVISDKNLLELVPLQRGSDEAFLTQYTMNEVEAIGLLKMDFLGLRNLSIIDFTLKAVKRVEGYEIRLKEIPLNDAKTLLLFQRGETSGVFQFESAGIRNVLRRLDPENIEDIAAVNALYRPGPMQNIDTFIARKKGKEAIRYPDDSLIPILKNTYGVIVYQEQIMQIASTMAGFTLGQSDILRRAVSKKKKDVLDEEKSHFVSGALQQGYSEKTAATVYEYIEKFANYGFNRSHAFAYSFVGFQMAYLKAHHPGAFFTSLMNSVRHNTSKLKEYIAEARKNKLKLSSPSINQSNSSFELVNKEEIRFGLTAIKGIRRDFVEDILNERKQNGPFQSVDQFLIRIDKRWLKLELLQSLTAVGVFDELSPNRKQLMLDLEGKIQNIVYSGGSLDLLGIMALKEEEVADYTLEERLKLEEEYLGIYLSGHPAEGFDRLRLAKQVQLITDIVPNQPVNLLVMIKEVREIRTKKGELMAFVEGTDSSGEISVTVFPTLYRKYRNLFAVDRVIFVQGRSEISKYNQELQLIGESFADPNQLEAQYPSQTCYLRITEEREDPEIMKQLQVIFQKHPGYIPVVMYHEKTQRKVVLSDAYWVDDSKSIKRQLIYLLGEDNVVFK

SEQ ID NO: 5257 - protein, 109 aa, Enterococcus faecium
  misc_feature (B) LOCATION 1...109
  hypothetical: YES
SKTKVHASTISSYTIEEQRAVQTEILFGPLFYFKHFSLPKYSSRVSYASISVTIPEPTVRPPSRIENVVPFSTAIGWIKSTSIVTLSPGMTISVSSGNVIVPVTSVVRK

SEQ ID NO: 5258 - protein, 305 aa, Enterococcus faecium
  misc_feature (B) LOCATION 1...305
  hypothetical: YES
SKTKTAGMGKSTFRRTAPSMSAPTAMMGKCMRNPAILSVSTAPRLPYAPAWTGGCSVRKQATTFPAWPQSILTGEKYTDLTNGTLDIPLRDLPDDYEQLSVQAVDAAGNKSKIVQVKNPNYQAEDNKQKPSTGQTQPPATTAPVTSTTPAPTTPATSATTPPTTPTTNPATTTATKPAAGTGSAKPSASASAAPDEETDTTPRDPIPLTPDGQATVLDNATGEDGKEFYTIQTPDENVFYLIIDNQRDTENVYFLNAVTEADLMALAVKEDDTPQTDAIPDPEPACICTEQCAAGEVNTACPVCT

SEQ ID NO: 5259 - protein, 292 aa, Enterococcus faecium
  misc_feature (B) LOCATION 1...292
  hypothetical: YES
SQTNSYNHQKNEIDFVVGVGGGKLTDLVGYSANLARIDFGVIPTLASNCAPWTPLAVMYKENGQAEGKTEHFYRQAAFFITDPQLVIDSPVPYFIAGLADTLAKWYESELILEQDFLQDESFLKLAQDTAKICKEEILNHSAKAIQDMAQRKLTSEFKQLSEIIFAVAGLVGGLGDKYARNAAAHAMHDAISKYIPESHRFLHGEKVAYGIFYQLALEGRWEKIDELYPLYRELELPVSLEQMGLFPKDKQIIDKMAEFIDSKEKVHLIPIEVTQKSLIQSMMELEGYIRKI

SEQ ID NO: 5260 - protein, 191 aa, Enterococcus faecium
  misc_feature (B) LOCATION 1...191
  hypothetical: YES
GGAKMNKGVKTIGVIGTLLLLSVLLFAILLSATYPLPFQLEKFRFFSITNSYVQQYVFWLAVAFAILTIITLLVFLFYPKTIGNFLLKHGDGELTLDKKAIEGMVRSHLHEDEFIHSPKVNVKATKNKIAVNVKGELKRTSALIGKTGTLMKEIENEVQHILGTKEPVKVSVKYTGFEEPAKRSNDRKRVE

SEQ ID NO: 5261 - protein, 513 aa, Enterococcus faecium
  misc_feature (B) LOCATION 1...513
  hypothetical: YES
DYANKRAGKELQSLLDNTPRIAHRFKEGKLQDIVIDEINIDDQLLVKPGELVPADGRVTKGESSVDESSLTGESRPETKKPGDQIMSGSLNGDGSIQMIAEKRAADSQYQMIIKLVEESKEKPARFVRLADRYAVPFTLIAYLIGGISWWFSKDPLRFAEVLVVASPCPLILAAPIALVAGMSRSSKNGIVVKTGTTIEKLARTKTIAFDKTGTLTKGILEVEAIQPVNGIKKEELLLYAASAEQESSHILARSLVNNVKNSQLYPVSQLKEVTGQGIQAVVNNHEVKIGRASFVSAEEIETSNTAIYVTIDRSFAGTILFSDQIRPEAAKTIKELRKLDVKNLMMITGDGSAIAQTIAEKVQLDSVHARSLPQDKLTILESIPKDQRPVAMVGDGVNDAPALAAADIGIAMGAHGSTAASESADAVILKDDLLRVAKAVVISRDTMRIAKQSVLIGIFICIFLMLIASTGLIPALFGAVLQEVVDTVSILSALRAKKDPAIFPDSVPKTNIV

SEQ ID NO: 5262 - protein, 512 aa, Enterococcus faecium
  misc_feature (B) LOCATION 1...512
  hypothetical: YES
QIANLGLKYSSSFRKNSERRRNMSNNQPVDIYGKPYNRTLLVVVLLIGTFCTVLNQTLLTTAFPTLMKAFDISASDVQWLTTGFLLVNGIMIPITAWLINKFSSRNLYLSAMTIFLIGTITCFTAPNFSTLLIGRLIQACGVGVSMPLLQNIMLSIFPPEKRGSAMGMSGIVIGLAPALGPTLSGYIIDNYHWRDLFGMVLPIVVLVLVLAFFLMKSVIPLSNPSIDILSAILSTIGFGSLLYGFSSVGDDGWGSLKVIGFLVVGVIFIALFSWRQLHLEHPFLELRVFKSSTFTIAAVLAGVTNMAMVGAEMVVPLYIQNIRGESAFHSGLMLLPGALIMGAMMPVTGAIFDKYGAKRLAITGMFILTAATAPFAFLTKTTPVLYIVILYAIRMFGISMVMMPVTTSGMNALPNNLISHGTAVNNTFRQIASSIGTAILISVLTNVTKANIPSKSVLDNTPLAYKDQAINATLSGYHAAFIVAIIFGILGFIIAFLLKKKEPVLMKAGDNA

SEQ ID NO: 5263 - protein, 65 aa, Enterococcus faecium
  misc_feature (B) LOCATION 1...65
  hypothetical: YES
LSAKFPPILFTFPNEFIQRSIFIEIDLFELTKKDRDTDLSRSFFFIPTSKQMRKLIYTIILRIEE

SEQ ID NO: 5264 - protein, 155 aa, Enterococcus faecium
  misc_feature (B) LOCATION 1...155
  hypothetical: YES
NFQKRFVSKMKAIRKECCLMKFFQEFFIIIFFSVLGEGIRIFAHLPIPGSILGILFLFLAFEMHLVDPEKIGATGDFLLNNLAILFVPAGVGLLEYFDDIASIWPVLLGAVVVCSIVTMVAAGKTAEGVEALLGYVRKKKAERVSVNEMEENQID

SEQ ID NO: 5265 - protein, 242 aa, Enterococcus faecium
  misc_feature (B) LOCATION 1...242
  hypothetical: YES
KFQKYKPILKGELNMPKLVFSRHGLSEWNALNQFTGWADVNLAPEGIEEAKEGGRKIKEAGIEFDVAYTSVLTRAIKTCNLILEYSDQLWVPQIKSWRLNERHYGKLQGLNKKETAEKYGDEQVHIWRRSYDTLPPLMEETDEGSAANDRRYAMLDKRDIPGGENLKVTLERALPFWQDEIAPALLDNKTVLVAAHGNSLRALAKHIEGISDEDIMDLEIPTGQPLVYELNDDLTVAKKYYL

SEQ ID NO: 5266 - protein, 344 aa, Enterococcus faecium
  misc_feature (B) LOCATION 1...344
  hypothetical: YES
HRQKKSNVAGLSLKRNKNILTVKEELLMPNKLLEVKGLKQYFNVGKKNEVHAVNDISFHIYEGETFGLVGESGSGKSTTGRTIIRLNEPTDGEILFDGQDITKIKDKKGLTKFRHDVQMIFQDPYASLNPRMKVRDIIAEGIDVNGLAKSSEERAKKVDDLLRTVGLNPSHGTRYPHEFSGGQRQRIGIARALAVKPRFIICDEPISALDVSIQAQVVNLLQDLQKEHQLTYLFIAHDLSMVKHISDRIGVMHNGLLLEMGTSDEIYNHGVHPYTESLLSAIPLPDPDHERKRRRIKYQPEPDDGQVRQLREIAPEHFVYATEQEVPYYAKKLKRQKESLLVAN

SEQ ID NO: 5267 - protein, 326 aa, Enterococcus faecium
  misc_feature (B) LOCATION 1...326
  hypothetical: YES
LLQKEGLLMTFPYSEGNKRYHSWNYALRNEFGGKIFKVPIDGGFDCPNRDGTVAHGGCTFCSVSGSGDMIVAPEDPLPIQFQKEIDMMHQKWPHVQQYIVYFQNFTNTHAPVEIIKERFEQVVNLPGVVGLSVGTRPDCLPDEVVDYLAELNERMYLWVELGLQTTFEETSKLINRAHDYQTYLDGVAKLRKHNIRVCTHLINGLPGESLEMMKENVRRTILDSDIQGIKLHLMHLMRKTRMLRDYHEGRLQLMSRPDYVNVICDQLEMIPKEIIIHRLTGDAPWDSLIGPMWSLKKWEVLNAIDEELLRRDSFQGKYDVRKKVSV

SEQ ID NO: 5268 - protein, 370 aa, Enterococcus faecium
  misc_feature (B) LOCATION 1...370
  hypothetical: YES
KQQNVLLKWSEKIMSNEQNYETGGTYRLFHGSMNKFDEFSLDHKGLNGTANGFGVYLTPNKEMATMYAEQGSNGNNGFVYEVNVELEKPISMNERTITDEELSKVIDKLQESNDILNDYNDVSYYGEKVVKREVIASLSENENDVDLINDIGNTIGDHEATAKAFYDVGKYTHIIAEEQLRQKDVVIVVLQPDKVKIETIHDLNEERNSLESSEDMTDKFVGHKVSEVPIREVVIKDFEQELETTNYYDKQAWQERIEYLENMEEPVSRLALDSDINEFYDSHKEEIETKLTNLSEKLEIDKEELLGFPVDTSSTEYKKATSIMAYNGAMREIYNEIENDTFEIPPVSEEMENKILKLTNFENTTKFEME

SEQ ID NO: 5269 - protein, 61 aa, Enterococcus faecium
  misc_feature (B) LOCATION 1...61
  hypothetical: YES
IKQNQSISSVCSGRKIPAKLSSIFAGSTRDTIVKPIYDDAFCRRCYEKQESRLYYFSSVVR

SEQ ID NO: 5270 - protein, 369 aa, Enterococcus faecium
  misc_feature (B) LOCATION 1...369
  hypothetical: YES
AVKKTVSMYTGISANERKEGARNMEINEQNFGENYHLITITNQNGTSLSVSDLGARVVHFQTIIDNEKRELILGFDEAKEYLEKDPYIGASIGRMAGRITNGTFKLDDETFEVKTDPDTGHCLHGGAPSFEAKQWHYTVINGENEASVIFYQTSPDMENGFPGTLDVEVRYTLTNDDTWRVTVQGISDRKTVFNPTNHVYFNLTGDPAQSIDEHILWLNSRLFATLNKDTTPTGEVVSVSGTAFDFQRPKKLGEVFASDFRQSMIVGGIDHPFLLKKQSGLLNAAELTSPDEKVSIQVKTDASGIVIFTANFGEDGPEMRGNKLVNHGGITFETQELPGAERLESFGDVTLEPNQVREFVTEYKINIKK

SEQ ID NO: 5271 - protein, 98 aa, Enterococcus faecium
  misc_feature (B) LOCATION 1...98
  hypothetical: YES
EVKKFAHPKEFDTRRTRRTHRFVRRVYFPVGTRFNALNQRMKQLEDQMNEYYHRVTKWFTSSEHAEQLNAILQLAEKNTNGFYAMQQLYYCIAFWQCQ

SEQ ID NO: 5272 - protein, 174 aa, Enterococcus faecium
  misc_feature (B) LOCATION 1...174
  hypothetical: YES
LTKKGVLFMSRQEKINIVLDARPRLVHIIKCATDDQLGEYVGKVLDDMVMTVPFTDVPPLEGIRSDGEPLTINDQLFDPQENRWIVLTNVLDHNKLNNLEAVYEALENENGNLKQLNAKLMLNDVAIKQENTALKEKADSLAQINSKMMLASIQNSKDIAEIKEQLNPASKGGE

SEQ ID NO: 5273 - protein, 497 aa, Enterococcus faecium
  misc_feature (B) LOCATION 1...497
  hypothetical: YES
NHKKNWRRVSGMLENYIERNIFRKVYLCEQLFEFQEIDIEQTAISLRVTTPTILHDLESLAECLEYCIKEQVREKHKYKLVFKHGIALSELTQFLYGQSYFLKFLSYYFNGIFTSTELADLEFISLSKVYTIKKIVLDFFKENDYLKNKEIIIPEFDSRNILLALVRYVNWEGYENKNPYVEEACNELIDYVETHFFKRRYSEDEKSFIIRGIEIAIGRKAFPLGLKEEDKKSAETKPLFQLVCQGLEEQKGILDLQEEDVYYIFSLFNSRNYTNENMELLRKDFEVVYKNFVLNDLSLNELILQIISIAEIDDAENFIFKQSFLQFVRTLWADGQVFLPERIYLLSEKEQLLYGKIVEILEEWKKKNQIQLRWNENFIRKFVKSLSLINSEQAGRQEIEIFVVSESSVKQFFYRTQFHLYAEEGIAEINPILFRSLEELPDECLCAKKRVVLCDAASYQNGLETEKTKIYPISLKGANIHLYHIAQELHLLKKHIS

SEQ ID NO: 5274 - protein, 83 aa, Enterococcus faecium
  misc_feature (B) LOCATION 1...83
  hypothetical: YES
KHKKLFLLGCSYYLMQGSFFTTSFQIFRFLILQMVLLLTLVERLDSTCSIVGQSLAGRRSQLLLVLLKSVCFGSLVPIHFLDL

SEQ ID NO: 5275 - protein, 121 aa, Enterococcus faecium
  misc_feature (B) LOCATION 1...121
  hypothetical: YES
KHKKLFLFGRSYYLMQSSFFTTSWYTVFNQLTLGISSKKRQNMRNYFSIFFSNTQVKTLISQPLFLMKNMALMRRFFEFRHFFFDERIDCRSYDSKDNKQTDHDPDCFRSIWPINSSCRFP

SEQ ID NO: 5276 - protein, 331 aa, Enterococcus faecium
  misc_feature (B) LOCATION 1...331
  hypothetical: YES
KNKKRNRREKSMEWTQALIPIVSSCAMTIAAMPLFIGYFQMKKQGQAIREEGPKWHNSKAGTPTMGGLVFLIGSILTGIWVGAWQKQLTPTLFILLFVLALYGVIGFLDDFIKIFKKRNMGLNSKQKLIGQILGGIIFYLVYRSEGYPGVLNFFGLDLPLGIIYGIFALFWLVGFSNAVNLTDGIDGLVAGLGSISFAAYGLIAWHQHQYDVLIICLSVLGGLLGFFVYNRKPAKIFMGDVGSLALGGLLAAISIMLNQEWTLLLIGLIYVMETASVMLQVTSFKLTGKRIFKMSPIHHHFEMCGWSEWKIDTVFWLISIVTSLITLWIVW

SEQ ID NO: 5277 - protein, 122 aa, Enterococcus faecium
  misc_feature (B) LOCATION 1...122
  hypothetical: YES
LSKNLIAKTETTKDTNVPTRRTTVSSILNEFPSAKYLTIFKPLAPNMTGIPKKNENSVATKREAPIKIDPRIVAPERDVPGTSAKTWNNPTRRAAWYVKSFREVQRGVLFLLRFSTIIKAIP

SEQ ID NO: 5278 - protein, 64 aa, Enterococcus faecium
  misc_feature (B) LOCATION 1...64
  hypothetical: YES
KHKNTNKSTILVFLIFHYRAFSFLCSMYPNLEKLIKDLDKAIDDLVVVLPEYQCLTSIPGIGPV

SEQ ID NO: 5279 - protein, 497 aa, Enterococcus faecium
  misc_feature (B) LOCATION 1...497
  hypothetical: YES
SNKKTSKFRGIDMKKFPEGFLWGGATAANQCEGAWDVDEKGLSVSDVYTFDSDLPKEKWTDQWHMMTHQQVKAAQDPNSKYYYPKRHGNDFYHHFKEDIRLFAEMGFKCYRMSIAWTRIFPHGDEETPNEAGLFFYDQVFDECLKYGIEPVVSLSHYEMPLYLVTEYGGWPNRKLIQFYVRFAETVFKRYKNKVKYWMTFNEINCVKHHPFVSVGVIEENHPHLEQAKYQGAHHQFIASALATKACHEIIKGSQVGCMISYQLLVPYSCDPDDIQKTIEQQRTSLFFSDVQARGYYPAYTQRMFEEKGVNLKIEVGDEEILAAYPVDFVSFSYYMSSAVSAHPENWEGVQGNLITGGIKNPYLPSSEWGWQIDPKGLRIALNQLYDRYQKPLFIAENGLGAIDKVEEDGTVQDDYRIDYLKQHIEQMKEAIKDGIDLFGYTSWGCIDIVSASTSQMSKRYGYIYVDQDDEGNGTKKRLKKKSFDWYRQVIQSNGEIL

SEQ ID NO: 5280 - protein, 302 aa, Enterococcus faecium
  misc_feature (B) LOCATION 1...302
  hypothetical: YES
MDKNIGGMKMIKGSIVALITPMNEEGSVDYAGLEKLIQFHLDEQTDGLLVLGTTGESSTLTQSEEEQILQLTVKKVAGRVPVIAGAGTNNTKETIEKAKHFASLGADALLVITPYYNKTSDAGLAAHFTAIAEASPIPLILYNVPSRTGMSIPIHVLVNLAEHPNIIGLKEASGDMAYVMDAARLIGEEFFLYSGNDDLILPVMSVGGSGVISVWANIQPKIVHELVKDTQDGRWQQAKEKQLNALELIHALFSETNPIPVKAAMSLLDLPSGPLRLPLVSLSKEKKKQLAQLLLKERTVEK

SEQ ID NO: 5281 - protein, 84 aa, Enterococcus faecium
  misc_feature (B) LOCATION 1...84
  hypothetical: YES
KIKKRWNLFRLSAPRAIKTTFHRFLVTEKIGNKKMIHLSTPRPQVTIFIKDEKLFFEIALCDSELNDRLTTSFLNGVQSADLRY

SEQ ID NO: 5282 - protein, 361 aa, Enterococcus faecium
  misc_feature (B) LOCATION 1...361
  hypothetical: YES
RSKKGKPMNRKDEHVSLAKAFHDKQKNEFDFVRIIHNPLPQIAVSDVDLSTQAVGFTLSSPFYINAMTGGSEKTKKINQDLAIVAREADLMIATGSVSAALKVPSLADTYTIMRQEYPHGKIIANIGAGTSVERAKEAIRLFHADALQIHLNAPQELVMPEGDRDFTNWKVLIQETQTAIDVPLIVKEVGFGMTRETLNDLAALGVHTVDISGRSGTSFTQIENARRSKRELSYLADWGQSTVSSLLEANEADTSMEILASGGIRNAYDIFKALCLGANAVGTSGTVLTHLMNHGVEETIILMKQWQEELRLLYTMVGATNTAALHQQSLIFSGPVKDWCEARGIDLVKYGRRTEKSVGQK

SEQ ID NO: 5283 - protein, 234 aa, Enterococcus faecium
  misc_feature (B) LOCATION 1...234
  hypothetical: YES
LKKNMDVEWGYSGDKGPENWASLCDWFARGAEFPLQSPIHLTKGEETKIEGDTLSFHYQKQRFTDKEFKNTIHLVPFDQLSYVEFKKERYYLTDIHFHLPSEHIINGKQEDIEFHFVHMNSKKENLVVGVMYQLMVQEGWLYNQENGESWNLEKHEHWVNPDVFFPEQKSHFHYIGSLTTPPTSGPIQWFVMDHVGKLNQEFLLPFDGQYARPNNRPIQPLNGREIYYFEEFEQ

SEQ ID NO: 5284 - protein, 900 aa, Enterococcus faecium
  misc_feature (B) LOCATION 1...900
  hypothetical: YES
MKKKVYIISHSHWDREWYMAYEQHHMRLIELIDDLLELFEVDPSFNSFHLDGQTIILDDYLQVRPEKRQAIQQAINEGKLRIGPFYILQDDFLISSESNVRNMLIGMEESRKWGTPVMLGYFPDTFGNMGQTPQLMKQAGISAAAFGRGVKPIGFDNQVLEAENYSSQYSEMWWKGPDQTAIFGLLFANWYSNGNEIPVEKEAALAFWKQKLADAEQYASTNHLLMMNGVDHQPVQKDISKAIHLANELFPDYEFIHSNFTDYLEAVQKDVPEDLGSVEGELTSQETDGWYTLANTASARVYLKQWNTKVQRQLENITEPLATMAYEVSGNYPHDQLDYAWKTLMQNHPHDSICGCSVDSVHREMIPRFEKADEVGKYLAQDSLEQLTAAIDTTGFPKDSFPFVIVNTAGMDKTGEAEITIELERKRFAEGIPEQLYQELENLPKRKYHVETKSGATIPAILSEETVQFGYDLPKDRFRVPYMARMIKVTLPLENMPAFSWETFALVEGEAKAEEKETMIHQSGRIIENGPLHLTIEKNGTITMEDRKNKRKLNNLHIFEDIGDIGNEYIFKQPFCDQPILSSNKENSEVKVLVDTPEIAKISILQEMEIPVSADERLEKEQQMVVEFRYRKAERSKEKRILQIKTIMTIRKDSKKIDFETTLDNQMKDHRLRVLFPTKLHVEHHEADSIFEVVKRPNHVSKSWENPTNPQHQQAFVNIHDEEYGVTVGNFGLNEYEVTEDGQIAVTLLRSVGELGDWGYFPTPEAQCLGEHRFNYSIELHGPEEKFSTYLHAYAAQIPFSTQQIKHHEGTLISKQQYLTIKSETFAITALKRSKFSDKVVVRGFNMSSHLEKLEITKDNGKTVILNLLEEPTKQAVVPIIQPYEIRTIGFEEENECMAE

SEQ ID NO: 5285 - protein, 203 aa, Enterococcus faecium
  misc_feature (B) LOCATION 1...203
  hypothetical: YES
KKKNNQKAGGKMVHRYNKDTQQKILKEATDLFMSKGYLGTSTREIAQKVGITQPNLYHYFGDKEKLYTAVLENHLKDVGKALREIVQTSETGFQVTLTKMAQFLIETHLVDLFLMLHDLESNLSKETRDHLFFLWKKNYREPFEEIFSANQSVLRNGISKEIAARHFFLVLAPYITRSKRPVEEPLNVAQLIDLYLNGVLGEA

SEQ ID NO: 5286 - protein, 70 aa, Enterococcus faecium
  misc_feature (B) LOCATION 1...70
  hypothetical: YES
HEKNLKSLLLLVQNKGRTLTHEITFVRIWGYDFDGDGSTVHTHIKNLRANVPENIIKTIRGVGYRLEESL

SEQ ID NO: 5287 - protein, 128 aa, Enterococcus faecium
  misc_feature (B) LOCATION 1...128
  hypothetical: YES
EEKKMRLTEGIVVDSGLTFGKLRFSALRREVRKQNEDGTIGNEVKERTYNLKSSAQGRMIQVSIPANVPLREFAYDAEVELVNPIVDTVANYVFREGTTVNWFIKADDLVLKRQPNQGNPTNQNERKK

SEQ ID NO: 5288 - protein, 628 aa, Enterococcus faecium
  misc_feature (B) LOCATION 1...628
  hypothetical: YES
KRKKEKTMDNQAVGRRVWEAVGGQKNVKSLVHCATRLRFRLKDESLADTQKLKEDPDVIQVVQSGGQYQVVIGSNVADVYQSIVDEEGLAVSEDGKEESKNILNRLIDIISSIFTPFLGAMAAAGVLKGFLSLATVMGWLTADSGTYQILFAAADGVFTFLPVMLAFTAAKKFKANQFLAVAIAMALVYPAITAVAGAGEAISFFGIPVILSPSGYTSSVIPIILAVWVQSKLEPFVKKVIPQFLQMILVPLVVLVVMVPLTFLALGPIGTVAGNALGGLFNSIYGFSPIVAGLIMGSLWQVFVMFGMHWGFVPIMFLNIEQYGFDVLMPMLLPAILAQGGAALAVALRTKDTKLRALGISSTVTSLFGITEPTVYGVTLPLKKPFIAACISGGIGGAIIGFSGVKAFSSSLVSLLTIPTFINTVDGVESNVTVAVIATGIAFVLAFVGTLILGFDEQTQDNQLENKHANAGEPITSARHTLKSPLTGKVLPLSEVPDQVFSSGVMGKGIAIDPEVGELVAPADGEITTIFPTGHAVGITTTDGAEILIHIGMDTVELNGNGFEILVKQGDLVKAGDLLIRFDIEAIRAAGYSVITPVVITNTDAFADILELDQKEIIANEDVLAIVK

SEQ ID NO: 5289 - protein, 74 aa, Enterococcus faecium
  misc_feature (B) LOCATION 1...74
  hypothetical: YES
KRKKKKVLKHCVILGILGTCLAGIGTGIDVDAATYYGNGLYCNKEKCWVNWGQSWSEGLKRWGDNLFGSFSGGR

SEQ ID NO: 5290 - protein, 264 aa, Enterococcus faecium
  misc_feature (B) LOCATION 1...264
  hypothetical: YES
GGKNNVDFVIILVKSVIIGGLLGFAASVGAARMFHAPNTQGLGAFRTLGEMNACMGDPASHFSFGLGFFFNAWASSVGAGAFTQDVTHRIIPNWAAAALLAKNKDVTQTMHDPKKMGIIGAVIGAVVVAFLNTTAAAIPEALQVTAVSVLVPAATILINTVMPVIFWLAALDAGKRTGFWGTLFGGIAQLIMGNAVPGVVLGILIGKGVDESGWNRVTKSMMIAIVLLFIFSGFFRGFDMEMIKSFQLQVPNWLDNLHNIFSVK

SEQ ID NO: 5291 - protein, 99 aa, Enterococcus faecium
  misc_feature (B) LOCATION 1...99
  hypothetical: YES
LMKKILIYLVRGYQRFISPAFPPSCRYYPTCSNYMIKAIQTHGALKGTVMGTARILRCHPFVKGGIDYVPLTFQLTRNKKDKKEPDYKKVVKNTSSTER

SEQ ID NO: 5292 - protein, 297 aa, Enterococcus faecium
  misc_feature (B) LOCATION 1...297
  hypothetical: YES
VVKKSKGLGRGIDALFQDLENLETVDVKDDTVVQLPLNELRPNPYQPRKTFEEVSLQELANSIEQSGVFQPIIVRRSAVKGYEIIAGERRFRASKLAEKETIPAIVRDFDEEAMMQVAVLENLQREDLNPLEEAEAYEMLMKNLKLTQAEVASRLGKSRPYIANYLRLLSLPDLVKEMVQDQRLSMGQARTLLGLKNKTLILKLANRAVTENLTVRQLEQLVSELNQNDGKEKKKIPRLAKEKPYYIRESEDRLMDKFGTSVAIQEKNGKGKIEIEYLSQKDLTRILDILNIQFDEE

SEQ ID NO: 5293 - protein, 333 aa, Enterococcus faecium
  misc_feature (B) LOCATION 1...333
  hypothetical: YES
RPKKWRRITVNYDSCSSSFLRKSLLSKIKRIEKRTYMNYYSKNKENFYQKLTDDPLFSSLTDYLYEHREQETILRELKKEFSQNKFSHFLDLLIDAGLIKREERRYHLNFPIFDPKDYLQQATSAAETIAEQLKRLSVDEQKLAMGEVIWAYCFEDERKEAYFYGVRNSRETELLRTTAGNEKYRFITLSSIEHFPLTLANYFFVQKNQLPVTKAFKELAELIGDVNESYFFDQIEVIVDRIRKNKYKNRRPSIFHQSLLVTNTIKEEESFTLELPIVEKNNFEIELPTLDPSLTMEEMAFLKRQIFSELSKKFIPHAFSYIKEYGTVLVSKT

SEQ ID NO: 5294 - protein, 79 aa, Enterococcus faecium
  misc_feature (B) LOCATION 1...79
  hypothetical: YES
TKKNGFHRVKKSHQGLLDEFVLETKEGWLNLNKNCQVAGLGGADQRDGSYAYYISEPIICNDQKGVGAFLQALIEVEAL

SEQ ID NO: 5295 - protein, 78 aa, Enterococcus faecium
  misc_feature (B) LOCATION 1...78
  hypothetical: YES
GEKKMNNKTFEVLKWFALVIIPALATFVGLVGKALNWQYTDICVVIITGFGAFLGSVLGVSNRTYKMFSAESEEGGNK

SEQ ID NO: 5296 - protein, 149 aa, Enterococcus faecium
  misc_feature (B) LOCATION 1...149
  hypothetical: YES
ERKKKMNIDSLMIDEISELYKSVGWTNYTKDTARLARAFEQSESLIKRNGEGKIIGIVRWITDFATIAFIQDILIHPRYQRQGIGKVLLNEALEKITSYGPVQIELLTDDTEKTKKFYESVGFVQVKEMGGISYVIDTRRKKVLFGNDK

SEQ ID NO: 5297 - protein, 471 aa, Enterococcus faecium
  misc_feature (B) LOCATION 1...471
  hypothetical: YES
RSENMAKGIKIATIGGGSSYTPELMEGFIKRYEELPIREIWLVDVEEGKEKLEIVSQMSQRMWDASPYEVKIYATLDREEALKDADFVTTQFRVGQLDARIKDERIPSYYGMIGQETNGAGGIFKAFRTVPVVLAIVEDMKRLCPNAWLINFANPSGMVTEAVIRYGKWDKVIGLCNVPVMAMMTEPAMLGKKKEELIYKFAGLNHFHWHKVADNKGNDRTAELIDRLYDEENGLPKNIFDIPFFKEQLKQMNMIPCGYHRYYYREEEMLEHALEEYQTIGTRAQQVKETEAELFELYKDPELDHKPEQLQKRGGAYYSDAACETIASIYGNKETQIVVSTKNDGAVPDLPADCVVEVTAYVGAQGARNVAFGSLPAAERGWLQVMKNMELLTIEAAVTGDYGTALQAFTINPLIRSGKTAKRIMDELFIAHQQYLPQFKETISRLKEEGIEVQDELARELSGNTHIMEEV

SEQ ID NO: 5298 - protein, 127 aa, Enterococcus faecium
  misc_feature (B) LOCATION 1...127
  hypothetical: YES
EGEKMLTHYRKENRKIAMGLLSFHKKLTGKTSLLKEIDTYESEDDYELFFFTPEGSTNIQGIIGIYWATNDQLIIHDISLNPSYRGENMGFQMLDELQEKYPDVSIRATEITEPYIGKWLAKKKKKE

SEQ ID NO: 5299 - protein, 123 aa, Enterococcus faecium
  misc_feature (B) LOCATION 1...123
  hypothetical: YES
NGEKGNRFAHREFKKGNPSIGGMSVDKKAAMKRIAELTKSESWQEDKEIVAEVQKLGKSMWTEKPKRRTPRKIAIWHDDRILVTGTAEQLSEITGLSKNIIWDRARSLWIDSKGRQFRYVEER

SEQ ID NO: 5300 - protein, 193 aa, Enterococcus faecium
  misc_feature (B) LOCATION 1...193
  hypothetical: YES
VKEKRENMKIVLASQSPRRKELLAHIVSEFEIEPADIDETPFPDEQPVDYVRRMAEEKARTVWEQDEKEDHLVIASDTTVVLNQEIMGKPEDLAEAEFMLKKLSGETHTVYTAVVLKTKEREERILAEAHVTFYPLTDEEIKRYLETGDYADKAGAYGIQNAASVFVKEISGDYYSIVGFPIGAVNQALKTFI

SEQ ID NO: 5301 - protein, 231 aa, Enterococcus faecium
  misc_feature (B) LOCATION 1...231
  hypothetical: YES
IGEKMKKLKIFPKMFIQIFSVLGIIIILVHSLIFFIFPKTYLETRKEKIHNMANEISSNMNGKEIKYIEQTLEFYSKSSEIKVFIKEKNNKNEIQIKDNINVNLESDSNSLIIEEREIKLNDGKKTNLQFVSTADMQKDAKDLSLKFLPYSLLISILFSAIISLIYAKSIKNNIQEIKIVTDKMMKLDKKMSLKVSSNDEVGELKQQINDLYSTLLRTIDDLEGASIILCK

SEQ ID NO: 5302 - protein, 244 aa, Enterococcus faecium
  misc_feature (B) LOCATION 1...244
  hypothetical: YES
FMENFFSILGGMGTMATESFVRLINHRTKATKDQEYLNYVLFNHATVPDRTAYILDRSEENPMPFLLDDIEKQNLLRPNFIVLTCNTAHYFFEELQAATDIPILHMPREAANELVRQHTTGRVAILGTEGSMKAGIYEREVKNLGFETVIPDTALQEKINYLIYHEIKESDYLNQELYYEILEEAVERLNCEKVILGCTELSLMHEFAEDNHYPVIDAQSILADRTIERALAERSEALDTASEK

SEQ ID NO: 5303 - protein, 147 aa, Enterococcus faecium
  misc_feature (B) LOCATION 1...147
  hypothetical: YES
VMEKFTGYVREPFYYETDQMGIIHHSNYIRWFEEARVALLVHLGFPYKKIEESGIIIPVLEVNCSYKEMIHYGEKVSIHPTIQKYTGTRLDFSYEIVGTEDKKLKTTGSSKHCFLLSDSQRLVKLSKVNPELDQLFQAYASLDDVNS

SEQ ID NO: 5304 - protein, 468 aa, Enterococcus faecium
  misc_feature (B) LOCATION 1...468
  hypothetical: YES
GVEKMPINSYDNYPLTWRPDKQKLKRPYYRSLIQQLEQDILKNKLQKNTQLPSQRELADYLDLNFTTVGKAYKYGIEKGLLYTNIGSGTFISPNVFESITISTNEVTEHIIDFGLVSSFEECNKFVVPFIQSTSNNPNLVGLLNYQDPKGTNFQLTTAANWLKTQGVIPSLESLSIVSGVQNGLAITLSALFSPGDRIATDRYTYANFIELAQLYHLEIVPIDFDEQGMRPDILIQECRKKKIHGVFLMPSCNNPIGFQISHKRREQLAEVIEKEGLWVIEDDIHSFLTTYYQHTIIPPFQNLLPNQTIYLAGMTKFICSGLRVAYLVVPVHVQSKIEQAIFNINVKTSGLDVEVITQILHSNEANRILETKLSLTKRANQLFDSLFKVEKPTNRVPYYRILPVDPEIDPKIIENDFLANGIRLYHSRRFTTRAQPDAFVRISLSSNNLEILASGLSIVKEKIKKYEL

SEQ ID NO: 5305 - protein, 348 aa, Enterococcus faecium
  misc_feature (B) LOCATION 1...348
  hypothetical: YES
LKENNMIVFILSLFSSGHKLRISSLYQLLVGKRTTSVLIYGFTHELLFIHNSFPELKQDKFYQILQKIAQQGWIEINENEAKLTPAGADMLSEHQIEHTGLRFDRYGRTGETSWRLIKFAVQVISNLATGIQDYLPAETSPFYTFQLKKWLSESQLPREILIDTAYESLVQLFSEIPEEAADFLANQLSGNERTGLLPYQLAKNNDESAVYLQQSRCIHLLLAQIEKRPDSLWHALIDSLLQQNFNQSMMITKQMFMNGQTIDQIMAIRHLKRGTVTDHLIEWALFFDDFPYEWILSAETIERLEPNKDSVREWRFSEWNVDGQLDYGEFRLYQIYLLRKEAIQNVNK

SEQ ID NO: 5306 - protein, 297 aa, Enterococcus faecium
  misc_feature (B) LOCATION 1...297
  hypothetical: YES
YKEKRGIQMKKLVAGLLTAVALLAMSACGADQKNTAQTSSSTKESAEVSSGASEQVYTDPKEMKESYDVVIIGAGGAGMAAAIEAKDAGLNPVILEKMPVAGGNTSKSSSGMNASETKFQKEEGIKDSNDAFYEETLKGGGGTNDKEMLRYFVDHSADAVDWLDQNGIKLDNLTITGGMSEKRTHRPSDGSAIGGYLVEGLLNNVHEREIPIFVNADVTDIKKNGETVNEVTVHVQGEEPKEVTGKAIVVTTGGFGAXKEFIEKYRPDLADYITTNQEGSTGDGITMIEKLGGQTVX

SEQ ID NO: 5307 - protein, 80 aa, Enterococcus faecium
  misc_feature (B) LOCATION 1...80
  hypothetical: YES
TKENKNMENPTFEESLQELEKIVMQLEQGDVPLESALDSFKRGMELSKHCQDTLAKAEETLTKMMTESNEEVDFDGNEES

SEQ ID NO: 5308 - protein, 70 aa, Enterococcus faecium
  misc_feature (B) LOCATION 1...70
  hypothetical: YES
YAWKTAIQIPISKTEIKKNGKIEIVPVFLDNACIPPHKKGIAKSGAFILKRRFNENNFTRNWQPNKTITG

SEQ ID NO: 5309 - protein, 143 aa, Enterococcus faecium
  misc_feature (B) LOCATION 1...143
  hypothetical: YES
KNWKNGPQQKFNAIVKERIAVFVVEQQCPYQEVDDIDGQAWHTFFQDTDGKILAYTRVYEEAESIHFGRVLVHQDNRKDGLGRKIVQETINMIQKNFPEKPIVIGAQEYLQAFYESFGFKAISDVYLEDDIPHIDMKKEQVAS

SEQ ID NO: 5310 - protein, 292 aa, Enterococcus faecium
  misc_feature (B) LOCATION 1...292
  hypothetical: YES
WNWKVISERSEGGGHMETLSVVQSLLIALWVAAVMSRWLGGGATLTLRFSPLMTGLVVGLIMGEVAQAMIVTAALQMIYMGVFSPGGSMPAEPSIAAAIAVPVALLGDLSPEAAIAVAVPVGLLGSYLYQFRFFINTFLGKYTDKAVEDLNTKAMARSIILYPTVASFLLFVPLVFIALYLGAPLIADVIKALEGTVVIHILEVVGGGLAAIGIATTVYVIGRKDYLVFFFLAYFMSVVLKSLDITMVTYAIFGIIIALIFVQSQKGKQVQPATSNNNSASFDDEDDYDDGF

SEQ ID NO: 5311 - protein, 240 aa, Enterococcus faecium
  misc_feature (B) LOCATION 1...240
  hypothetical: YES
RRWNPKMKKYIFTERNGIYIIDLQKTVKLVDAAYDYMKSVAEEGGVALFVGTKKQAQEAIKEEATRAGQYFVNHRWLGGTLTNWDTIQKRISRLKQINAMEEDGTFEVLPKKEVAGLNKERERLEKFLGGIADMPRIPDVMYIVDPRKERIAVQEAHKLNIPIVAMVDTNCDPDEIDVVIPSNDDAIRAVKLITSKMADAFIEGNQGEDQVVEEDFTEENTATSIEEIVDVVEGDNSSAE

SEQ ID NO: 5312 - protein, 188 aa, Enterococcus faecium
  misc_feature (B) LOCATION 1...188
  hypothetical: YES
TRWKQMKKIVIKGNRPLAGEVTISGAKNSAVALIPAAILADSPVILEGVPDIQDVHSLIEILEIMGATVHFSNNILEIDPREIVSIPMPHGKINSLRASYYFMGTLLGKFGEAVVGLPGGCYLGPRPIDLHVKGFEALGAEVTNEHGAMYLRTENKGLRGNRIFMDVVSVGATINVMLAAVKAKGRTP

SEQ ID NO: 5313 - protein, 454 aa, Enterococcus faecium
  misc_feature (B) LOCATION 1...454
  hypothetical: YES
ASRKRWKCRQKMATKHDLILEYIESLPVGNRISVRSIAKELNVSEGTAYRAIKDAENVGLVSTIQRVGTIRIERKLKKHIERLTFGEVVRIIEGDVLGGAAGLDKVLNKFVIGAMTKHAMERYITPGSLMIVGNRAEVQKLALEDGAAVLITGGFNTTAEIAKLADDLEMPILRTSYDTFTVATMINRALSDQLIKKDIMLVSDIYMPAEKTHYLQQTDTISDYQRLSEETQHSRFPVVNRHHRLMGIVTAKDVLGKSPNQIIDRVMTKEPISVKKTMSIASVSHQMIWDGLEVMPVVSDDLTLEGLITRQDVMKAMQLVQRQPQIADTISDQISGNIHTIDTDREGNRLENPKFKFVVAPQMVNGVGTISFGVLSEIISDVAQKTMVMNQKRNILIEQVNLHYLRLIQLESELDIRPRVLEIGRRSAKLDIEVFIENTIVSKAIVVCQVMERS

SEQ ID NO: 5314 - protein, 540 aa, Enterococcus faecium
  misc_feature (B) LOCATION 1...540
  hypothetical: YES
SCRNDGRCRYIHYYLPLRRRSTAICRKAGKNEGINEEDFYMKDMKALQNGSDIRGIALPVEGYEVNLTTDMVKKIGWGLANWIKKKKKSTDPNKKWTIGIGHDSRISGPALKEALIQSLKEQGIHVIDFELATTPAMFMSTQFEQFSCDAAVMLTASHLPYYYNGIKFFTSEGGAEKEDIAFILSQQQKIKSEQTGSVEKADLLTPYAQDLVTKIKKGIGTLESKPLNGWKIIVDAGNGAGGFFAEKVLNSLGADSTGSQFLEPDGRFPNHIPNPDNKEAMESIKQAVLANEADLGIIFDTDVDRSAVVSASGTVINRNNLIAVLSTIVLKEHPGTRIVTNSPTSSHLQRFIEEKGGIQVRYISGYRNVINKALELNRLGKDTQLAIETSGHAAFKENYFLDDGAYVIAKILMLLPELKRKGITLDEQIKELKQPVEVQEIRLKLFSDEPREQGNKILEEMKRLLEEEKGMNFDPENEEGIRYDLEEPYGNGWFLIRLSLHEPLLVLQIENDEFGKNKLALVKLAKLFGHFSDLESLTAE

SEQ ID NO: 5315 - protein, 257 aa, Enterococcus faecium
  misc_feature (B) LOCATION 1...257
  hypothetical: YES
PFRNKGEKNMVRYKAIIAYDGTNFNGFQKQPNGRTVQEEVEKTLQKMANGKEITVFGSGRTDAGVHAIGQVIHFDYPEERPLERMRFALDTQSPEDIAVRQVEIVSEDFHARYLVKEKTYQFRVDIGKPRSPFRRHYASYFPYPLDLEKIQRALPDLLGTHDFTSFCASGSSIEDKIRTIYEAKMEVNETKDELLFTFRGNGFLYKMIRILVGTLLKIGNGRLPEDSIPDIIAKKDRNAAGPTAHPEGLYLYEVKYE

SEQ ID NO: 5316 - protein, 62 aa, Enterococcus faecium
  misc_feature (B) LOCATION 1...62
  hypothetical: YES
GARKITFHQIYPKSKIFSMVYSMYLVTSLIKYVSKTEKKSVMTFKAVYQANSKEEAILSYPA

SEQ ID NO: 5317 - protein, 515 aa, Enterococcus faecium
  misc_feature (B) LOCATION 1...515
  hypothetical: YES
KNRKELHQLNNEEEKEKRLTEEAELTADSPKVEKENEKQPTDGKTISGYALKFGQPSKDLGGFVEVITPEALKEVDLSNVFLLYGHDYSKPLASVKAGTLKLNVDDTGLHFEAELTDTTYSNDVYENISKGVVDSMSFGFVLGLDSFDKKEDGTIERSIDKIKALNEISVVTVPAYDSSNVQVNKRSYESFMSNNQAKQTNNSLESTSKAQKESNNMEKTLIDNEKTELRGYEEYIRSQGEVRDGVTTVNAAAVVPEEVIGEVFDLKRSNYNLAQYATVKTVSNGQGKYPVATNQQAVLATKAELAEIGDIDAEMFTSVDYKVETRAGKIALSNEVVEDSAVNIVQEVKDQLAKLVENTDNKHIMDLLKTFTKKTAATLDDLKQLYNVALDPALNKMVILNQSGYYHLDTLKDSDGRYILQPDVTAPSGKSLFGMPVVLIADTLFANPKAGTFPMIMGDIAQSIFVARRNQVTTQWEKFDYYSQGLAVIVRNDYKKIDQNASVYIEFTPVVTPKV

SEQ ID NO: 5318 - protein, 384 aa, Enterococcus faecium
  misc_feature (B) LOCATION 1...384
  hypothetical: YES
TQRNDFFRRGTFMAKKDKELLSQLTSEGAKGPFVTIMLNTHVAHQDVEKDQIKFKNFAKEAKKRFEKKYSEHDWSPFQEKIENLLGDPSFWRSATTSVAVIITADQTYIHRLSIPVDDQYYVSDLPYLLAIIKNGQFNYSYYLLGLNRDSMKLYEVSNKQVKEVSLPEGAPVDVVTALGSELTGGGLNFSSNGGGGARDGVTFHGVNPKDEEVEIDWVNYYQAVDTYLKDSFENPEQWPIYLFALPENQTMFKKIAKNPYYCADVAISASPAQLSFRDIEEGAKKLSNELAAQESKEYNKLLDKKFIDQLVDIVPAAKEGKVSHLCIATSNLADGFGKDPETEYDRRQVLNALADDVIINGGKVFILDQKDAPDEKSLTAILRY

SEQ ID NO: 5319 - protein, 264 aa, Enterococcus faecium
  misc_feature (B) LOCATION 1...264
  hypothetical: YES
TKRNPEPRYFDVPLGSINSMGLPNLGFSYYLEYALAYEKVQENQNQPLFFSIAGMSVQENLEMLEKIEKSGFNGITELNLSCPNVPGKPQLAYDFEATYETLKEVFSIFSKPLGIKLPPYFDFAHFDQMADILNQFPLTYVNAINSVGNGLYIDTEQEAVVIKPKEGFGGIGGEYIKPTALANVRAFYTRLKPEIQIIGTGGIRTGQDAFEHLLCGASMLQIGTELHKEGPEIFSRIIKELTQIMSEKGYTSIDEFKGKLRTIS

SEQ ID NO: 5320 - protein, 432 aa, Enterococcus faecium
  misc_feature (B) LOCATION 1...432
  hypothetical: YES
LERKETAVEEWQSVFEEWFPKEISKSYPIKISKQYTSSQRWEIYAKLTKKQRELVDKHRRYLISSRFMEEHYLAATDWVFSDFKINPFFRTKRSQQKLYCECGRELKVQYIVKSPKTGKILKLGINHFADHLHVSPTVAASIHQGMTKVDLALDELLWLKQKNIDFPEGLWQKYCFVLYQNRRMKQPYLPDIKLAQRLAEFRQVEMPIYIADYQALENEIKKISEHINGQSKKRQIKKELFDDFAEELVKDVEEFLINYRAFLRKDWQSIVYEEVPVHPNAYFETFISVLRKTKRQRTPEVTAQMEYFAKNQRFIQPKIYLFIWKQYCRYGFTEGFFDSIPRIVRNGFLKVLRKEREAIQSADKKDRTVSKEKWQLVVKDIQSGNVQETIDKWKGKHYRFTEAQKQALEYYQKLEESLRFNDEARKYLKELL

SEQ ID NO: 5321 - protein, 135 aa, Enterococcus faecium
  misc_feature (B) LOCATION 1...135
  hypothetical: YES
KERKLTLMEKNMNAFNRNLHNLLTISGTDAAELAQTLNVELPEINRWLNGSAAPDVYQLQEIAKRFGMPYSYFFESEQSLPNVPKVAAWLGLSEETVETLLAMADTEPEDVMDALDDAIYAMATAVSAAGEVDTE

SEQ ID NO: 5322 - protein, 90 aa, Enterococcus faecium
  misc_feature (B) LOCATION 1...90
  hypothetical: YES
GERKETLLKTQHKLLTVKEVVQILVDKEVISEKVAEALFIPRYWTIETPLVEDAPTMLFQDLVKIAGCELHYQENLETYENEYWLTKLEN

SEQ ID NO: 5323 - protein, 561 aa, Enterococcus faecium
  misc_feature (B) LOCATION 1...561
  hypothetical: YES
NRRNHFRTCDMRQRNIDRFIATVILSAFCWLVLMRKPLFYATITKTFEHKKGGKDVYLSSEYLKQFDKDLYYKILLLESFEDQAWHTAAQLAQVVQLDARSVSKYLNELSKNYQQFSGKTHPLFTKNHRSGYNFYDTLDSIEHERFLIYLVQSTLKFQLLHDIFFEEFHTMYQFAQKHYISESTAHRKINEWKQQLQTYGIRLQRGTYIAQGEEEIIRLYLHMTFWQLFRGKIWPFETISQMDVKNMAEHIMAFFNVRLNEIKKRRLEYMLGAFFLRKSQKHYVVLNEKKRRLISDNLLFQRFCQVMEPVFPNYFQVEDELGALFLVLMTREEYYSDPKIRKKIFDFHQQAKTPPFTALSEAKAALSLYQEEQGLPAENLTFEAENYLFSSHFFAYLFPNAKETIDGNSSDFINHLVIENKELKQWLVHFFESRHKHPNHLAFKNHAFLMGRYLTVFKTLGAFTPQLPKITILLMTDFPLFEEQLLEEGLRTFFRNEYQLIFLPTDYRGREVDLLISTSKVHRKPWADLDYFIVTEELKLIDYIQLSQKFEMIQKQKLLKQ

SEQ ID NO: 5324 - protein, 108 aa, Enterococcus faecium
  misc_feature (B) LOCATION 1...108
  hypothetical: YES
GRRKIMSLRGKQKRFLRSKAHHLQPIFQIGKGGINSAMIVQIEEALEKRELIKVSLLQNTDEIAEEAAQVLEKEIDCEIVQIIGRVIVLYKPSTKEKYQRLSKEVKAI

SEQ ID NO: 5325 - protein, 283 aa, Enterococcus faecium
  misc_feature (B) LOCATION 1...283
  hypothetical: YES
LGRKEFMFFANIIKAVILGIIEGITEWLPISSTGHLILADEFIKLDASSQFMSMFNVVIQLGAILAVVVLYFHKLNPFSPSKSTVEKKDTWTLWFKVIVACIPAIIIGLPLDDWLEANFHKFLPVAIVLIVYGIAFIIVEKRNKNKTPRWTSLNDFTYQAALLVGLFQVLALVPGTSRSGATILGSILIGASRFVATEFSFFLGIPVMFGASGLKIVKYLAEGNSFKMEETVVLLVGTFVSFVVSVLAIKFLLSYLKKNDFTAFGWYRIILGIILIGYWFIAM

SEQ ID NO: 5326 - protein, 351 aa, Enterococcus faecium
  misc_feature (B) LOCATION 1...351
  hypothetical: YES
EVRKMLTKRQNDILRLIIQHYTSSGVPVGSKTLMSEGVKASSATIRNDMKALEDEGLLLKTHSSSGRIPSALGYRYYVDHLLKPARVAEDDLLLIRQSLSREFHEINEIIKQSAEILSELTSYTTFSLGPEIKDRRLTGFRIVPLNNRQIIAIVVTDMGNVESQVFTLPEYMGSQELEKMVQIVNDRLVGDPLMTVYHKLRTEIPMILHKYFQTTEGMSQLFDTVLGHVFEDKVYVSGQMNLLDYEPRQDLDQFKSMFSFMKDSDGLTQMITPMDSNIHIKIGAELGNDLLQNMSMIQASYEIDGHGRGTIALLGPTSMPYSRMFGLVDVYRRELAAKLADYYRSLDLSNS

SEQ ID NO: 5327 - protein, 436 aa, Enterococcus faecium
  misc_feature (B) LOCATION 1...436
  hypothetical: YES
KWRNKMAIEAGLVLFFVFVVLLVLGMPIAISIAFSSMMTLLLVIPFDVSAFSSARKMVGSINSFSLIAIPSFVLSGIIMNNGGIANKLLDFAMLFVGRVPGALAHTNVLRNALFGSISSSAIAASTAIGGVLIPQQVEEGYDRKFATAVNIASAPTGMVIPPSTAFIMYSLVAGGASISALFMGGYLVGALWALGIMLVAFIVAKKNKYPVVEKGQMAHAGKIIKEAIPSLLLIVIIIGGILTGIFTAVEASAIAVIYSLLIAMFYYKTVKLKDIPNMLFQSVAMSGTIMFLLATSSMMSFAMAFTGIPQAISSLIMGVTDNKFIILLLVNLVLLLVGMFMDVAPAILIFTPIFLPIVTSVGVDPVHYGLFSIMNLCVGSITPPVGTGLYVGASVGGVKAEAMLKPLLPFYGVILVVLFLITYFPQIVMWLPNMLS

SEQ ID NO: 5328 - protein, 77 aa, Enterococcus faecium
  misc_feature (B) LOCATION 1...77
  hypothetical: YES
FRRKTIMNYISAAIAIMGAAIGAGYGNGQVISKTIESMARQPEMSGQFRTTMFIGVALVEAVPILGVVVALILVFGV

SEQ ID NO: 5329 - protein, 112 aa, Enterococcus faecium
  misc_feature (B) LOCATION 1...112
  hypothetical: YES
LRRNVSMAWMELIIAGILEVFWSTMMKWSDGFSKINYSFYTVIGMIASFYFLSKAIKSLPMSLSYPIWTGIGAVGSVIIGVVLFHDKLNLSTWFFVGMLLISIIGIKITSGH

SEQ ID NO: 5330 - protein, 122 aa, Enterococcus faecium
  misc_feature (B) LOCATION 1...122
  hypothetical: YES
ERRKQMFKGVLFDLDGVITDTAEFHYRAWRKLGQEIGITIDHTFNEQLKGVSREDSLSLLLAYGGKEHSFSKEEFAELAKRKNDYYLEMIQTIEPKDVFPGGRAFTGFFKRRKNQDCSCFCK

SEQ ID NO: 5331 - protein, 508 aa, Enterococcus faecium
  misc_feature (B) LOCATION 1...508
  hypothetical: YES
NGRNWPFRNLSSRDDWLCVFYLVSFFEKRKRGQLNMKKLGWLSMCLFLLLFKPAFTQVATETETEMVQITLHKLLFPNGQLPKNHPNDGQEKALLQTYRGLNGVTFQVYDVTDSFYHLREKGKTVEEAQAEIAKNGASSGMFTAEATTTTLNNEDGIASFSLAAKDQEKRDKAYLFIESKVPEVVKEKAENMVVVLPVHGQNNQKLSTIHLYPKNEENDYPDPPFEKVLEEPRNDFTIGEKITYSLHTTIPVNILDYQKFELSDSADEALTFLPNSLTISSNGEKLTEGFVIHKKPHGFDVLFSIPSLEKYAGKKLTISYQMQLSSTAQANKEINNNGTLDFGFGVSTKKVSVYTGSKQFVKIETNKPDKRLAGAVFLIKNKAGNYLQQTANGYKWTKNESDALHLISDKNGAFSISGLKTGSYRLKEIEAPSGYILSETEIPFTISTFLSEDKEADSILKVVNKKENSRPFLPKTNETKNTLLGVVGMVFASFAIWLFIKKRTGVKK

SEQ ID NO: 5332 - protein, 167 aa, Enterococcus faecium
  misc_feature (B) LOCATION 1...167
  hypothetical: YES
DSGNLLSIGGKRMLRFFPQKNKYIQEKSEFQFNTDGPIPQHIAIIMDGNGRWAQNRRLPRVAGHKEGMETVKKVTKKASRLGVKVLTLYAFSTENWKRPKDEVSFLMQLPVDFFDTFVPELIKENVKVHVMGYENVLPEHTQDAVRRAIEQTKNNTGMVLHFALNYE

SEQ ID NO: 5333 - protein, 91 aa, Enterococcus faecium
  misc_feature (B) LOCATION 1...91
  hypothetical: YES
NGGKVMKREETDKIKWTVALCGTLLLFLYGLFTQNIIINLLVIFFALVIYKYGNHVLFREYDEKRKRKIEESMKIKEATKEILREKSFIKR

SEQ ID NO: 5334 - protein, 379 aa, Enterococcus faecium
  misc_feature (B) LOCATION 1...379
  hypothetical: YES
SCGNPRGKILAAWLARVLGGGTAAKNIANIIVLAILTYVSIVFGELYPKRIALNKSEEVAKFTSGLIRLIGVVAKPFVWLLSASTSLLARITPMTFDDEDSKMTRDEMRYMLENEGVLNNEELEMLQGVFSLDTKVAREVMVPRTDAFMIDINDTVEENVNEVLSENYSRIPVYNEDKDKVVGILHTKNLLKAAHKFGFDNLDIKKIMQEPLFVPETVFIDDLLYEMKKTQNQMAILLDEYGGVVGLATLEDLLEEIVGEIDDESDEVENLYEKIDEHEYIIQGRMLIDEFNEAFDSDLHMSDVDTMAGYLITALGMIPDEGEKLSFDVDNITLVSEEMEGSRILKIRVIFHDPEETEAEPEEERRYFRKEFEDDEPRR

SEQ ID NO: 5335 - protein, 255 aa, Enterococcus faecium
  misc_feature (B) LOCATION 1...255
  hypothetical: YES
RVGKEMNKIVEVQNVTKVYGKNNEKKTQALSGISFDVEKGEFIGIMGASGSGKSTLLNILSTLDKPTDGHIRINQKDVTTLKGNQLADFRANEIGFIFQDFNLLESLTAQENIAVPLSLQGVRPKEIKQRVQKIAERLSISHILESYPSEISGGQKQRVAAARALITQPTILLGDEPTGALDSKSARDLLDTMDELNTKDHVSILLVTHDPFSASYCQRILFIKDGGIHQEVKRGDQSRDSFYREILSILGNLEQ

SEQ ID NO: 5336 - protein, 124 aa, Enterococcus faecium
  misc_feature (B) LOCATION 1...124
  hypothetical: YES
QKGKAEPEAKQKIANAFKEYGEAPVLSMVIDMIPPMMREAAQPLGHIEKISVVDTGSSSGETSGANRVTNYATNLLCYSQETLKATTGLDLKEIVENLSTRGTTSQVNMYEAPKEAEQNSMKEE

SEQ ID NO: 5337 - protein, 176 aa, Enterococcus faecium
  misc_feature (B) LOCATION 1...176
  hypothetical: YES
KEGNVNKMGVVNLARVDERLIHGQVMVTLSQKSGVNSIFVVDEVVAKDKFMRDLYKNAGSRTGQKTIVITPEKAKFYWDEYQFKEYNCILIAKTVQTIYDLVKHGIPMEELNIGGIAQKNPDTDLLVTKSVYLNKSDAEKLKEMNEQYGVKNIYFQATPSAPKTGLKDVLNKFDLS

SEQ ID NO: 5338 - protein, 168 aa, Enterococcus faecium
  misc_feature (B) LOCATION 1...168
  hypothetical: YES
KRGKSMKRALFPGSFDPFTKGHLDTVERAAKLFDEVVIGVFINTSKKSLFPPEERMTLITKAVSHLPNVKVMHQENQLTVETAKEIGADALIRGIRSIKDFEYEREIAQMNHHLYDELETVFLLAKPEYSHVSSSILKEVLHFGGDVSSYLPPVINEALAGKRESNES

SEQ ID NO: 5339 - protein, 244 aa, Enterococcus faecium
  misc_feature (B) LOCATION 1...244
  hypothetical: YES
LGGKNVAIKKYRPTSNVVRNMTGSDFAEITTSTREKSLLQPLKNHVGGNNNGRITVRHQGGGHTRQYRVIDFKRNKDNVVATVQTIEYDPNRSANIALVHYEDGVKAYILAPKGLEVGMKLVSGPEADIKVGNALPLENIPVGTVIHNIEMKPGKGGQLIRSAGTSAQVLGKEGKYVLIRLNSGEVRMILAACRATIGSVGNEQHELINIGKAGRSRWMRKRPTVPGSVMNPYDKPSYTTRCPP

SEQ ID NO: 5340 - protein, 234 aa, Enterococcus faecium
  misc_feature (B) LOCATION 1...234
  hypothetical: YES
KEGKYMDFSGAFSWMNIRFLLEGLKVTVEVSLFSIIFSFLIGGLTGVIRFANIPFFSKILGVVIDIIRNLPLLLIIFFTYFALPQIGIQMNIFWSAVAALTIFESAMLSEIFRAGLNAVPKGQMEAGLSTGLTYVESMRTIVLPQAFKSMIPAIVSQLISLIKDTSLAVIISLPELSHQARIIYGQNTNYVLPMFIIMTLMYFVVCDALSLLSGYLEKRRYSYKYMILLAVVAN

SEQ ID NO: 5341 - protein, 168 aa, Enterococcus faecium
  misc_feature (B) LOCATION 1...168
  hypothetical: YES
ALLFLKKICYSYCKKKTEKVVIAVIVNEELFQLEDQCLQVAEMIKKSKTMASYLEHKQSMEESAKVCQLKEPFLSKKEAFENVPAYGEYAPDYREKKRAVRKAKRQLDMDEHVAAFRYSETQLQSLLDQIVQVLAEEVSNEIKVDAGSPFFETKKHFGCGGNCHAIRQ

SEQ ID NO: 5342 - protein, 70 aa, Enterococcus faecium
  misc_feature (B) LOCATION 1...70
  hypothetical: YES
SNRLCGLRWGSRERGEGKTAFGRADKDERCEALSLRTNDRQSHRLWLYRDFFDGNQSIKAVTHSVKKPRN

SEQ ID NO: 5343 - protein, 61 aa, Enterococcus faecium
  misc_feature (B) LOCATION 1...61
  hypothetical: YES
HRRFQLFPLHQQSNVQLYQNPKKQLLLVQWLLLNQQQLRYYAILRLLLLLPIRSRDECLED

SEQ ID NO: 5344 - protein, 105 aa, Enterococcus faecium
  misc_feature (B) LOCATION 1...105
  hypothetical: YES
SLHLSGSIILEVTANDGLFQKDQCESANKKNTKLCPHDSNRNHFDHSIALDGVYFIETNGRNRSLSSDLFPRKNRMGKLSGYDCRLSFLALCKKYIIHHCASSDR

SEQ ID NO: 5345 - protein, 81 aa, Enterococcus faecium
  misc_feature (B) LOCATION 1...81
  hypothetical: YES
QMHLKIYLSYQEVWRFSMYKLNEIVPVQLGNEKSAPEKGKPAAAKLAMRIKRENGSEVLIYNGINNYILQAILKELLSNAL

SEQ ID NO: 5346 - protein, 81 aa, Enterococcus faecium
  misc_feature (B) LOCATION 1...81
  hypothetical: YES
QMHLKIYLSYQEVWRFSMYKLNEIVPVQLGNEKSAPKKGKPAAAKLAMRIKRKNGSEILIYNGINNYILQAILKKLLSNAL

SEQ ID NO: 5347 - protein, 62 aa, Enterococcus faecium
  misc_feature (B) LOCATION 1...62
  hypothetical: YES
NLFDQSINQCKITKNLSQNVVHSDSDLILHNSSVLIDKEPIFGTNTKQTPVPQRIQGLFIRS

SEQ ID NO: 5348 - protein, 76 aa, Enterococcus faecium
  misc_feature (B) LOCATION 1...76
  hypothetical: YES
NLFDQSINQSKITKNLSQNEVHSDPDLILHNSSVLIDKEPSFSDLNGFFYLFIKIKFHFSMIQSIRPLLHDYVFGH

SEQ ID NO: 5349 - protein, 94 aa, Enterococcus faecium
  misc_feature (B) LOCATION 1...94
  hypothetical: YES
NLFDQSINQCKITKNLSQNVVHSDSDLILHNSSVLIDKEPLFLSKESGITCFLFFQIKLKTISYVLRTHILKRRTVFKIRNLAQTKNCISSFYL

SEQ ID NO: 5350 - protein, 260 aa, Enterococcus faecium
  misc_feature (B) LOCATION 1...260
  hypothetical: YES
WDFDHCRNARRIVFDTYDNQSRPNYSNRRLIKMKKILTMKKVTKTFGSGHTKVSALKAIDFYVKEGEFVSIIGPSGSGKSTFLTISGGLQTPTSGEIVINGHSLTELPEKKRADLRFKEIGFILQSSNLIPFLTVKEQFELVDQVTSKKEDSTKIDSLLQSLDIQSLKNSYPKDLSGGERQRVAIARALYNEPSLILADEPTASLDTDHAYEVVKLLVKEAHEKQKATIMVTHDVRMIQWSDRVYRMEDGYLTEEEKKKE

SEQ ID NO: 5351 - protein, 68 aa, Enterococcus faecium
  misc_feature (B) LOCATION 1...68
  hypothetical: YES
SSFDFKAPILMTISTSSAPLLMASVVSNAFVSGVFAPRGNPITVHTATGSPCNCSFASATHAGLMQTE

SEQ ID NO: 5352 - protein, 451 aa, Enterococcus faecium
  misc_feature (B) LOCATION 1...451
  hypothetical: YES
LMFDFLQKYLMGPMGKIAQLKIVRAVMAAGMASIPFTIVGSMFLVLNILPLPFPFLEGFFNATFFKVSDLYMIVNTMTMGILSIYFAIVFAYELTSIERDEQKLNVNPLTGALLSVFAFFMCIPELIMTDGKISLIASINETETVVNGIRMGSFVERLGTSGIFTAIIMSIIAVELYCMCVKRNWVIKMPDVVPPGVSRSFTALIPTFVIAFVVMIINGLLVALGTDIFKMIAIPFGFVTQLTNTWLGVMVIYFLIHALWIVGIHGANIITSFLTPIVLANMAANAQGANYPLAGEFNSSYVTVGGSGATLGLIIFIAFLAKSDQLKVLGKASLVPGLFNINEPIIFGMPIVYNPYLAVPFFLAPMASATLAYFAIRLEIVKPMLAQMPWPSPVGIGAFVGSGGDWKAAVLAVICAIIAFIIWFPFIKFYDNKLLNEEREKAAELASEKLK

SEQ ID NO: 5353 - protein, 75 aa, Enterococcus faecium
  misc_feature (B) LOCATION 1...75
  hypothetical: YES
SVLDTIADCQKVVPQLHNMEKKNQAQLSEGGIDYVLDIINEPMVLSYAMEQVERLLVCAGKQAMRLIRLGEKIRR

SEQ ID NO: 5354 - protein, 90 aa, Enterococcus faecium
  misc_feature (B) LOCATION 1...90
  hypothetical: YES
CSLDFAKSRSSDLRNSLSCNDLFAAASFVFYSKTASPGHKWKIVIHMLTKFLKKIMFHIKMERLKKRKRLLMRINNDYFFCFSYFKMDHL

SEQ ID NO: 5355 - protein, 282 aa, Enterococcus faecium
  misc_feature (B) LOCATION 1...282
  hypothetical: YES
QILERGEKAPIGLYSGAIKGKNKENVTVFGTTKEAFLLPKLTKGHEFKTKNEIIISQNLADSGYKIGDTIKIGSYDDPLTIVGIFPETYYTVSPVIYASLDTWTALKYGQQPFASEEEQPINGIVIKDSAKISKEKASKGLQLLTIGTFIESIPGYSAQNMTLNAMIYFLFLVVAAVVGIFMYVMTLQKTAIFGVMKAQGIKNFFIAKSLVAQSFIVGVVGVLLALLFAYLTSLILPSAMPFAVFWSQWLLYSGILIIVAMLGGLFSIRTITKVDPITAIGG

SEQ ID NO: 5356 - protein, 170 aa, Enterococcus faecium
  misc_feature (B) LOCATION 1...170
  hypothetical: YES
SRLETIWWYTLLICAGLAVLLIIFGDVFDFDGPLDPMLIIPWLTFTSLFGFLGERLTDQSSLFLFIASGGISIVLVFLLNFYILMPMKHAESTMSSSEKTLEGQVAVVITPIPVRGMGEIQLKSVTGSISRPACFYSPQEQTAERGTKVLIIEIKERICYVMPYESMIKA

SEQ ID NO: 5357 - protein, 106 aa, Enterococcus faecium
  misc_feature (B) LOCATION 1...106
  hypothetical: YES
KQLERGVCMDVSIRGIDPQYVKEIDKKVNKIQERTGKKFSRNDYFLAIIRQDSEIDLIDYKKSEFDLVVEKLLLSNEQMVESISELTSVYERLFNFLISERSDLNK

SEQ ID NO: 5358 - protein, 62 aa, Enterococcus faecium
  misc_feature (B) LOCATION 1...62
  hypothetical: YES
NRIDDFTDGFYLFEKSFFNVNSLSTSYGLILEWGVAKNSVIHFFSIKIASFDLNQRYKAKLR

SEQ ID NO: 5359 - protein, 477 aa, Enterococcus faecium
  misc_feature (B) LOCATION 1...477
  hypothetical: YES
NSIEIGGKKMSSGKIVQVIGPVVDVEFSLDQSLPDINNALVVYKNDENKSKVVLEAALELGDGVIRTIAMESTDGLQRGMEVIDTGKAISVPVGKETLGRVFNVLGDTIDLETPFPEDAERSEIHKKAPAFDELSTSTEILETGIKVIDLLAPYLKGGKVGLFGGAGVGKTVLIQELIHNIAQEHGGISVFTGVGERTREGNDLYYEMKDSGVIEKTAMVFGQMNEPPGARMRVALTGLTIAEYFRDVEGQDVLLFIDNIFRFTQAGSEVSALLGRMPSAVGYQPTLATEMGQLQERITSTKKGSITSIQAIYVPADDYTDPAPATAFAHLDATTNLERKLTEQGIYPAVDPLASSSSALAPEIVGEEHYKVATEVQHVLQRYRELQDIIAILGMDELSDQEKVLVSRARRVQFFLSQNFNVAEQFTGLPGSYVPVEETVKGFREILEGKYDDLPEEAFRSVGRIEDVVEKAKTLGY

SEQ ID NO: 5360 - protein, 402 aa, Enterococcus faecium
  misc_feature (B) LOCATION 1...402
  hypothetical: YES
FFIENRKRGGTMIEFQNVSKIYKGGKVAVQDVNLSFEKGEFICFIGTSGSGKTTTMRMINRMTDPSQGKILIDGKSIQEIDPVELRRQIGYVIQSIGLMPHMTIRENITLVQKLLKVSQEERNKTAEKMIDLVELPREMLDRYPHELSGGQQQRIGVVRALAANQDIILMDEPFGALDPITRDSLQDLVKDLQERLGKTIVFVTHDMDEAIKLASRIAIMSEGRVIQFDTPENILRHPANDFVEELIGEDRLLQAKPNATRVGEVMLNTAITITPEKSLQEAIKLMREKRVDTLLVTDNSNVLKGFIDVETLNKKRGKVSSVGDILNKHVFYVKESAYLRDTLQRILKRGLKYVPVVDEQNKVVGILTRASLVDIVYDVIWGEDPATTDVAESATPEESKEV

SEQ ID NO: 5361 - protein, 82 aa, Enterococcus faecium
  misc_feature (B) LOCATION 1...82
  hypothetical: YES
ELIEYLRNQILSLHYPPDVHIQQNTNIINLIKAFFSALCNLTQLSKKIKSKKRIYTNGKKTYIIFSLYKRNNECSLLAKKRL

SEQ ID NO: 5362 - protein, 226 aa, Enterococcus faecium
  misc_feature (B) LOCATION 1...226
  hypothetical: YES
KLIEIIWYFFLGRVGAVKERYGHLTVVEEITHNGYKKYRCLCDCGNETIVYRSNLLSGRTKSCGCGNYKNRHKYKNLTNKTFGKLVAIKPTKLRSEGTVVWECQCLCGRKKLVSAKRLLKGDVKSCGCLKSKKHHIENKKFGLLTAKYPLDNNCSWKTKWVCHCECGSMCEISYSNLFFGHTQSCGCLKRQETRTCVEGTVIECLTSKLPKNNTSGVKGVYRSKEK

SEQ ID NO: 5363 - protein, 506 aa, Enterococcus faecium
  misc_feature (B) LOCATION 1...506
  hypothetical: YES
GGNLVKKIGFDSEKYIEEQSAYILERVNHYDKLYLEFGGKLVDDKHAKRVLPGFEEDAKIKLLQKLKDQAEILICVYAGDIERNKIRGDYGITYDMDILRLIDELRGYGLLINSVVITRYSGQPATKVFINKLERRNIKVYKHSEIEDYPVNVEKIVSEDGFGKNEYIETTKPIVVVTAPGPGSGKLATCLNQLYHESQKGHAAGYSKFETFPVWNVPLKHPLNIAYEAATVDLKDVNMIDSFHFDAYNKVAVNYNRDVETFPVIKRIIEKITGKESVYQSPTDMGVNRVGFGIVDDTVVQEASKQEIIRRYFQTECDFKKGLIDEEAVNRIKLIMEEVGLRPEDRNVVVPAHDYADKIQAQSPTKDPSAVIAIELPDEVIITGRTSSLMDASAAVILNAVKHLAHIADDIPLLSPLVLETIQGLKSKTLHSSLDALSINEVLIALSISAVTNPIAQVAYDKLAELEGAQAHSTVMVNKNDEQTLKKLGIDITCAPVYPSENLYYQ

SEQ ID NO: 5364 - protein, 63 aa, Enterococcus faecium
  misc_feature (B) LOCATION 1...63
  hypothetical: YES
CKIEKKDREGRVMNHFKGKQFKKDVIIVAVGYYLRYNLSYREVQELLYDRGINVCHTTIYRWV

SEQ ID NO: 5365 - protein, 116 aa, Enterococcus faecium
  misc_feature (B) LOCATION 1...116
  hypothetical: YES
CKIEKKDREDRVMNHFKGKQFKKDVIIVAVGYYLRYNLSYREVQELLYDRGINVCHTTIYRWVQEYSKVLYYLWKKKNRQSFYSWKMDETYIKIKGRWHYLYRAIDADGLTLDIWL

SEQ ID NO: 5366 - protein, 238 aa, Enterococcus faecium
  misc_feature (B) LOCATION 1...238
  hypothetical: YES
CKIEKKDREDRVMNHFKGKQFKKDVIIVAVGYYLRYNLSYREVQELLYDRGINVCHTTIYRWVQEYSKVLYYLWKKKNRQSFYSWKMDETYIKIKGRWHYLYRAIDADGLTLDIWLRKKRDTQAAYAFLKRLHKQFGEPKAIVTDKAPSLGSAFRKLQSVGLYTKTEHRTVKYLNNLIEQDHRPIKRRNKFYQSLRTASSTIKGMETIRGIYKKNRRNGTLFGFSVSTEIKVLMGITA

SEQ ID NO: 5367 - protein, 77 aa, Enterococcus faecium
  misc_feature (B) LOCATION 1...77
  hypothetical: YES
GTIETVTCTSGCFDSDCNTDSENFAYVDVRRAGSFSNRNTACESLSDPNVCYGKKSWGYSRSNPSRNGTRWTSILFI

SEQ ID NO: 5368 - protein, 97 aa, Enterococcus faecium
  misc_feature (B) LOCATION 1...97
  hypothetical: YES
MEIDETCLSNSYKSMNDFFEEMELDSELLYQFYLAFRGQQISFPMKMYDRELVRKRIENMIEQEKTVDIRQLTEVYGFSARWIQKVIKQKERRRVHG

SEQ ID NO: 5369 - protein, 388 aa, Enterococcus faecium
  misc_feature (B) LOCATION 1...388
  hypothetical: YES
RGVEMKIGIDRLSFFIPNLYLDMTELAESRGDDPAKYHIGIGQDQMAVNRANEDIITLGANAASKIVTEKDRELIDMVIVGTESGIDHSKASAVIIHHLLKIQSFARSFEVKEACYGGTAALHMAKEYVKNHPERKVLVIASDIARYGLASGGEVTQGVGAVAMMITQNPRILSIEDDSVFLTEDIYDFWRPDYSEFPVVDGPLSNSTYIESFQKVWNRHKELSGRGLEDYQAIAFHIPYTKMGKKALQSVLDQTDEENQERLMARYEESIRYSRRIGNLYTGSLYLGLTSLLENSKSLQPGDRIGLFSYGSGAVSEFFTGYLEENYQEYLFAQSHQEMLDSRTRITVDEYETIFSETLPEHGECAEYTSDVPFSITKIENDIRYYKI

SEQ ID NO: 5370 - protein, 112 aa, Enterococcus faecium
  misc_feature (B) LOCATION 1...112
  hypothetical: YES
RIVDFGKSNSSDTWPIVYIFFIFSHLFFSLFFFLLTFKLLEGIESKSIRKKRRNNMSILKTFLQKNKGLALLTFVMICLQIAGTLGVPKISSKADRHRYSKWRSLSYKKNWS

SEQ ID NO: 5371 - protein, 473 aa, Enterococcus faecium
  misc_feature (B) LOCATION 1...473
  hypothetical: YES
KNVEKRMKRLYNLKLFDGFALFYLFFIIIVFHQKKIQGVELFMEKFFGLKKNNTNVSTEIMAGVTTFFAMSYILFVNPTILSASGMPFQAVFLATIIASIIGTLVMGLFANVPYAQAPGMGLNAFFTFTVVFGLGYSWQQALAMVFICGLINIFITVTNIRKMIIRAIPESLQHAIGGGIGIFVAYVGIKNAGFLSFSADQSAISSSVVEGGKATNVTINGGIVPALANFDNAPILLAVIGLVLTAILVVKNVRGAILIGIVATTVLGIFMGVVDLSSIDWQTNSLGNSFKELGTTFGAAFGSEGMQSLFSDSSKIPQVLMTIIAFSLSDTFDTIGTFIGTGRRTGIFSKEDEIALEDGRGFKTKMDKALFADAIATSVGAIFGTSNTTTYVESAAGIGAGGRTGLTSVVVAVLFALSSLFSPLIAIVPNQATAPALILVGVMMMASFADIKWLDSGRSSTTLLCIDLYGIVL

SEQ ID NO: 5372 - protein, 195 aa, Enterococcus faecium
  misc_feature (B) LOCATION 1...195
  hypothetical: YES
HRVDTFFFMQKSNCQKIETNINMRGMILMNHIVLFEPLIPANTGNIARTCAATNTPLHLIEPLGFSTDDKHLKRAGLDYWNDVNITYHSNLEAFLTFLGNRKLHLISKFAHKVYSDENFADGEEHFFLFGKETTGLPETFMRENEEKCLRIPMNDEHVRSLNLSNTAAMIVYEALRQQGFPNLELTHHYENDKLD

SEQ ID NO: 5373 - protein, 89 aa, Enterococcus faecium
  misc_feature (B) LOCATION 1...89
  hypothetical: YES
PCSDGSIGAFGSLVTVSIKTSLAVKRAAGYSRLRLYVSFTSALKAVGQFVSAPLLAVVLFQNDAGKAQGGFIGGEVHLAAPDDFFRVNR

SEQ ID NO: 5374 - protein, 140 aa, Enterococcus faecium
  misc_feature (B) LOCATION 1...140
  hypothetical: YES
RIPEHIGSVNNIEYTIRREFRRERMIFFSIGILFLIIGSLFRILPSKGNLPFYGYHSPLAAKTDAHWRLAQKTSGNWFFLMGLLMTLIGYYLKTSGHTNYFLIEMLLLVFPIMPIFIMTEKKLQRYDLETGGNDNEYFND

SEQ ID NO: 5375 - protein, 191 aa, Enterococcus faecium
  misc_feature (B) LOCATION 1...191
  hypothetical: YES
TPPESPNHNPEELVEWCLDETHGVPLEVIDIGTGTGAIAISLKAARKNWHISAVDLSEEALEVAKENAQKEGTKISFYHGDTLGPVMDQQFDVIISNPPYISRNEWELMDESVRSFEPKMALFAENDGLAIYEKIAVEAPSVLKSNGKIFLEIGFRQGEAVKKIFQQAFPDKKVAIKKDLFGNERMIQVYG

SEQ ID NO: 5376 - protein, 83 aa, Enterococcus faecium
  misc_feature (B) LOCATION 1...83
  hypothetical: YES
CYPEGRSINKLRGGSTMADLKGRSKDMKDKVVGEGKEAYGKATDDKSKETEGKAQSLGADIKEKARNLGDEVKDKFSRKDEKK

SEQ ID NO: 5377 - protein, 103 aa, Enterococcus faecium
  misc_feature (B) LOCATION 1...103
  hypothetical: YES
MTPEQVTEELLIAVKDNIYVTWNEEDESIKKMIAKNAVYLQSKVSTTLSFSPESLEYGLLIERCRYDWNRALDEFEQNFASELLGFIQHYALQEYIAGDVNGE

SEQ ID NO: 5378 - protein, 87 aa, Enterococcus faecium
  misc_feature (B) LOCATION 1...87
  hypothetical: YES
HITDPIFILSQGGTTMAQEFSYEIVEEIAILSENNKGWRKELNLVSWNGRPPKFDLRDWAPDHEKMGKGLTLTNEEFEQLQKAIENM

SEQ ID NO: 5379 - protein, 81 aa, Enterococcus faecium
  misc_feature (B) LOCATION 1...81
  hypothetical: YES
KITDLIKGDGGILMENEQLFEVGETYAFKSDLFESPIKGKIEKIYENSVMIRVMKCAVEDNDTAHNLHWQLVVRKSSTIEE

SEQ ID NO: 5380 - protein, 125 aa, Enterococcus faecium
  misc_feature (B) LOCATION 1...125
  hypothetical: YES
LKTDKRRPIIMANYRDRRVGQEILKEVNDILRKKVRDPRVENVTITDVKVTGDLQQATIYYSILSDLASDKKTAQDGLNKASGLIRRELGHNLSIYKTPELFFELDESVVYGNHIDELLRDLNKD

SEQ ID NO: 5381 - protein, 79 aa, Enterococcus faecium
  misc_feature (B) LOCATION 1...79
  hypothetical: YES
MKTEIWNGHIIRFVDINDEWWAVAKDVAEALGLKQVTRAIHSLPKDGVTTTKVIDSLGRTQDVNIINEKKYLPHGIQKP

SEQ ID NO: 5382 - protein, 191 aa, Enterococcus faecium
  misc_feature (B) LOCATION 1...191
  hypothetical: YES
IMTENKATQERTPQERLQEEQEHKEHVHHTKINAAAIADHLLGNMHTLHVKLHQYHWYVKGANFFTLHEKFEELYNENEKWFDKLAERLITSGHKPASTTVEFEKYSMLSEDAVNKYAKAEDMVENIIEDFRSTRDLTIRAIRLAQDEGDDALEDTLIAFKNDLDKNIWMLQAFIGKEALEDDDALDEDED

SEQ ID NO: 5383 - protein, 320 aa, Enterococcus faecium
  misc_feature (B) LOCATION 1...320
  hypothetical: YES
LMTETFQHYTVMLKETVDGLNIKPDGVYVDCTLGGAGHSEYLLSQLSSKGHLYAFDQDQKAIDHAKLRLASYVEQGMVTFIKANFRELEERLSEHVDKVDGILYDLGVSSPQLDEAERGFSYHQDAPLDMRMDQSAPLSAYHVINEYSYHELVKIFFRYGEEKFSKQIAREIERVRKTKPIQTTGELVEIIKQVIPAPARRKGGHPAKRIFQAVRIAVNDELGAEEASLEQAIRLLKVNGRISVITFHSLEDRIVKSMFKEYSTVQDLPPGLPVIPDEFQPELKVITRKPILPSEEELTENNRSRSAKLRIAEKIRMKEE

SEQ ID NO: 5384 - protein, 341 aa, Enterococcus faecium
  misc_feature (B) LOCATION 1...341
  hypothetical: YES
ESDLRQVTIINEAGEQETISYIDLERGKTASYTITAPIPYFIDSVLENGSAVIKNYKITDTPTVGLTYYDQEIEVRAGETILTKGQDYIVEVVSNGFVVTILTEENGVAKVDTLGRLADARGGDLTITYNLKVSTELEADDFHNNTAVIEIGRNDEFDYEEGVEPPEKVTTGGRKFEKYDASSSELLKDARFELWNEDRSEYAIFYKGESPLAVYESGADRIEWATSGQATEFVADGNGYFEVQGLDYGTYQMKETMAPEGYVLPTGEAAFTEFIISYGSYNEEIQIVGVENPGPERVPNMKRGSLPATGGNGLLAFLLIGISLMIGAYSWYRKSKMKSEV

SEQ ID NO: 5385 - protein, 581 aa, Enterococcus faecium
  misc_feature (B) LOCATION 1...581
  hypothetical: YES
PFYDVLVYLKKKESAMEIKKVYFSQKMSLYSPIQQAKQPLPFFQSHQESRDAFWRSAKKQCAFKAVSKKYTVYFTIAKSRGDVIFNNLLIEGETFEWKKFFRYMEACARFFIKENCCFLFQSPLSEEWLRIFHKNGYQGTTQLNKKLVYHTALVLGGGGAHGAYQIGVWQALKEHDINFEIITGTSVGALNGALILQGDMKKAVNLWKKLSTRQVLALPEMAAVEDLRERFYRERRQMTKTALIEGGVSSAPLEKMVKDNLDLSLLKHNPKIRLYTVSTKLPELAEVVTDIQQTKTEEIPDWILASASFYPAMAYRKIGKNKYADGGYRNKIPIDIAINKGATEAFVVDVQGPGPAKKIRMPDIFIHWKCQTLWTLGSFLLFDSQRNQLNLQLGYLEMKKRLGYYYGNWYTFHSVKPARTYWRGFLSYLTKEIQLELSFFKSIKFWQKLRNLYKNRVVPETCGLAMLELLAKKHFLLPNEIYQVDMMIQMICQQDIKSMPDDLLAQIGQLSTEEWRRYRKYQQKIQNERTKTVYFDYLLQGKRKDRLQHELLKQPVDTLLILYLYYLKEEQPWHKNFHMKS

SEQ ID NO: 5386 - protein, 286 aa, Enterococcus faecium
  misc_feature (B) LOCATION 1...286
  hypothetical: YES
QYYEKSFYKNGGIDLMEDQYVQAMTIAGSDSDGSAGMQADMHTFFTRNVYGVSVMTACVAGNSYGIGASVTLPTDFIDKEFELIAKDFQIRAAKTGMLADSKLIETVVKNYQKYDFGPLVVDPVIVTKHGNLLLEESALQSLKEKLVPLAEVLTPNFYEAEKLTGRTLAAEEDFVQAAKELQDMGAKNVMIKGHHAKNAQQETVNDYVLFESGKSFWLNAPFYPTDRINGTGDSLSACIAAELAKGKTVEQAIRLAKDYVNRAIREEINVGHKYGPINHWAAGELE

SEQ ID NO: 5387 - protein, 80 aa, Enterococcus faecium
  misc_feature (B) LOCATION 1...80
  hypothetical: YES
GGYDYSMKSDKYKNRKHTSWKTFREIIGSYLAVVVFLPLLYMAMTEQTRFIGVDTQYIAETGFLFIFILIFAFYKSFHTK

SEQ ID NO: 5388 - protein, 111 aa, Enterococcus faecium
  misc_feature (B) LOCATION 1...111
  hypothetical: YES
SQYEYRNGGKHLDTKEEQLLIDLTSAKGVPGNEEEVREVFREYAKPFADDIFYDGLGSVIAKHGAGGGPKVFISGHMDEVVFMVTKITEKRFLEFQTLGSGWGQVHACSAS

SEQ ID NO: 5389 - protein, 145 aa, Enterococcus faecium
  misc_feature (B) LOCATION 1...145
  hypothetical: YES
HGYDIQFHFCDGLYADVQRPVRQGAGKWRRTENPCYLPAGRVCKPENPQLPAPDFRYPKPGNFRAYRGADAEPVKGCLQRPCGNYHRQLLLRPVFGRQGAQHPERDFGNAGKGNHRPFQYLRHAGKPAQHGGKLPETRKRTDVNR

SEQ ID NO: 5390 - protein, 99 aa, Enterococcus faecium
  misc_feature (B) LOCATION 1...99
  hypothetical: YES
IMYDANREKGMEILENQIDIQEQTNEETKGKSSALVVAATCMIAFMGVGLVDPILKTIAAQLNATPAETTLLFTSYMLVTGVVMLFTGFLSSRIGLKKH

SEQ ID NO: 5391 - protein, 85 aa, Enterococcus faecium
  misc_feature (B) LOCATION 1...85
  hypothetical: YES
KGHENHQQMEISCPFSNGAISESTSEMEKASRMSEINFGVYSCFLGKARNKLIYAIKRDTFQSQYSIETFNEIVFFTIMRIYFVI

SEQ ID NO: 5392 - protein, 120 aa, Enterococcus faecium
  misc_feature (B) LOCATION 1...120
  hypothetical: YES
IFNEHLSMVGLKRKELAGRRFTRIVSVGGGAKNLAWLQIQADIFDATVYCLSVEEGPALGATMIAALGLGWFDTPESCCQNFIQYTDAAEPLLQNVEKYHKIYQQCRKIYPATKEICHDL

SEQ ID NO: 5393 - protein, 244 aa, Enterococcus faecium
  misc_feature (B) LOCATION 1...244
  hypothetical: YES
KNNEVFYMKKLGFILLLVSLFLVGCTSPSKENSDPSATTDKSSIRQTSSAEKSSTQKSASTETNTSSTSSKVSEPNTSSTSSSTVETNISSSTIDTTSSQSSQSIDPLAGYSDLQIEYARVWLAIRGNTFRDTSGDFELHVIHYPAGTPIAPYDAGSAVYPKDVVMLTGKYSYQGVLVYSSNHDGTITSYPVPSHWQMPADQTSYPAFIRETTQEIIDNASVVAIPTGNPNDVKQLIDVTVIDN

SEQ ID NO: 5394 - protein, 114 aa, Enterococcus faecium
  misc_feature (B) LOCATION 1...114
  hypothetical: YES
MDNDRSAKATAKTVRTSPRKARLVIDLIRGKSVADAISILKFTPNKSAGIIEKVLMSAVANAENNFDLDVENLVVSEAFVNEGPTMKRFRPRAKGSASPINKRTSHITVVVSEK

SEQ ID NO: 5395 - protein, 107 aa, Enterococcus faecium
  misc_feature (B) LOCATION 1...107
  hypothetical: YES
NCNEYQMDTERASIYLRITKKRRILPSNGFRGNWLERSFSMTDIAEITQRDREKIKEYVESSKFLTYTMLAERFGISKSYLSLILNGKKTSAEANRIIDSIITMYEL

SEQ ID NO: 5396 - protein, 107 aa, Enterococcus faecium
  misc_feature (B) LOCATION 1...107
  hypothetical: YES
SCNEYQMDTERASVYLQLINRRGLLPSNGFRGNWLERSFSMTDIAEITQRDREKIKEYVESSKFLTYTMLAERFGISKSYLSLILNGKKTSAEANRIIDSIITMYEL

SEQ ID NO: 5397 - protein, 246 aa, Enterococcus faecium
  misc_feature (B) LOCATION 1...246
  hypothetical: YES
RSNDMIPIYICEDDPKQLEVLSTVIKNRIMIENLDSYVHISTSDPEELLNAAKIRTSSFGIYFLDIELEDSEMDGVAIGKLIRELDPLGKIIYVTSHTEMSMKILKSNIEPTDYIVKEDLYDLKENVEHILSKIFEDFQMSQIQKDIFKIEFNDEIKFLPIKDIQYFSTSLGAPHKLEVHLTHAQLQFYEKIKEIEKMHRNFIRCHKSYVINTQNVRSINKKTREVTLANGETIPASIRGLKKLIS

SEQ ID NO: 5398 - protein, 299 aa, Enterococcus faecium
  misc_feature (B) LOCATION 1...299
  hypothetical: YES
IINDRIGGKRMKQKDLFKNGHAFLILPVILISIMVFIPMVLALITSFQSGPPVNMTFNGLGNYQRMLTDATFKKAFFNTFLYLLVQVPIMLFLALFISNLLNDKKLKYKGLFRTAIFLPCITSMVSYSLIMKSLFSQSGLVNNLLLGIGMIDTPIGWLTHPIWARVLIILSITWRWTGYNMIFFLSGMQNIDSEIYEAASIDGASKWQQFIKVTIPNLKPIILFTSITSTIGTLQLFDEVQNITGGGPANATTTLSQYIYNLSYKFTPNFGYAAAVSFVIVSFIVILSIIQTKVGGESR

SEQ ID NO: 5399 - protein, 208 aa, Enterococcus faecium
  misc_feature (B) LOCATION 1...208
  hypothetical: YES
TLNERSFFMRNPKPKEWLAKDYSQNYIADYKPFNFVDGEGVRNSLYVSGCLFACEGCFNKAAQNFRYGKPFTPELEEQIIADLRNDYVQGLTLLGGEPFLNTDVCLQVVRRIRKEFGTTKDIWSWTGYTFDELLQDSEDKLELLSQIDILVDGRFELSKRDLKLQFRGSSNQRIIDVQKSLESNQVVIWEKCTDATETYEQIKKQDLI

SEQ ID NO: 5400 - protein, 375 aa, Enterococcus faecium
  misc_feature (B) LOCATION 1...375
  hypothetical: YES
LINDCRNGGKTMQKRVITLLMIIVGASLGISFLPSAWQAIGQQSNGWLNNTFTNSLLGALIFFLLSLLLAKHISAIIKQVEQKLSEVSLTYLLFGAIGAIIGLTLGVVISTPLYNMEIPFVNSVLPILLMIILGYLGLRMGTTRIEEWKKVFGSRTQKIEQETGSQVESQLLERKSGENFHRNKFLDTSVIIDGRIYDITKTGFLEGTWMIPDFVLYEVRYIADSGDSLKRVRGRRGLDILDALQKEEGISVEMYDGDFEDISEVDSKLIKLAKLLDGVIVTNDYNLNKVSEFQNVPVLNINALANAVKPVVIPGETMNVVVVKAGTERQQGVAYLDDGTMVVVEDGQHYMNERIEVVVTSALQTAAGRMIFAKP

SEQ ID NO: 5401 - protein, 210 aa, Enterococcus faecium
  misc_feature (B) LOCATION 1...210
  hypothetical: YES
EINEMKKYFILLAGSPGTGKTYLMNKLRERFPDMYAITLDEIKEYYAESIGFNNLEERAEQERTKVYPFYYKALDLYMEAGKKVIVSEYPFSDKQKARLQELADRYGYQVITIRLTADFEVLWQRRYKRDRESDRHLSYIMDHYHYGDVLEDRTKGTNHITKEAFKKIIADRKYDKFQLGTLYEFDVTDYTQVDYTPLLDKLEKEINDNK

SEQ ID NO: 5402 - protein, 92 aa, Enterococcus faecium
  misc_feature (B) LOCATION 1...92
  hypothetical: YES
ASNEVNCIQRVILAPDEPLMSMGREEKILRKDVYFRGGFSEAIPGGFQDKKFVGGRDWVGYSHPRGWEQVYKGGGLRKISICGRKKAKKYFC

SEQ ID NO: 5403 - protein, 326 aa, Enterococcus faecium
  misc_feature (B) LOCATION 1...326
  hypothetical: YES
FSNEYNRKKKEEESMKIAIAGAGAMGSRFGLMLHQSGNEVLLIDGWAEHVQQIKEHGLQANFNGKEVEAKLPIVLQSEVEKEDQVDLIILFTKAMQLEKMLQDIQSLIKKDTEVLCLLNGIGHEDIIEKFVPMENIYIGNTMWTAGLEGPGQVKLFGSGSVELQNLGDGKEAAAKKLADKLSESGLNAHFSDNIHYSIYRKACVNGTMNGLCTILDVNMAELGKTSTAHKMVATIVNEFAKVAAVEKIELDVPEVIAHCESCFDPETIGLHYPSMYQDLIKNHRLTEIDYINGAISRKGKKYGVATPYCDFLTELVHAKEDSLNVK

SEQ ID NO: 5404 - protein, 247 aa, Enterococcus faecium
  misc_feature (B) LOCATION 1...247
  hypothetical: YES
FKNENFTSRVSFIYRAEHFFLWTCNGWNGYFNAAITSGLYFCTEIFCSRNSYVWNERVRKMKIVETKLYGQLIVVSDYILLGILWVIVCLPVITIVPATCAVFYVMAQWKGEGSGNIIYFFFQGIKQHFGKNLFLSLLTIIIYFLVNQLLEEQTIVLSISGYVVLLIYSMFLLSWIYVISENKDITFLQIFEQSAWKVFFDFLRNILCCVLLLGFVLLIFLFPPFIFIFAGGVWKLVSIILTIGNER

SEQ ID NO: 5405 - protein, 405 aa, Enterococcus faecium
  misc_feature (B) LOCATION 1...405
  hypothetical: YES
RMNDKNFIEELRQKREEYGVTQRKLAVACGISRTYFNQIENGTVVPSAELKQTIEKQIERFNPQEPLFLLIDYFRVRFPTTDALKIIREVLQLKADYMLYEDFGKYGYESKYVLGDINIMCSMQEHLGVLLELKGRGCRQMESYLLAQERSWYDFMLDCLTAGGKMKRLDLAINDKAGILDIPKLKEKYKAGECISYFRMQKDYSGTEKCGSDLPKNTGETLYLGSTSSELYMCAYQKNYEQYVKNGIEVEDTEIKNRFEIRMKNERAYYAVVDLLTYRDAERTAFSIINHYVRFVDREDDKPKSQWKTNDDWAWFIGENREPIRLTTKPEPYTLQKALHWLQRQVAPTIKMVQALDRENHTTILKDMIEQAELKDKHKHLLQLEKSTIEERIDTAVPQENDGIF

SEQ ID NO: 5406 - protein, 67 aa, Enterococcus faecium
  misc_feature (B) LOCATION 1...67
  hypothetical: YES
LADEGGISLGMSTNKIAQLSLLSAACVAGRIAFQFIPNFQPMTAIFLFIVLYLSLKDALIVILTPLG

SEQ ID NO: 5407 - protein, 119 aa, Enterococcus faecium
  misc_feature (B) LOCATION 1...119
  hypothetical: YES
TSDEKRHFSYQLMIRQPDFVTEAIAQEAIQRSSKLPEELKEQVVFKKMEESLCAQILHVGPYAEETATFEKLEAFIAKESYERASKEHKENYISDPRRSAPEKMKTILRVKIKQREQPE

SEQ ID NO: 5408 - protein, 214 aa, Enterococcus faecium
  misc_feature (B) LOCATION 1...214
  hypothetical: YES
LGDEMKRKRLSIIRILFYMIILTVIGAVLFLGGRTYRSVKRVESYQIEITTAAKNYHMENYENLIKAIILTESKGKGTDLMQSSESLHGEAEIIDNPADSIDQGVKYLAEMIVEAKKQGCDLWTAVQAYNFGKDYIAYVKNHGGENTVELAEAYSKDVLSPLLGNEEGKQYRYWRIQSLLYNGGYLYHNGGNMFYPDIVKMNEKIIETYEKVFK

SEQ ID NO: 5409 - protein, 89 aa, Enterococcus faecium
  misc_feature (B) LOCATION 1...89
  hypothetical: YES
KKDEGNDHINNMSDEKGFFAMAMLIMLITIYKIYMNLPFGDTGAIPLSFLSFHSFNRYKQTKEKDTLVYGIVTGFIGIAFLVWYVIETI

SEQ ID NO: 5410 - protein, 406 aa, Enterococcus faecium
  misc_feature (B) LOCATION 1...406
  hypothetical: YES
WKDDKQMVVGDFAVELDTVVIGAGPGGYVAAIRAAEMGQKVAIIEREYIGGVCLNVGCIPSKALIAAGHHYQESLDSEMFGVTSENVKLDFAKTQEWKENKVVHTLTSGVGFLLKKHKVETIEGEAFFVDDHTLRVIHPDSAQTYSFNNAIIATGSRPIEIPGFKFGGRVLDSTGGLALKEVPKKFVIIGGGVIGAELGGAYANLGAEVTILEGSPQILPTYEKDLVKLVEDDFKKKGVTVVTNAMAKEAVDNGDSVTVKYAVDGKEESVTADYVMVTVGRRPNTDDMGLEQAGVEVGERGLITVDKQGRTNVPNIYAIGDIVPGAALAHKASYEAKIAAEAISGKKVAVDYKAMPAVAFTDPELASVGMTIKEAKDAGIEAKAYKFPFSGNGRALSLGKTEGSSV

SEQ ID NO: 5411 - protein, 154 aa, Enterococcus faecium
  misc_feature (B) LOCATION 1...154
  hypothetical: YES
RWDEMAEILRDIGMIARALDSISNIEFKEVDLTRGQYLYLVRICENPGIIQEKLAEMIKVDRTTTARAIKKLESNGMIERLEDKENKKIKKLYPTKKGAEIYPFIIRENNYSNAVALNGLSDEEAKQLEYLLNKVCKNVSEDWNFVKKGNKRIY

SEQ ID NO: 5412 - protein, 65 aa, Enterococcus faecium
  misc_feature (B) LOCATION 1...65
  hypothetical: YES
RDCDKSRVTVLFFRINDVLLSTPRSQVKIFNKHEKLFFEIVPCDSEMNGRLTTSWKTVFKSLHLR

SEQ ID NO: 5413 - protein, 64 aa, Enterococcus faecium
  misc_feature (B) LOCATION 1...64
  hypothetical: YES
RSCDFVAALFIFIENIVSFSSLTQDKKYDRIKKQFLAEKRHFNDGKFEPDDHSACTKRTFRLSS

SEQ ID NO: 5414 - protein, 250 aa, Enterococcus faecium
  misc_feature (B) LOCATION 1...250
  hypothetical: YES
KGCEKMTDCIHSIIDGFPDYLHKLALAERPTIPSPKRQRVETSVLGRLGGLVQDYSFEDMSFTLHYNYLEDVEDHQAFKQSFYIMRHWLNYAKKLEFSDDPNVYYVIQTIDIGDAENDIVEWGEFDVNITAKPFARVQEDVPITVDKPQSFNLLNNSLEESFPKIIITPSATSCQFILNDYVFSFEGLVAGTDVVIDSDLMLCYEEQSDGDILDRSNKMKTMQYPTLQVDINHFNCTGLSKIQIYRNGLR

SEQ ID NO: 5415 - protein, 89 aa, Enterococcus faecium
  misc_feature (B) LOCATION 1...89
  hypothetical: YES
KECDNMGKELKVRKIGNSVGVILPSSLGLKSGDTIQAKQEGNLFILDTTQIAKEHDRKLIEESFQDFEKGLTVSEIEMVKAFGKYGWSE

SEQ ID NO: 5416 - protein, 109 aa, Enterococcus faecium
  misc_feature (B) LOCATION 1...109
  hypothetical: YES
YTSDRIFSGGDLVSITVNILYTSTNGQARKFAEEMVERNIVKAIRAEEGNEKYDYYFPLEDPESLLLIDRWKDEEAIEKHHKSEMMAQINELRKKYKLKMKVERFTDLP

SEQ ID NO: 5417 - protein, 99 aa, Enterococcus faecium
  misc_feature (B) LOCATION 1...99
  hypothetical: YES
LFSEYLEYRFPASTVSSTSPVASATVPTKLNRTIRVSMLIKTIPTIRKSFFFIPSLHSLLNRWTGIKGMEEFFKDWMYLNHAYPTIQILHQALAIFQIS

SEQ ID NO: 5418 - protein, 283 aa, Enterococcus faecium
  misc_feature (B) LOCATION 1...283
  hypothetical: YES
SSSELSYRYVERPLARFDYGRTFQVMKGWFSKPIISKSKPWVVPGTLLVAIALVGFVTAPKNAVTADQKQLQAKIAESKKLAEETRNNSENTTSSVDQAILDKYELSKAQGNKAQKLELTAFGDSVMLDAATDLQELYPKVVVDGDVGRQLYASVPYIEKLKEQDLLKDTVLIGLGTNGSFSEAQFDSVMDAIGDRKVYWVNVRVPTKRWQNDVNAMLEQMTKKYDNMTLIDWYSYSNDHSDWFYDDQVHPNPEGMTHYIHLVSEALLGGSSSTNSSETNVTE

SEQ ID NO: 5419 - protein, 238 aa, Enterococcus faecium
  misc_feature (B) LOCATION 1...238
  hypothetical: YES
MNSDMTQIMGEFIGTLILVLLGDGVCAAVNLNKSKAQASGWIVIAFGWGLAVTMAVYISGFMGPAHLNPAVSLAMAMTGAISWNLVVPFIIAQVLGAFAGAILVWLSYLPHWNATKDESAILGTFATGPAIRNYPANVITELIGTFVLVLGLLAFGQNEFAPGTNVFAVGGLILAIGLSLGGPTGYAINPARDFGPRLAHAVLPIANKGTSDWAYSWVPIAGPMIGAIIAVGVYSLMV

SEQ ID NO: 5420 - protein, 240 aa, Enterococcus faecium
  misc_feature (B) LOCATION 1...240
  hypothetical: YES
MLSDAHCHLDGSQSLALLQQEHTILTIINCDSPEEWKENRQLAASKTQALSYGIHPWKADSYTFEQVEPFLKKARIIGEIGLDNIWTNVPMTTQKKVFERQLAFAAINEKPVVLHTKGCEKEILNYIQAYPNHYLIHWYSSLDYQQDYIDLGCYFSIGLDLKKNPAVWQLAKAVPIDHLLIETDGLHAAEWALGGIFSEKDYVSLLEEQLKTIAEIKELSVEEVKKNTYQNLERFIRLGK

SEQ ID NO: 5421 - protein, 348 aa, Enterococcus faecium
  misc_feature (B) LOCATION 1...348
  hypothetical: YES
KVSDDMFTTEDFDLDLPEELIAQTPLKDRDHSRLLVLDRKTGEMEDKHFHEIIEELQPGDALVMNNTRVLPARLYGEKPDTGAHLEVLLLTNTQGDTWETLIKPAKRAKVGTRISFGDGRLQAVVKEELEHGGRIIDFEYEGIFLEILESLGEMPLPPYIKERLEDPDRYQTVYAKENGSAAAPTAGLHFTKELLDEIEAKGVELVYLTLHVGLGTFRPVSVDKIEEHHMHSEFYRLTEEAAERLNQVRKNGGKIVAVGTTSIRTLETIGTKFNGEIKADSGWTDIFITPGYEFKVVEAFSTNFHLPKSTLVMLVSAFAGRELTLSAYQHAIEERYRFFSFGDAMFVK

SEQ ID NO: 5422 - protein, 247 aa, Enterococcus faecium
  misc_feature (B) LOCATION 1...247
  hypothetical: YES
MTSDTLDLTTRQRDTTDYRANNSDPFIVLNDADLELAVKAAVAGRYQNTGQVCAAAKRFIIEEGIASAFTERFVAAAAALKMGDPRDEENALGPMARFDLRDELHHQVEKTLAQGARLLLGGEKMAGAGNYYPPTVLANVTPEMTAFREEMFGPVAAITIAKDAEHALELANDSEFGLSATIFTTDETQARQMAARLECGGVFINGYCASDARVAFGGVKKSGFGRELSHFGLHEFCNIQTVWKDRI

SEQ ID NO: 5423 - protein, 346 aa, Enterococcus faecium
  misc_feature (B) LOCATION 1...346
  hypothetical: YES
CRSDQSMFKDKILLITGGTGSFGNAVMKRFLDSDIKEIRIFSRDEKKQDDMRKKYNNDKLKFYIGDVRDINSVKNAMYGVDYVFHAAALKQVPSCEFFPMEAVKTNIIGTDNVVTAAIEMGIQKVICLSTDKAAYPINAMGISKAMMEKVFVAKARTVTDERTMICGTRYGNVMASRGSVIPLFIDQIKSGKPLTVTDPGMTRFLMSLEEAVELVVFAFQNAKAGDIMVQKSPASTVGDLAQAIKELFHADNEIHIIGTRHGEKRYETLLTKEEYLVAQDMGDFYRVPADTRDLNYDKYFVEGSKELTQEGEYNSDNTQRLSVEQIKERLLELEYVRKELKEWQNQ

SEQ ID NO: 5424 - protein, 304 aa, Enterococcus faecium
  misc_feature (B) LOCATION 1...304
  hypothetical: YES
RRSEEMLEVKDLVKTFGNYTAVDHVSFQIPDGKIMGLIGQNGAGKTTTFRLILDFLTQDQGEVLWNGHHLGEKDYDVIGYLPEERGLYPKVTIQDQLLYFAELRGKSRKEIEPKIDFWMEKFQVKGKKTDKVKSLSKGNQQKVQLIATLIHEPKLIILDEPFSGLDPVNAELLKDGILELKKHGSCVIFSSHNMDNVEKICDHLIMLRNGKMVLNGKVHEIRESFGRTKLFLESGLSQQEIEEIEGVKKVILHEDNTLEITLEDPEAGKEIFTRATQFGYIPMFNQQPPTLEEIFKLKAGEIDA

SEQ ID NO: 5425 - protein, 331 aa, Enterococcus faecium
  misc_feature (B) LOCATION 1...331
  hypothetical: YES
MYGDIKIVRGNGGYGGPLIIRPTKDKHKFIYVTGGGERPMIVNKIKELTGMESINGFKTSIPDSEIALAIVDCGGTLKCGIYPKKRIPTINIVSTGKSGPLAQYITEDIYVSAVGLEQIQPLMETDDNQETVNTASPDKKYKYDTSKKITEQKAEQQNWIAKIGMGAGKVVATFNQSAREAVDTMIRTVIPFMAFVSLLIGVIQGSGIGNVFANIMAPLAGNAVGLTIIGFICSLPFLSPLLGPGAVISQVIGTLIGVEIGKGNIPPQLALPALFAINTQNACDFIPVGLGLEEAKAETVEVGVPSVLYSRFLNGIPRVIIAWVASFGLYS

SEQ ID NO: 5426 - protein, 326 aa, Enterococcus faecium
  misc_feature (B) LOCATION 1...326
  hypothetical: YES
NDGDIMTDNSKTRVVVGMSGGVDSSVTALLLKEQGYDVIGIFMKNWDDTDENGVCTATEDYKDVAKVAAQIGIPYYSVNFEKEYWDRVFEYFLAEYRAGRTPNPDVMCNKEIKFKAFLDYAMDLGADYVATGHYAQVTRDENGVVHMLRGVDNNKDQTYFLSQLSQEQLSKTMFPLGGMEKSEVRAIAERAGLATAKKKDSTGICFIGEKNFKQFLSNYLPAKKGNMVTLDGEVKGQHAGLMYYTIGQRQGLGIGGGGDSQEPWFVVGKDLATNTLYVGQGFHHPALYATSLDASEIHFTTNEPMPKEFKCTAKFRYRQQDVRVPC

SEQ ID NO: 5427 - protein, 733 aa, Enterococcus faecium
  misc_feature (B) LOCATION 1...733
  hypothetical: YES
SSGDLMAAAETKMDTFVITGMTCANCSARIEKELNGQPGVVNATVNLATEKASVKYEGTTTEKLIQSVENIGYGAILYDEAHKQKIAEEKQVYLKKMLFDLVLSTILTLPLMLSMIAMMLGSQAAIVHFFHLPIVQLVLSTPVQFYVGARFYKGAYHAIKTKAPNMDVLVAIGTSAAFALSIYNGFFRGHPQDLYFESSSMIITLILLGKYLEHTAKTKTGNAIKQLMSLQTKTAQVIRNGKEETLAIEEVFVGDQLVIRPGEQIPADGRIISGSSAIDESMLTGESLPVEKNPDDTLFGGTINTNGLLHMAVTQVGKQTVLAQIIQMVEDAQGSKAPIQKIADRISGIFVPIVLVIAFITLVATGLITGDWQLALIHSVSVLVIACPCALGLATPTAIMVGTGVGARNGILIKGGEALEAAAHLDSIVLDKTGTITEGKPKVTDLVGSKEVLSIFYTLEQASEHPLGKAIVEYGKLQEAATYDMIDFTAHPGAGISGTINGVRYFAGTRKRLIELNLSFDEYQEHALELEQQGKTVMFLADEKQVIGLIAVADQIKQEAKQAIKQLQDKGLDVFMLTGDNKLAAETIGKQVGIDPMHIFAEVLPEDKAAYVEKLQKDGKKVGMAGDGINDAPALALADVGMAMGSGTDIAMETADVTLMNSSLASIAQTIELSRMTLRKIKQNLFWAFVYNTIGIPFAALGFLNPIIAGGAMAFSSVSVLLNSLSLNRHMKK

SEQ ID NO: 5428 - protein, 74 aa, Enterococcus faecium
  misc_feature (B) LOCATION 1...74
  hypothetical: YES
IIGEVIFQELTLAERLIAIVVGSIIYQLLILVVIKLGFDTTYLKLFSAIILAICLMIPQLKKALNLKTGFEKEA

SEQ ID NO: 5429 - protein, 795 aa, Enterococcus faecium
  misc_feature (B) LOCATION 1...795
  hypothetical: YES
KGGERMIIGGIFSGIADWWSGLFGDGDADPKTVTKVLQDYGNYLQYQDVFSWICNTFLWGLIKGLYNLNTLLEKTIYQSFDLKDLLNAAGVNELFQSLISKVLALFCVVTLIYLGLKFFMSKHPPKIKNILVNLFMAMILIFGGSSLIDEGLNISKNFYGDVTAANKADKTGSPAFQIIQNNVIDVSTLLENDPNKVEHIPTDKRNALTAKNFKTANINGIITPDQAKKMSESSDISTVQKDRLKALQYRLELDDNGKEIPVQISDEGLAKYVYTSGYRRYISSPGIILAGESSLSVAYLFILFTIVTCIIELVFKKFYLVIAASTDFETGQRMKSAIEDISQSFLLLAFTILELRIYTLMLSGIGDLHAAGKINGFLYVVALIVLTIALFKGSQSVTKIFGVDTSLKNGSNSLLSMFALGNVAKNVGSGAKNLASAGKSGLSNLNDIRKNGFGNRKDVTPDNGEEQSDDKATTVPNSKKTVSEMFGKAKNGVSKAAEGLGYVNERGLKGTAEDLTEKAKDTLEEKLDGTRAKELAEAVKNPSETLEKQKEKASEIKEGLKDAYGEGQVNAAVKANTTTEKENQEGAAIPSAKDHQDELHSNENSEEGQNGQLPKTDPEQYRYKSNINSENEKRISDLPKRNQEVQTDDDSIDLPNDNGVEVGTEKSTKIGLPKAQNLPMKDSRLNQFKENDQSFVHQSTAGNVQMKPSRLPENGNLTTVSYNLSESGETGNASVQNVVTREAAPEPIQRVHTGYKPANVAFTAPTKINVTRETKNRNNELKEQLLRDIKQDIKP

SEQ ID NO: 5430 - protein, 197 aa, Enterococcus faecium
  misc_feature (B) LOCATION 1...197
  hypothetical: YES
LPGEADSGELIPVTVVEATPNVVLQVKTMETDGYEAIQVGYQDMREVLSNKPAKGHVAKANTAPKRFIREFKNVELGEYEVGKEITVDVFQAGDIIDVTGTTKGKGFQGVIKRHGQSRGPMAHGSRYHRRPGSMGPVAPNRVFKNKRLAGRMGGNRVTIQNLEVVRVDAERNVILIKGNVPGAKKSLITIKSAVKAK

SEQ ID NO: 5431 - protein, 87 aa, Enterococcus faecium
  misc_feature (B) LOCATION 1...87
  hypothetical: YES
RPFEIIWRVGMVQIKTTTILIYLLAIQELSKRKKKLKNNDLAKVLSVSPASVSEMLAKLRYEDYLDIGFQLTDKGKKFIDDYKKGFK

SEQ ID NO: 5432 - protein, 81 aa, Enterococcus faecium
  misc_feature (B) LOCATION 1...81
  hypothetical: YES
RFFDGDYCKCRSRFSWISTWSSIIRFLGTKYCRNGNRAIIDWCHHFSTNRIILCSKTVKRLLKRGREKAVLHQVIRTAKQK

SEQ ID NO: 5433 - protein, 66 aa, Enterococcus faecium
  misc_feature (B) LOCATION 1...66
  hypothetical: YES
RKFDGLCNEYHCWTSRFKYWTSDFRRMGTKSCRYGTYSIYFRRSDFGSSCLIFLWKTIISFYKIVN

SEQ ID NO: 5434 - protein, 241 aa, Enterococcus faecium
  misc_feature (B) LOCATION 1...241
  hypothetical: YES
GSIEKISIKGMWKMDNQLTKELKENYNIVFHDLNLLEQAFTHSSYVNEHRNLQLSDNERLEFLGDAVLELMVSQYLFRLYPHLPEGKLTKTRAAIVREDSLSKFAKECHFDQYVLLGKGEENSGGRTRPALLCDLFEAFLGALYLDQGFDTTHAFIEKVIFPKVKAGAFSHEMDHKTKLQEVLQKSGDVSIEYRLINEEGPAHERVFWIEVYVDDQLIGTGQGKSKKLAEQAAAENALAAL

SEQ ID NO: 5435 - protein, 81 aa, Enterococcus faecium
  misc_feature (B) LOCATION 1...81
  hypothetical: YES
MSIEEAILLDTLRCRLNFLRTGRSLSQVAVSSALSIPLFKYRKYEEGEEIPSIIELIYIADFYDISVDYLIGRSETASKLK

SEQ ID NO: 5436 - protein, 153 aa, Enterococcus faecium
  misc_feature (B) LOCATION 1...153
  hypothetical: YES
KQIETTDKSEVKPMRKYLIATHGELAKGFQSSLNILADKGNDFQVINAYIIDEDYTPAIDEFIASVQPEEQGFIFTDLFGGSVNQKAFTELMNAKKDNIVIITNANLAVILSVLFLGGDEALSLEQIQQAVSESQVQVVPTQIADEDDDSIFD

SEQ ID NO: 5437 - protein, 417 aa, Enterococcus faecium
  misc_feature (B) LOCATION 1...417
  hypothetical: YES
KMIDKVQKIAAKISNQRHLLALRDSMAAVMPLIIIGSFFMLLANFPIEGFTKWLSEIGVQSFLNKASDSTFGIIGLAVTYSLGHNLAKTYGVDSLSAGLLSLSGYVLLTPLLDADGSIGFPTKYFGTSGLFVGIIVALVSTEIFRWFVLKNITIKMPASVPPNVSRAFVAIIPGFFVVLLWFIVVVICYKLGIENVHALIADTLAKPLSLLTKTLPGIILVILIQCFFWMFGIHGAQVTGPIIEPLLLQNSDVNRIAYQAGKELPNIITYEFLYNFVFSGGAGCLFALAILTFFFSKSQENKTLGKLSIAPVSFQVAEPLLFGFPTILNIKMLIPFVTAPVVTTLITYFSMSMGLVAKPVGATIPWTTPPIIAGFLASGGRISGAVIQVITIAINVLIYYPFFKLDDNAKLKSEKND

SEQ ID NO: 5438 - protein, 312 aa, Enterococcus faecium
  misc_feature (B) LOCATION 1...312
  hypothetical: YES
AFVDWLSYPLFISKKRGGTTMSRMDRYKDIHKKAKPLKRDTGSIFARRERKRTRMENEEDATRIYEREQHSFEHLNQYEQQIYRDAPRAEEQQKNKKFFNRQKKNKPLKPRRKRSWKKIILSILLVLILYSGISFFIGKYVAEHDTSLEAATSETFHGQKATNGAHNILILGSDTRGEDAGRADTIMVLQLDGPSHKPKLISFMRDSFVTIPGVGQNKINSAYAYGGADLVRQTLVENFGIDCQYYAKVDFKSFEKVIDALFMNGVKIDAEKDLNLDGVDIKKGVQKMDGHVLLQYARFQNGRTRHFIFTKG

SEQ ID NO: 5439 - protein, 85 aa, Enterococcus faecium
  misc_feature (B) LOCATION 1...85
  hypothetical: YES
LDVDQRNKFETYTIPGERGTGMICLNGAAARCVSTGDKIILMAYCELNENEVKDHRPKVVFVDDNNKVERVTSYEKHGRLSDIIL

SEQ ID NO: 5440 - protein, 257 aa, Enterococcus faecium
  misc_feature (B) LOCATION 1...257
  hypothetical: YES
HLCLQTAKMSYLFKWHKPSKKNQQAIIEANHKDLEKAVEHNISETMQDRLQLTPERINAMATEIEKIASLDDPIGKVDEMWTNTDGLRIGKKRVPLGVTGIIYESRPNVTTDAASLAFKSGNAVILRGGKEAFFSNQLLVQLLQQVLVSAGESPYAIQFVDDTSHETAGQLMRLTEYLDVLIPRGGAKLIQRVKEQATVPIIETGTGNNHVYIDKEAQLSMAVNIIVNAKASRPSVCNAAETLLIHSEIAPFFLASY

SEQ ID NO: 5441 - protein, 62 aa, Enterococcus faecium
  misc_feature (B) LOCATION 1...62
  hypothetical: YES
FRCLGLYWTIQLEDFLLSSEEKCKLTELYEKKDNYVVANRFINFFKFMFIYVSEFFLFNGLV

SEQ ID NO: 5442 - protein, 319 aa, Enterococcus faecium
  misc_feature (B) LOCATION 1...319
  hypothetical: YES
KTTEMFGKIGSLVKNCLNKFSFTKLRRNFIMPVVSGAEFLKAARKGGYAVGGFNTNNLEWTQAILEAAEAKQAPVLIQTSMGAAKYMGGYKICKDLITDLVEAMNITVPVAIHLDHGDYEAALECIELGYTSVMFDGSHLPFEENLKLAKDVVEKAHAKGISVECEVGSIGGEEDGIIGNGELADIEECKQMVATGIDYLACGIGNIHGQYPENWKGLAFDHLQAIADAVGPDMPLVLHGGSGIPQDQIEKAISMGISKVNVNTEFQLSFAAATRKYIEAGKDKEGKGFDPRKLLAPGKAAIVEDAKSHIDWFGSANKA

SEQ ID NO: 5443 - protein, 80 aa, Enterococcus faecium
  misc_feature (B) LOCATION 1...80
  hypothetical: YES
LNTEKLAFEHRLFGTRGCDTSFVTTPLSLFIIILVGTHHIVFAFLSIPYHSQPCPKRLSISVMFHLDQQSLYSIHLNIDS

SEQ ID NO: 5444 - protein, 270 aa, Enterococcus faecium
  misc_feature (B) LOCATION 1...270
  hypothetical: YES
PNTDRRSLQDCGVFSSAEYHSVGLSGGKDSSALLLLMLEKGMPIDSVIFADTGMDFPEMAAHIAKLDALLYRERGIHITTLRHPHGFEWLMFDEPKRKPSCLKNRARLGVPPYGNGWPGIKVRWCTGQLKTHLITKEVNRLKKEKNALHYIGIAADEAKRCKDAPNHRYPLVEWGVTEAQALQICYDRGFDFGGLYKIYHRASCWCCPLQRIGELRKLRQHHPELWARLWDMDNRARAQFGAGPLGQFKERWSIEQLDARFSREEKEERA

SEQ ID NO: 5445 - protein, 60 aa, Enterococcus faecium
  misc_feature (B) LOCATION 1...60
  hypothetical: YES
ANTESQLNEHRLVERLSLKHCLFANKGTVTKVVSQLPFFFRINGVQKLASAVISLTKRKI

SEQ ID NO: 5446 - protein, 103 aa, Enterococcus faecium
  misc_feature (B) LOCATION 1...103
  hypothetical: YES
LVTEELAGEHRLFEKRTVTMYRLPKVRPKNLTFGGRYTRFLSQSLCVSFHINNYLLCTIYFISVILMLFAKFFTSAGITFPTSDCCAFDMPQAIAYLTHSFKG

SEQ ID NO: 5447 - protein, 136 aa, Enterococcus faecium
  misc_feature (B) LOCATION 1...136
  hypothetical: YES
LVTEELAGEHRLFEKRNCDKTFVTVPSFFCYAILDVKNRRNKMREIYSFESKIYASEVGKGGAYIIFPYDIRKEFGAGRVKVQATFDNVPYEGSIVNMGVKNPDGSVCYILGLRKDIRKNIGKEIGDIVAVTVKQK

SEQ ID NO: 5448 - protein, 477 aa, Enterococcus faecium
  misc_feature (B) LOCATION 1...477
  hypothetical: YES
ATYENICEVLDWIKKSKPYVMSVIYCKGCDAMNGDITRKQRSRFFATNVAAFAFIFFLLGFITLQILNQSAYRETDLSLEKINFDSRTVQLEIQRYQQGDPFLNPTQTEQNRTNMEQPLMEPSNDRFNTQVILWSKNGEILNKAAIGGRFNQIKELKMDTKNLNTIQNIELNEDSGSSALSFRSITKKAETNQDGVAYIQILENTNQIKNSLATFRTIMILCMIVFWILSIGISYYLSSLSMRPIILSWRRQKEFVENASHELRTPLTIIQNSLEHLFTKPNHTIIEESESIAQALSETRRLTGLTSDLLTIARNDSDQQLLSKQMINTQEYIEQLVKPFQEMAIIDGKEFILHNDATLEVPIDEKKIHQVLVILLDNALKYTNPEDKIILDSSVNHKEWLIHVKNTGPSISEEDQARIFDRFYREDQSRAKETGGYGLGLAIAKQVIEQHHGQISVSNYLPQGVDFKVQLPLKPKK

SEQ ID NO: 5449 - protein, 111 aa, Enterococcus faecium
  misc_feature (B) LOCATION 1...111
  hypothetical: YES
NIYDSANQIEREIRELPEFKALKEAYEKVQANEEAHKLFKDFQAMQIELQEKQMSGQEFSDEDAMKAQEMAVKIQSEEVINDLMQKEQGFSTIINDLNRIIMTPVRDLYSE

SEQ ID NO: 5450 - protein, 169 aa, Enterococcus faecium
  misc_feature (B) LOCATION 1...169
  hypothetical: YES
RRYDETTDARAFVRWHYDKKRNCIYAIDELYEVKCSNRRAAQWIKSNKYHYQDIIAEVEPKSNAEMRNEHDISKIRQVTKGPDSVEYGEKWLDDLDAIYIDPIRTPNIAKEFENIDYQTDRDGNPKPRLEDKDNHTIDATRYAFNDDMRKQPEPVNVKKTIDTFKKLGL

SEQ ID NO: 5451 - protein, 61 aa, Enterococcus faecium
  misc_feature (B) LOCATION 1...61
  hypothetical: YES
LTHDRTFSLEKKSVALEKQDKIDRAILNPVPFPQKSHSYFYKSYSNKFHQSPSTHPLLFFT

SEQ ID NO: 5452 - protein, 95 aa, Enterococcus faecium
  misc_feature (B) LOCATION 1...95
  hypothetical: YES
LCNESGKSRKFFEMVNEIPANQQARETAKAKNDELTTAVIEQYETAQAMPNIPEMGEVWTGAENLMFDAASGSKTPKESADEAVKTISEAIEQKY

SEQ ID NO: 5453 - protein, 126 aa, Enterococcus faecium
  misc_feature (B) LOCATION 1...126
  hypothetical: YES
QMRLVSLQKQVIWRKFIRKQVSDMVKKAFCMKVYPEKQEEYKKRHDELWPEMRTALREHGVIDYSIYLDPSTSLLFGYLVIEDEKLWEKMANTSINQKWWKYMEDIMETNPDASPVSWELMPVFEL

SEQ ID NO: 5454 - protein, 402 aa, Enterococcus faecium
  misc_feature (B) LOCATION 1...402
  hypothetical: YES
SFNEKESHMSKTIAINAGSSSLKWQLYQMPEETVVAKGIVERIGLQDSIFTIKYGDNQKFEQIMDIENHEVAVKMLLDQLIELQILSSYDEITGVGHRVVHGGETYGDSVVIDEKVMDRIAELAEFAPLHNPANLMGIKAFKKILPDILSVAVFDTSFHSTMPKQNYLYSLPVSYYEDFKVRKYGFHGTSHRYVSERAAKLLNKPIEELKIITCHLGNGVSITAVDGGKSMDTSMGFTPLAGVTMGTRSGDIDPAVLPYLMEKLEIDIDEMINVLNKKSGLLGLTGLSSDMRDLEKNYEKEHIRLAYDIFVDRIRKYIGGYVTTMNGVDAIVFTAGIGENDGHVRSEIIKGMSWFGCEIDPALNELRGEEVDISTKESKVRVLVIPTDEELMIARDVERLRG

SEQ ID NO: 5455 - protein, 67 aa, Enterococcus faecium
  misc_feature (B) LOCATION 1...67
  hypothetical: YES
IVNESSLSINEWVIDCFCLEPCFELNGRFSVYNRKTRCVQKEEGQAMDEFVQQSAVKDSRRSAHNDW

SEQ ID NO: 5456 - protein, 119 aa, Enterococcus faecium
  misc_feature (B) LOCATION 1...119
  hypothetical: YES
VSNDVITRRILVSKRKERKDLLETAIEVLEKCAQLVTASEEWGYESVTMEKEEIEMGMLPEDVHLPRLVMTHLYIYCAPEDGKDYVVYFITDITSQREFVRGLLVEGRLVWSQIGGTDE

SEQ ID NO: 5457 - protein, 422 aa, Enterococcus faecium
  misc_feature (B) LOCATION 1...422
  hypothetical: YES
DGNELSKEEIEYIVTNYTNGKIPDYQVSALLMAIFYQDMTNEEITNLTLAIANSGDVIDLSSLEGIKVDKHSTGGVGDTTTLILAPLVASVGVTVAKMSGRGLGYTGGTLDKLEAIPGFQIELSDEEFVRIVNESKVAVIGQSGNLAPADKKLYALRDVTATVDSLPLIASSIMSKKIAAGADAIVLDVTTGDGAFMKNIEDARRLAKTMTSIGKLANRETVAVISDMSEPLGEAIGNSLEVVEAIETLQGNGPEDLVEMCYALGSQMVVLAGKAKTTDEARTLLQEALESGKALAKFKEMIQNQGGDPAIVEHPERILTARYTMELPAKQSGVVSKIVANELGIAAMMLGAGRKTKEEDIDHAVGLKLHKKIGDTVTKGESLLTIYSNDEEITSVIELLYKNIEIGESAMKPTLIHDIITE

SEQ ID NO: 5458 - protein, 179 aa, Enterococcus faecium
  misc_feature (B) LOCATION 1...179
  hypothetical: YES
MNRLKEKYLKEVTPSLMEKFNYSSVMQTPKVEKIVINMGVGDAVSNAKNLDKAVEELTLITGQKPMITKAKKSIAGFRLREGMPIGAKVTLRGERMYEFLDKLVSVSLPRVRDFHGVSKKAFDGRGNYTLGIKEQLIFPEVDYDLVDKVRGMDIVIVTTANSDEESRELLTQLGMPFQK

SEQ ID NO: 5459 - protein, 424 aa, Enterococcus faecium
  misc_feature (B) LOCATION 1...424
  hypothetical: YES
MIDDIFAINLYHFPFIPAFVYNEVIDKGGKRVKKETDTTNRLIRFLGGKTSYYVLGIVILLALIIYFFHQISFIFKPVGIIIATILPPLLFALILYYLLEPVIKRLSKHLSRNLSVIIVYVIILFLLGLGSIWLIPFLEEQAKTLISSLPDLFQDFQESLRQFLEKTPFADSFNQFFASIDDVTSDIAGFIGNYWESGAQRISNIFSTVTAIFITLFTGPIVAFFLLRDPQKFYQSVLAIVPPAFRTDFKNLTKIANQQLGSFLKGQIIASFILGAVYWVCFLLIGLEFASVLAISAGLLCIIPYIGPFIAFFPGLIIAFQDSTFMAVKFVIVWFAVQLLHGDLVIPRVMGDRLQIHPITILIVLLVMGDLMGIVGVIFGIPIYTLVKLLVTFIFRKFKQRYNKFYGDKGEYENSSFSEEDYFK

SEQ ID NO: 5460 - protein, 323 aa, Enterococcus faecium
  misc_feature (B) LOCATION 1...323
  hypothetical: YES
GDDDMLKKKPSIFIGMLVLVLFVTGMYLTIHTYGNWHFACALRSKKIFAFILVSLAVSSATISFQTITHNQFLTPSVLGLESLYVLVQTVLFFFIGGVTMLQQTGTVFFLLNVGLMVGLSLLLFFFLLKKMRANLFLLLMSGMILGTLFGSVSTFLQVIMDPNEYDLLQGRLFASFGNIQSQYLLPASLIIIGCWYLLFRYRHVLDVFHLGNEQAVNLGIDTDRFEFLILCCVSLLTGTSTALVGPVTFLGFIVANISYRVFSTYRHGQLFIGSFLVAMLFLTGGQLAVEQIFGWNTTVSVVVEFVGGIYFVTKLIRERKSIL

SEQ ID NO: 5461 - protein, 311 aa, Enterococcus faecium
  misc_feature (B) LOCATION 1...311
  hypothetical: YES
HQDELVVREAYFHQETPVAIVAKQLKRGRQTIYNVYNFLKCGGTALEYFEQYKENKRRCGRTEIIFPAEEKEYIEKRSTEGWTPDVIIGRAERTFSCSVSTLYRRFKTGEFNVLHLPMQGKRKPNGYKEKRGKQAFKRNISERKKDYVVFEKKFGHLEGDTIVGIHHKSAVITLVERLSKAIIALKPEGRKAVDIENSINEWLQSVPKNLFKSITFDCGKEFSNWKSISNTNDIDIYFADPGTPSQRGLNEHSNGLLRKDGLPKEMEFNQVNQGFISSVASKRNHIPRKSLNYQTPLEVFLSYVNGKFCLA

SEQ ID NO: 5462 - protein, 205 aa, Enterococcus faecium
  misc_feature (B) LOCATION 1...205
  hypothetical: YES
RFCDFFFCMLEWRKGEETMIRFARKEDAPEIAPLILVILKDMELPFLKQTGEQKTLEILEEAITDPNYRYSYSRGIVEEIDGKVAGVAYGYTDEEESIIDQPLVPILEKYQLDASTRLFIDKETFPNEWYLDSISVSEDFRGQGIGSRLLEALPKLAKKANRSVIGLSVDEKNPKAKKLYERHDFKVVGQRMISGHLYDHMQKNI

SEQ ID NO: 5463 - protein, 219 aa, Enterococcus faecium
  misc_feature (B) LOCATION 1...219
  hypothetical: YES
NICDFRFRYFLPISIECLSIKEEKQMNAIEKIISQMNEAAEQERAALEQEERMKIDQNFEQKRTQIETEHQKQKEKQIELLEKKYRQLRNRQQVEVRQENLNAKQEFLRRLFADAIAEMENWDESEQIQFIKNSLYSLPLTGKVTFIAGEKSAAYLSQTLLDEWNNELPFMMVLSDETVADQAGFLINDQGVQYNFLFSSLVQDIQGTMSFEIANQLFE

SEQ ID NO: 5464 - protein, 306 aa, Enterococcus faecium
  misc_feature (B) LOCATION 1...306
  hypothetical: YES
RKCDTSNQHDQSNTRKDHRYHYRKDQKHMNVSYLGPESSFTYQAACQLFPTEQLTAYASIPVCLRALFRKQVDLAVVPVENSLEGAVHHTIDLLSKHPEVEVKSEIVLPIKQQLLGNPATKITKILSHPQALAQSQQFLETHYPNVPLVATESTTAAAMYVAEHPKEDAAAIASLETAQHVGLEILAENIQDNELNQTRFWIVGDRKMTSQQSAPVKMSVILTLPANRPGMLHKMLAAFGWREINLSKIESRPLKTSLGEYFFVIDLLLDRPMTLVENALQEIKMLGGESQILGCYPVLTVEETRR

SEQ ID NO: 5465 - protein, 457 aa, Enterococcus faecium
  misc_feature (B) LOCATION 1...457
  hypothetical: YES
KMRDLTKGSPAKLILMFTVPLLIGNVFQQFYNMIDMIIVGQTLGKNALAAVGATGSLTFLIIGFAQGLTAGLAIITAQRYGAKDYRGLKKSFAASVVISLVVTVILTVLSLLFIRPMLQLMQTPPEILDQAQTFISIILLGIFASVSFNLLSNVIRALGDSRTPLFFLIIAVIINVVLDLIFIIYFGMGVEGAAIATVIAQVSSSVLCLVYIKKKMPLLQLRKKDFKFEKEEFAVHLNAALPMAFQSSIIAVGAIVLQAALNSLGTDVVAAQAAAGRIDQFANQPMMSFGIAMATFTAQNYGAKEYGRILQGVRQTLLMSVGFSLLAGAIVIFFGHFFVQLFVSPSETRVFELAQTYFNINGSLYWILAVLFILRYTLQGLGQSKIPTIAGMMELLMRSFAAIVLTGMWGYPGAAAASPLAWIGSVAVLLYSYMRSMKQLKHMGEEEHFTLEHAEAR

SEQ ID NO: 5466 - protein, 449 aa, Enterococcus faecium
  misc_feature (B) LOCATION 1...449
  hypothetical: YES
KRSEGKMMEKYQNIVIGFGKGGKTLAKALASKGESVLVVEKSTRMYGGTCINIGCIPSKSLIFNGERGIDFTEAVARKEKLTGMLRAKNYHMISDEATGTVMDGTARFLSNHQIEVTNNGEKVIVEGERIFINTGSEPIILPIKGLNTSRYLIDSTQAMDQEQLPEKLVIIGAGYIGLEFASMFNEYGSKVVVLDAHSEFLPREDEDIAQMILEDMTNAGIEFHLGVSVDQVADQESTAAVTFTEDGQEVTIQASKVLAATGRKPSTASLGLENTDVKLTDRGAIAVDEYLRTDADNIWAIGDVKGGLQFTYISLDDYRIIMDQLKGENKRTTNNRKAVPYSVFITPTLSNVGLTEKQAKAQGVNYKLFKYMTSGVPKAQVLEDPKGVFKVLVDPETDLILGASIYAEDSHEVINLISLAMNGKLPYTLLRDQIYSHPTMSEALNDVLK

SEQ ID NO: 5467 - protein, 540 aa, Enterococcus faecium
  misc_feature (B) LOCATION 1...540
  hypothetical: YES
GGSEMTDKFSRWSTLFSQNLSRDWKKILIWLVGVTAFSGGFVPAFEELTSGQGLAGLYETLQNPAMIAMVGPTPASNAAEYTLGAMYANEMLLFCSLFAAVISVLHVVSQTRKKEELGLIELIRSFRVGRQANSLAVIAESILINLLLAISISCTMIFFQADSITAEGAWLFGLSVGSMGILGSAVALFAAQLMPSSASSNGLSLAFLGGLYLLRAITDVADSSLSMWNPLGWSYLTYPFTTNNWIPLLYLFLFSLILIISSFVLEEHRDLNTGYIPEREGKPYAKRSLLSLRGLLFYLNKGMTISWLITFGLMGAAYGSIYGNMQQFLESNDLMKQMFIQSGVSIEKNFTSTIMVVLICLAAILPIASINRLFTEETHGRMNQLFATKISRNQLYWTNMLLAILFAILAILISSGALGLSALASMKDAKDMDLLMFLKAGFNFLPAVLVFIGISGFLFGWLPRIGKLAYIYLAYSFALNYFGGILDLPEWFSKTAVPSWVPRMPNDSFDLSVFLTLSCISLALFVLGSIGYRRRDLLEG

SEQ ID NO: 5468 - protein, 240 aa, Enterococcus faecium
  misc_feature (B) LOCATION 1...240
  hypothetical: YES
GSGDMTEKILYQHGTLGALMAGLMDGTETIAHILEKGTLGLGTLHGLDGEVIFLDGVAYQGRSDGSVVQLDGSELTPYAAITDFTPDTSFSVSESADGEQLKKDILVKEDGENLFLAVKITGLFKNMHIRIMPKQEKPYRRLAKISESQPEFQQSNIHGTLVGFFTPELIQGVAAAGFHLHFIDDTHTFGGHVMDFEVTEGNVEISRISSLVQHFPVDDPTFVHETIDYADLAAEIQQAE

SEQ ID NO: 5469 - protein, 209 aa, Enterococcus faecium
  misc_feature (B) LOCATION 1...209
  hypothetical: YES
KEGETMFERSHSELTERENYKLLIGSVIPRPVAVVTTKSAKDIVNIAPFSYFNIVSSNRPILSLAIQRKQDAVKDTAKNILETREAVIHILDEDNVEEVNKTAANLPNEESELYLTDLTLTDSVIISVPALTEAKVRFETSLYEHVEIRNKNKVTADLFLLEVQKYHLNETVYDDKTGRIDPRKLNAVSRLAGNDYAAIGEIFTIARPE

SEQ ID NO: 5470 - protein, 509 aa, Enterococcus faecium
  misc_feature (B) LOCATION 1...509
  hypothetical: YES
RKRLHIMEGITMTESTYIMAIDQGTTSSRAIIFDKKGRHIGSSQKEFTQYFPQESWVEHDANEIWNSVQSVIAGAFIESGIKPNQIAGIGITNQRETTVIWEKDTGRPIYHAVVWQSRQSAGIADNLKNEGYQEFFHEKTGLVIDAYFSATKIRWILDHVEGAQERAEKGELMFGTIDSWLVWKLTDGQAHVTDYSNASRTMLFNIHQLDWDQEILDLLNIPRVMLPKVTSNSEVYGYTQGYHFYGSEAPISGMAGDQQAALFGQMAFEPGMVKNTYGTGSFIVMNTGEKPQLSKNNLLTTIGYGINGKVYYALEGSIFVAGSSIQWLRDGLQMLQKASDSEDAAKRSTSEDEVYVVPAFVGLGAPYWDQAARGAMFGLTRGTTKEDIIKATLQSIAYQVRDIIDTMQDDTGIKIPVLKVDGGAANNEYLMQFQTDILNVPIQRAENLETTALGAAFLAGLAVGYWKDTDEIREFYEAGKLFEVQMEEERREKLYNGWKKAVKATQAFE

SEQ ID NO: 5471 - protein, 127 aa, Enterococcus faecium
  misc_feature (B) LOCATION 1...127
  hypothetical: YES
WRRFRMEKFQPIINQIKEKEHQQKIKDLFAKITETYPQLDTTVKWNQPMFTDHGTFIIAFSFAKNHFSIAPEKAAIRALEKNIQEAGYVYTDNVIKVPWKSVINWELIEQLISFNIEDKKGHDKFWR

SEQ ID NO: 5472 - protein, 259 aa, Enterococcus faecium
  misc_feature (B) LOCATION 1...259
  hypothetical: YES
EESLEGSKPMIIRKPKKKRIMGKWIIAFWLLSAVGVLLLMPAEASVAKYQQNQQIAAIDRTGTAAETDSSLDVAKIELGDPVGILTIPSISLKLPIYDGTSDKILENGVGITEGTGDITGGNGKNPLIAGHSGLYKDNLFDDLPSVKKGEKFYIKVDGEQHAYQIDRIEEVQKDELQRNFVTYLEPNPNEDRVTLMTCTPKGINTHRFLVYGKRVTFTKSELKDEENKQQKLSWKWLLGSTVFLSVMIIGSLFVYKKKK

SEQ ID NO: 5473 - protein, 81 aa, Enterococcus faecium
  misc_feature (B) LOCATION 1...81
  hypothetical: YES
GSLERMCNSIVTIQEKAEEELMRIEAEYKEKRKAIKRKKNAELKKYKEEQALKLGMMLCKYYDCYDINEVLKKANLNQFCE

SEQ ID NO: 5474 - protein, 241 aa, Enterococcus faecium
  misc_feature (B) LOCATION 1...241
  hypothetical: YES
FHLDIIVDRMRREFKVEANVGAPQVSYRETFRAGTQAEGKFVRQSGGKGQYGHVWIEFTPNEEGAGFEFENAIVGGVVPREYIPAVETGLKDAMENGVLAGYPLVDIKAKLYDGSYHDVDSNETAFRVAASMALRAAAKKANPVILEPIMAVEVVIPEDYLGDVMGHVTARRGRVEGMEARAGGQQVVRAMVPLAEMFGYATTLRSATQGRGTFTMTFDHYEDVPKSVQEEIIKKNGGQAE

SEQ ID NO: 5475 - protein, 158 aa, Enterococcus faecium
  misc_feature (B) LOCATION 1...158
  hypothetical: YES
AKLERYFSDEPDATGHVNLKVYTGKTAKVGVTIPLLILVLRAEEISPDLYASIDLVVDKLERQIRKFKTKINRKSRETGMNTADATALFNEEDENENDSELDIVRTKRLSLKPMDSEEAVLQMNMLGHNFFIFEDAETNGTSIVYRRKDGKYGLIETD

SEQ ID NO: 5476 - protein, 153 aa, Enterococcus faecium
  misc_feature (B) LOCATION 1...153
  hypothetical: YES
NMLEKSSKACDTNKEKVTDKSHNERIPWDQYFMAQAVLLSLRSTCTRLEVGATLVREKRIIAGGYNGAVSGDVHCIDEGCYVVDGHCLRTIHAEMNALLQCAKLGIPTEGSEIYVTHFPCLACTKALLQAGVKGINYLHDYRNDPYAQALIEK

SEQ ID NO: 5477 - protein, 332 aa, Enterococcus faecium
  misc_feature (B) LOCATION 1...332
  hypothetical: YES
SMLEWSENKRQAMERLSTPEGIITALAIDQRGALKKMMSALGMEATKEKIEQFKTLISQELTPYASAILLDPEYGLPAAQKRAAASGLLLAYEKTGYDQTVPGRLPDLLSDCSVLRLKELGADAVKFLLYYDYEEAEEINRQKQVFVERIGSECMAEGLPFYLELLSYDAKNVDTKSLSYAKAKPRKVIEMMKEFSKTQYKVDVLKVEVPVNMSFVEGNATGEIAYTRQEAAAYFKEQSDATDLPYIFLSAGVSAALFMETLRFAKHAGARFNGVLCGRATWKDAVAPFVEKGEAATLEWLTEQGTQNIRQLNEVIRETAIPWYEKVSESTC

SEQ ID NO: 5478 - protein, 63 aa, Enterococcus faecium
  misc_feature (B) LOCATION 1...63
  hypothetical: YES
RMLEEKSLNTYNYFISKKMLSVVSPIAEESHSRDYLIKKYVYSIHLFIFALLTYCNNVSNNVF

SEQ ID NO: 5479 - protein, 139 aa, Enterococcus faecium
  misc_feature (B) LOCATION 1...139
  hypothetical: YES
KALEALLEAHLLVVMRAEMGELKMIDYNDRGRLKWAGFYLSDHTEEIDADNEQRTSQNLAKEQMTTEEIAEVLNAAVIKNRSVSIQKEERNAEGYYPEDIIGKILGSDELGIYVGKDKIHYDEIRHIEFYQDNKWSRLE

SEQ ID NO: 5480 - protein, 429 aa, Enterococcus faecium
  misc_feature (B) LOCATION 1...429
  hypothetical: YES
SAIEVFFVEFCYTVIKLINGDEKMDQKDFRENLELKPVTQEHIDQFNELLSYVFQVTEADIEESGFENKRAFIRSKKPILEVSKVFGWFHENKLISQIAIYPCEVNIHGARYKMGGVTGVGTYPKYANHGLMQDLIIVALDNMRKNKQWISYLYPYSIPYYRRKGWEIMSDKLSFKIRDTQLPKQIPVSGMVERLPVDHPDVFSVYDKFAQQNHGALFRSDFHWEEYWRFENEDERTAAVYYDSNHEPRGVLFYWVAEEIFHVKEMFYLDQEARNGLWNFISAHFSMIYWVHGDIYKNEPLAFLIEDSQIKEQIEPYFMARIVDVKEFLQRFPFVGTADAFHFIIEDPVAPWNNGVFALTWDEQGQVRVLNEPIGKSVRLDIQTLTCLMMNYRRASYLARIERLETDEETLKSLERIIPNMEAYFSDYF

SEQ ID NO: 5481 - protein, 115 aa, Enterococcus faecium
  misc_feature (B) LOCATION 1...115
  hypothetical: YES
FYIDSKEFFYLKKVHSFLNYLMGAITIVAVYQAFLKYPDYGTKLLSLTHNQTAYSPTLILSTLTAGAKSATYFFHKTTSMLKRKKQRKQLLVVVAAMIIIYFLPVITQVFHQYFG

SEQ ID NO: 5482 - protein, 603 aa, Enterococcus faecium
  misc_feature (B) LOCATION 1...603
  hypothetical: YES
ASIEAKGEIGMKKTIFGFAALMSAVVLAACGGGGTDTSGNNSGGNGNNKEELTFPIATKNNDDAIEDGELEAAVATDSQFKGLFQWEFYQDSYDAAFMAPSHEPLFANDDDFRITDDGAATLDLDEDTKKATIKVKDNVKWSDGEDVTADDVIFPYEIIGNKDYTGIRYDDTFRNIVGMEEYHDGSADTISGIKKIDDKTVEIEYKEVNPSMLQSGGGIWSYAAPKHTLEGVAIKDMESSDQVRKNPVTFGPYYMSNIVAGESVEYLPNEHYWNGTPKLKKITMKSVPMASATEALNSKLYDMIFQMPTDTYDTYKEIAGYTNLGREQTSYTYLGFKLGKWNADTKSVEYNPDSKMADKSLRQAMGYALDNNAVGERFYAGLRSNATSLIPPVFQSYHDDEMKGFTQDLDKAKKLLDDAGYKDVDDDGLREDKDGNKLTINFASMSGGETAQPLADYYIQQWKEIGLDVQYTTGRLIEFNSFYDKLENDDPEIDVYQAAWNTGTDPNPSGLWGPNAAFNYTRYESEENTKLINDISSSKAFDEEYQKEAYQKWQQYAFEEAFAIPTLFRNEVLPVNDRVKDWDWSYDVPNPWANVSVTADSRS

SEQ ID NO: 5483 - protein, 111 aa, Enterococcus faecium
  misc_feature (B) LOCATION 1...111
  hypothetical: YES
KSIELLGGTNMTNYDGEKHKRLRGSMAPKTEEEVALAGTNSGETEDKEESLAGTNSGETENKETALSGSNSVEEETKPNEPNHFEKDIEKAVEDVKEKFEELTSKNKHDHH

SEQ ID NO: 5484 - protein, 87 aa, Enterococcus faecium
  misc_feature (B) LOCATION 1...87
  hypothetical: YES
ETIDYKEDYFKRSKESGGERMETKCDFMVNRAILIEMGFKPSQAARMIKESKAYLARIEGIDFYNNRQVGVVPSRVIEHLFHIQVAE

SEQ ID NO: 5485 - protein, 145 aa, Enterococcus faecium
  misc_feature (B) LOCATION 1...145
  hypothetical: YES
EMIDEQNRKETKQMNSMVFVNFPVADVNRSVAFYEKLGFKKNEEFSTEEAGSMVWDDTFWIMLLSHDFYKKFIKDKEIADNKKTSGALISFSVENADEVKKFAQIAKENGGTFHEVDMGMPEEEMFSLEVQDLDGNTLEPVWMKM

SEQ ID NO: 5486 - protein, 305 aa, Enterococcus faecium
  misc_feature (B) LOCATION 1...305
  hypothetical: YES
GGIDVEQSIFLKKEHQQVEKELYFDFCGFSKTMPFHSFGPAIRNDYILHVVMEGKGSYHVKNQQFQLKKGDLFLIRPGDSTFYLSDGEDPWMYCWLSFGGSAAEEIIRQSLFREDQYTMVSSDIQKYIDIILECMKDTEETLENELQLTALTYRFLSVLLKDGGKVSGGVQKVHSSLAVETVKYIEAHYAEKLSVEEIAQHLAVNRSHLSRVFKNHMGTSIKEYLIGVRINRGAFLLSLTDESVESIAYQVGFNSLVVFSRMFKKSTGETATNYRKRMKNENFKNIALDTLKKQLEKQTAVSWTT

SEQ ID NO: 5487 - protein, 60 aa, Enterococcus faecium
  misc_feature (B) LOCATION 1...60
  hypothetical: YES
LLVDRSPFCTFSTSSSSSKSKISSVSSSFSETVSISSTSSVSSEDTTNSSISSCSSNSSS

SEQ ID NO: 5488 - protein, 162 aa, Enterococcus faecium
  misc_feature (B) LOCATION 1...162
  hypothetical: YES
AYVEFFRNIPLLIIVMFFYVVVPIYWFNLDGFQAGTIGLTIYTSAFIAETVRSGIQTVPKGQTEAGLSSGFTYSEIMRYIVLPQAFKIVIPPLGNQFINLVKNSSILAIVAGLDLMYQGDLIASETFNTFDTYIIVGLFYLVITLPLSYLMVYLEKKWAVRS

SEQ ID NO: 5489 - protein, 83 aa, Enterococcus faecium
  misc_feature (B) LOCATION 1...83
  hypothetical: YES
LIVEVNCMPTTLASIKKDLEGRIGSPIMLVAQTGRKRQTERRGVLTETYPSVFVVDLDPAAILLNEYLTAIQMYLLGQLRSNF

SEQ ID NO: 5490 - protein, 760 aa, Enterococcus faecium
  misc_feature (B) LOCATION 1...760
  hypothetical: YES
PDSDDCRWLARICHPESGGKFISFGRNRRSYYLMKVEEKQFDLEYINKYASQMTIGNGFFGIRGSQEEDYRNQVRGMFAAGVYNRPLGAESAELVNLPDVIRWEIKIDGEHFSLETMKVLAYERALDLEMGELKRYALIETAQGKKVEVITCRVADQNNLHQAALKVVIKPLTEDCQVDVKTGIDGQQTNFGTQQLVEKELRVFGDDLISASYQTTESKIDIGIAAKFNKAGVFQAKNRRITASFSEKIRKNTSFTLEKIIVLSTSLQQTDPFKKSIAQAQKSVSYTEILEQSMSYWTDFWHQHRITIQGDSSFDQLAMDFAAYHLQIMTPRNDPSVSVGAKGLTGEGYKGHVFWDTEIFILPFFLYQFPEVAKNLLLYRYDRLEGARQKARDYHYQGALFPWESAHTGQEETPKFAALNIKTGTRQEVASAAAEHHISADLAYAVQEYVQATEDQSFLETKGKTLIHETAAFWLSRAVKVDDHLEIHRVIGPDEYTEYIDNNAYTNYLAHYNVALAVKYQAGDPLFLKECQNFLDKLYLPVPNKEQLIPQDDTYLSKPVIDLTTYKERPGSQSILLDYARSEVNELQVSKQADLVMLLYLLPEYFSQPIVSKNLHYYENKTIHDSSLSKAIHAIEACRIQEMEWAYHLFQEACLIDLGPDPHSSDDGIHAASLGALWLAVIFGFSGITVTNGTLSISPRLPSAWEKISFPFIWKNHRLLFVLTKKQIVIKKETKETLPIFVNGDQYQLEKELILERRGK

SEQ ID NO: 5491 - protein, 70 aa, Enterococcus faecium
  misc_feature (B) LOCATION 1...70
  hypothetical: YES
AQSDEKYGVLFLSDCSYCLMQSSFFTTSPLNGVLLPTPRSQVTIFNKHEKLFFEIVPCDSELNGRLTTSW

SEQ ID NO: 5492 - protein, 73 aa, Enterococcus faecium
  misc_feature (B) LOCATION 1...73
  hypothetical: YES
NPPEKYVDGATTRQQMLVLLCVGIMTRRGIAYMPLMNYTRLNVAIVVQLNGLRAISITTRTSSQRLNLNQTLR

SEQ ID NO: 5493 - protein, 263 aa, Enterococcus faecium
  misc_feature (B) LOCATION 1...263
  hypothetical: YES
GITEGDIPLASTDPLGGIPSIVIGPMTGSVIAMLSGVTDHVAHGGPIVAVLGAVDHVAMFFVAVIAGIAVTVLMLRILKPTLQQTAVAAANGVTVADLSETETSDVYTKTETFDSITDIMSDEAIVLGETATTKDGVIEDLVQRLEKTAAITDKTRFKEVIYDREHESTTGIGMGIAIPHGKSAYVLKPTVAFARSQSGVDWHSLDGKPAHMIFMIAVPENSQGDMHLKILQRLSRKLMDDDFRQALMEAPDKTTVHQLLSEM

SEQ ID NO: 5494 - protein, 585 aa, Enterococcus faecium
  misc_feature (B) LOCATION 1...585
  hypothetical: YES
SLTEFYKEETQMETSMINIPIYVDKEKLLEKPVTKKEKTDVRDRCLDNYREVTRDEFVEILNSSQSFIPSKTKNKGNDKESFVETRVIILDVDNTVKDEKGKVVDLSKDDSRYLSIEKVLSINLVHNSAFAIQKSIRYSENLKKYKIVFLLKEAITDYGKMVAVYEYLKKNIPGCDDNVNASNRMFFGGYKSDAVIIINEDNMLDITELPIDFTMTCSKNCQSDSGREYELVNETDFVKLIKNDDKEEMKQWFKDCLFDSSDMSFNEIYERLLTIDMNKLLKSSKNLRCLFHNDHNPSASIFTSKTGHSIFYCHSSNCDISENFIGVVMLILKKDSRVETFNWLLENLDLYPTHFRKLKEESKVLFDTLESMKDKLFRTIRNYLEEMRRVYDVLLSDVNFFDDSKESVTCILSGEQLAKKMSSYYGKTYDIDKCNKLLSLMTFIGLIKKLDDEDVPLKMLEYLNRLKEEKALGNFKHKRSNVYRLDVFNATSVIQKLNEDILPLLEKFHFTYQYFSYEWVKICFNEKEAKRVFPQNSRSELSKEKQLILDEAHEVLQGLSWQGTYLMTEKGLIYTVCETPTKCQG

SEQ ID NO: 5495 - protein, 180 aa, Enterococcus faecium
  misc_feature (B) LOCATION 1...180
  hypothetical: YES
GVTDMKWNEVKVETESEAVEAVANILMEAGASGVAIEDSLDVEHFQSDQYGEILDKNDFTSLKEGALVMAYFPETTFLPEILPFIKDRITQLPEFGLAIGKNKVTVSEVEESNWAPSLEGILSSGAFYANADGCAKLGKLPDRRSSRKNYHTRSWYGIWHRHSSHDFLDIDSTRNSLAWW

SEQ ID NO: 5496 - protein, 342 aa, Enterococcus faecium
  misc_feature (B) LOCATION 1...342
  hypothetical: YES
TKTEGNEKMDIYLKKAILHIIDRETGSPVFSQKELDLTKEYIRDFLQKKIQKISSAQTKTGQLAEESMIVESLKIAQENFVEASEAIVQRWFDIYQESEEAPSADVFVVLYELDTVMYLSLLKVNYREAYTHFVEADEAGIDNRLILNRAILGAKTQKADEAFAVNLTDWTYELIEKKYEFSGKKELYFSGRVIESVPAPSLEENVKVIQKVAKHLGKKFETEEFDIMADLKEAVYDTIEEKGRLDHEMIAEKVFKENITAKMAFKEEVQEQGFVPEAPPVKEVQEISEKKFGKQKFKLSNGIELIVPVDVYRNPDLIEFVNNPDGTISVMIKNVDEVLNRL

SEQ ID NO: 5497 - protein, 94 aa, Enterococcus faecium
  misc_feature (B) LOCATION 1...94
  hypothetical: YES
NNAESLSKRRAIVFVIINTTIXVALFSISGTPASAGFGVVGLVGPLASLNAGLNGFLVVLCWLVIPVFAALITQFLCEKVFKLYDREEVFKFLG

SEQ ID NO: 5498 - protein, 251 aa, Enterococcus faecium
  misc_feature (B) LOCATION 1...251
  hypothetical: YES
LDAEQLFHNLYLSISQNSGRIQKITERGETMELGKSDYQLFDRPIYAFKQLKESHPTDKIEQIKKEYKEHWQKWKEIQLQTAALLPDMYGMSKPKIESWTNGWNLRSHFWSAYRSESRQDENACLAVLLNQKQYQIYLMYQHYKSEERYGSIAAYNQLLAILKEWSKTVDIKDYYIWPQPEHELDDHLALSDYLSDTKKQEELKKAMRDRTFQMGKLFFYPQEIEHVEQITAETLQELAPLYQKLGAEKFQ

SEQ ID NO: 5499 - protein, 299 aa, Enterococcus faecium
  misc_feature (B) LOCATION 1...299
  hypothetical: YES
LLADYQGEVSMNRPRKHSDLKLAMGLLAPSMLLLAVLVLIPMLSNIQISFFDMPLNPNSDAVFIGLSNYLEILSDSEFYRSLGLTVAYTFLVVAGSTALGLAVAILLNRKFRFRKTVRSLILLSYVTPSISLIFAWKYMFNNSYGIVNDLLVDRLQLFNEAPLWFDQPVASFFMVVLFAIWRYYPYAFISFLAILQTVDKTLYEAAEMDGANAWQKFKIVTLPAIKPVLATVIVLRSIWMFYMFTDVYLLTNKVNILGVYLYQTAFAFNDLGKAAAISILLFIIIAAVVLLSRKKVDLK

SEQ ID NO: 5500 - protein, 105 aa, Enterococcus faecium
  misc_feature (B) LOCATION 1...105
  hypothetical: YES
KLADLSALDEDREIRFVSPESSIGIAKIQKLIARSIFSSGMKRNFYRDQFLIFLKFIFLRLVSRKKRIISSLFSIIYRFSLFFGKGAVSKMVKSGNVANISYLMI

SEQ ID NO: 5501 - protein, 157 aa, Enterococcus faecium
  misc_feature (B) LOCATION 1...157
  hypothetical: YES
VLAEALCGGLFAWFFTFSSARNFSTFIWMLSALLFSLMDLFYFMVHSHTLFCSWAILWIFWLQAGVFQWQSVLLTFIVGGVCLRYGQSYLGAGDTLLMLSWSGGLSLEELLQILFLASLFGISVFSVYFICHKKKLEKLPFIPFLSSALLIVLHLRY

SEQ ID NO: 5502 - protein, 78 aa, Enterococcus faecium
  misc_feature (B) LOCATION 1...78
  hypothetical: YES
KMADKRKEKIQKLLALAADVNDEESMSALAKAQQLMMDYDLTEDEIFNYHEQQRIEAVETHVIYRGRPQKWLYRLFKN

SEQ ID NO: 5503 - protein, 74 aa, Enterococcus faecium
  misc_feature (B) LOCATION 1...74
  hypothetical: YES
EEAESIMRKKFDYWGVPFSELFPNYHAPHTIECDCGERAKCIKSYRLYQCQTCGKKYTLSYGDYILIDEKGKKR

SEQ ID NO: 5504 - protein, 75 aa, Enterococcus faecium
  misc_feature (B) LOCATION 1...75
  hypothetical: YES
EEAESIMRKEFDYWGVPFSELFPNYHAPHTVECDCGERAKCIKSYCLYQCPTCGKKYTLSYGDYILIEEKGKKRC

SEQ ID NO: 5505 - protein, 87 aa, Enterococcus faecium
  misc_feature (B) LOCATION 1...87
  hypothetical: YES
DGGLNMTKEIISSKDLHLYYGKKEALKGIDLSFNQGEITAMIGPSGCGKSTYLRSLNRMNDLIPNVTITGSVIYKDKDIYGPETDVC

SEQ ID NO: 5506 - protein, 445 aa, Enterococcus faecium
  misc_feature (B) LOCATION 1...445
  hypothetical: YES
MAQEYLTVTTLTKYLKRKFDADPYLERVYLTGEISNFRLRANAHQYFSLKDDHAKISAIMFKGAFQKLRFQPKEGMKVLVVGRISLYEAGGSYQIYVEHMEPDGIGALYQELEERKEKLMKEGLFQGPKKMLPRFPKRIAVLTSPSGAVIRDIITTVKRRYPIVQLVLFPTVVQGNQAADNVVRNIQRVEEMGNFDTMIIGRGGGSIEDLWPFNEERVARAIYQANTPVISSVGHETDTTIADLVADVRAATPTAAAELAVPVLSEELMRIQERQARLQQAFVRQIQRKQERFERARRSYVFRQPERLYEGQTIKLDQLKQRLYQATQQIYHAKEKQTIALSHQLEQVAPLYRVKAARQETAYLEKRLEEKIQQYMKQQQQRFAQAVQSLDLLSPLKIMGRGYSYTTLNDQVVKSVTEIHQGDLLTIHYQDGIVKGQVQEIDKGE

SEQ ID NO: 5507 - protein, 536 aa, Enterococcus faecium
  misc_feature (B) LOCATION 1...536
  hypothetical: YES
TPQEKMARGSAWMTASNIISRLLGAVYIIPWYAWMGENAKAANGLFNMGYNIYALFLLISTAGIPAAIAKQTARYNSLNEYGTSRRLFIRALQMMGGLGLLFALFMYIASPWLAHASGGGEELIPTMRSLSIAVLVFPCMSVIRGYFQGNQEMMPYALSQIVEQVARIFYMLLATFIIMKVMDGDYVTAVTQSTFAAFIGMLASILVLLYFLKKHQAYTSAFIHYSENKINIATKELLLDTVKEAIPFIIVGSGVTIFKLVDQFTFMKIMSASTEYSNAQLLDLFSIFSANPDKLTMVVIALATSIASTGLPLITEAVTLKDRVGLAKLTSGNLQLFSFFMFPATFGVMLLAYPLNTLFYTPDSLGSNVLIQASFVGLFLGLYMLVSNMLQGMFENKAAINYLVIGFLVKLLLQYPAIRLFEVYGPLLATMIGFAVSCTLILKRIHEVARFKPSFVWRRTLLIFILTLIMLLASWITKMIFGAFLNEDSKFQSLLLILVVAGIGALVYGYLALKIRLAERLLGPGIARLRHKLKIK

SEQ ID NO: 5508 - protein, 191 aa, Enterococcus faecium
  misc_feature (B) LOCATION 1...191
  hypothetical: YES
NKQEQGGRRMIISEFDRNNPVLKDQLSDLLRLTWPEEYGDSSAEEVEEMMNPERIAVAAVDQDELVGFIGAIPQYGITGWELHPLVVESSRRKNQIGTRLVNYLEKEVASRGGITIYLGTDDLDHGTTLSQTDLYEHTFDKVASIQNLREHPYEFYEKLGYKIVGVLPNANGWDKPDIWMAKTIIPRPNSQ

SEQ ID NO: 5509 - protein, 464 aa, Enterococcus faecium
  misc_feature (B) LOCATION 1...464
  hypothetical: YES
KWQERDGKLSCSCCHYLKSSLRFSKFRGGIQMQQDKTSNINEKKITLCSLIPGMGQFVNGQAFKGIVFFAIFVLFIGQMLLGGFHALVGLVTLGSIPMEDHSLFILIEGTLQFIITIIFLIFYGLNLLDAYRVAKMRQEGKKINRTMKEIIHNIGDEGFPYLLTLPAYLLMIFTIIFPVLVTLFTAFTNYDFNHIPPASLIDWVGAKNFFSIFFLSSYRNTFFAVFSWTVIWTLCATTLQITLGILTAVVAHQKFIKFKRIFGIIFLLPWAVPAFITIMSFSNIFNDSVGAINTQVIPFINQLPFVDISAISWKTDPNWTKVAIILVQGWLGFPYIYVMVTGILQSISEDLYEAAKIDGANAWQRFSNITLPAVFLVAAPTFITQYTGNFNNFSMIYLFNNGGPGSVGGGAGSTDILISWIYKLTTGTSPQYSMASAITLIISVIVICVSLLVFKKTNAFNMGD

SEQ ID NO: 5510 - protein, 814 aa, Enterococcus faecium
  misc_feature (B) LOCATION 1...814
  hypothetical: YES
IAKDQKQREQLSFGHKGEIEMEKKKDTQKIYAAFAGKTKQELFELFHASANGLTEEQIERSRENYGENAISYGKKTPFIVEILKAYITPFTLVLIALGIISFITEYVLAAPGDKDLFGVAIIFTMVIVSGTMTLIQSVRSNQAAEKLKSLVKVTAAVKRNGKYTEIPMEEIVCGDLVRLSAGDMIPADMRLLSAKDLFISQAALTGESYPVKKHAKVCEDDQQSETSYENLVFMGSNVISGSAEGIIVSVGNETLFGHVAETLSEKPIQSSFELGIHKTSMLLIKFMSLMAPAVIVINGLTKGDWLEAFLFGLSVAVGLTPEMLPMIVTTNLVKGASVMAKKGTVIKNLNAIQNFGAIDVLCTDKTGTLTQDKIILEYHMDCEGNEDDRVLRHAYLNSYYQTGLKNLLDVAIIDEATETLDTDKINYQKVDEIPFDFERRRMSVVVADPAGKTQMITKGAIEEMLNISKFIDLGGTVTPLTKERKEAVLAKVQSLNEDGLRVIGVAQKTNPSVVGEFSVKDESDMVLIGYLAFLDPPKETTKQALKALKEHGVAVKVLTGDNELVTRSVCRQVGLEINELVTGEKISEMSDHELAQVAEDHEVFVKLNPQQKARLTTALRKNGHTVGFLGDGINDAPAMKVADIGISVDTAVDIAKESADVILLEKDLTILERGLLSGRETFGNIMKYIKATASSNFGNMFSVLIASTFLPFLPMLPLQLLFLNLIYDVSCISLPWDRMDKEYLDEPKKWNASSIGEFMVYFGPTSSIFDITTYLLMYFVICPAVVGRSFHTLDSSQRVIFIALFHAGCLFDSL

SEQ ID NO: 5511 - protein, 183 aa, Enterococcus faecium
  misc_feature (B) LOCATION 1...183
  hypothetical: YES
YNKENKTRGRIFMNTLAYILLCVLLSKPRSGYELKQLITIFWEAHHSQIYTTLAKLDQQGYVTVLDKDEHSQKKIYHLTDEGRALVEEWIKEETPAPTQKDEFLAKIYAFSTLDKTTATGLLFTREQQLNKIMQKNQKKLNDLSLDKKQEFGRYVVIQRRIMLCQQELQWCQQVREQMQQFFE

SEQ ID NO: 5512 - protein, 77 aa, Enterococcus faecium
  misc_feature (B) LOCATION 1...77
  hypothetical: YES
MNKERLKQDFYEAVNEEWQKTAKIPADKPATGGFQDLVDGIDQLLMGETDDLLAHPEKSVFRKNETFPCILSTGKRL

SEQ ID NO: 5513 - protein, 101 aa, Enterococcus faecium
  misc_feature (B) LOCATION 1...101
  hypothetical: YES
GGKEMKQRKIPLRKSVVSGEMKPKKEMVRITRSKEGEVSIDPTGKMPGRGAYVSLEPEEVQQAWDKKILDRVLETTLTDEFYQELLDYVTHQKARKELFGK

SEQ ID NO: 5514 - protein, 339 aa, Enterococcus faecium
  misc_feature (B) LOCATION 1...339
  hypothetical: YES
LIKESGRLLPCLAAPIIAGLFFVEVTKMSDKPFKTLEEQIEILKQRNLKFKNSENAKYVLMNNSYYGLINRYKELFSISTQNAEGDFEDDFQGNYFEDLLSIYDFDKNLSSLLYKYFSMIETTLKTSCSYYISLYIGEMQTNYLNKNNYSWGYIVEHGKMKGRPSREVTIDHLEKCIKKSGDPSIEYYKKEHNNVPPWISIPALSLGTIYELYRICPKEAKSDISSVFMKPKIQDISAQKNLFIKSLKFIHIYRNRVAHGQRIVNHCVEEKNVLPKYEFKLFSKNKKTHMLVKDGRSDSIIGLFLSVTLLLSSRSLVQSQFIDELESIFVTLKKRNTKA

SEQ ID NO: 5515 - protein, 69 aa, Enterococcus faecium
  misc_feature (B) LOCATION 1...69
  hypothetical: YES
LIKDRKNPNGFLPSNVFCDMNQVTATGIPKYFKKAPSIIDSGGTWANTMTNSKDKTNQAIWLKVTGKGS

SEQ ID NO: 5516 - protein, 137 aa, Enterococcus faecium
  misc_feature (B) LOCATION 1...137
  hypothetical: YES
KIKDASVVKKAFSCIKQPLTEVEIFHTDRGKEFDNQAIDELLTTFDINRSLSHKGCPFDNAVAESTYKSLKVEFVYQYTFETLQQLDLELFDYVNWWNHLRLHGTLGYETPVGYRNQKLAQRILDNELGCANASEAV

SEQ ID NO: 5517 - protein, 67 aa, Enterococcus faecium
  misc_feature (B) LOCATION 1...67
  hypothetical: YES
KVKENPMAIKYKTGKKQYHRSIHDRPDNYPDFNSEFGHLEGDTIVGIHHKSAVITLVERLSKVIITN

SEQ ID NO: 5518 - protein, 161 aa, Enterococcus faecium
  misc_feature (B) LOCATION 1...161
  hypothetical: YES
TSKDLIIKLISGRWNMEPDLKTVNDYLVSVFNDILTIEESELKKSQFKDLSITEMHTIEAIGMYKKKTTSEVAKELSITVGTLTTAINKLVKKGYVERIRSEDDRRVVKLGLTKKGKLLFRVHQHFHREMVKNILDGMATEEQHALLDALKNLHDFLQDYK

SEQ ID NO: 5519 - protein, 379 aa, Enterococcus faecium
  misc_feature (B) LOCATION 1...379
  hypothetical: YES
MKKEEKIAILQEIIRIKSVNGNEGEVAAYLNKLLAKHDITGEIVSYRDGRDNLIARYQKGQSGKVLGLSGHMDVVAAGDESSWTYAPFAAEIHGNRLYGRGATDMKSGLAAMVIAMIELKESGKPFNGTVKLLATVGEEVGELGGEQLTKAGYVDDLDALIIGEPTNYSLMYTHMGSINYTVTSHGKEAHSSMPDQGYNAINHLNEFITKANAEMNHLAETIENPVLGKTIHNVTLISGGNQVNSIPSHAQLQGNIRSIPEYPNDKIIALLQSIVNELNQETDYHLELMIDYNKIPVKADPDSPLIHCIQQQFSQPLPLVGAAATTDAAEFTKANHSFDFVVFGPGVVTLPHQVDEYVEIDNYLDMIEKYQGIILSYLA

SEQ ID NO: 5520 - protein, 322 aa, Enterococcus faecium
  misc_feature (B) LOCATION 1...322
  hypothetical: YES
ERKEGRKKYMDYQVLLYYNYTKIEEPEEFAKNHLAFCKSLDLKGRILIAEEGINGTVSGTVENTTAYMKAMKADPRFADTMFKIDPSEGHAFKKMFVRYRPELVSLKLEEDIDPNQVTGAYLSPQEFKEAILDEQTVVIDARNDYEYDLGHFRGAVRPDIRSFRELPDWIREHKEEFMEKRVVTYCTGGIRCEKFSGWLVREGFKDVGQLHGGIATYGKDPEVQGELWDGKMYVFDERIAVDINQVDKQIVGRDWFDGTPCERYINCSNPECNRQILASIENEEKHLGACSIECAKHPRNRYVQDHGVSPEEAELRFTALIK

SEQ ID NO: 5521 - protein, 650 aa, Enterococcus faecium
  misc_feature (B) LOCATION 1...650
  hypothetical: YES
RRKDASCFRTHPTYERTSSHYFCLWCKKRAPEPCRCVKRIYRKGGVQMKIGIIGAGPRGLSVAERILHNNQGRYSLELILFDPEGPGGRVWRLNQPPELLMNSVSQQVTLFTDETLSSGGTVMPGPNLFQWSKGPATDYIEQTVTKNKQLFIEEINRLEKDQQSTRCLYGLYQRWFFSKLQEEFPASTQLVYSLVKKVSKEKDGFLLQTDQQSYPVDQLILASGHWENDQTEEERAWVDYAKKNDLLYQLPSNPADVDLSKIQPKENVFLRGLGLSFFDYVGLFTVSRGGRFENKKGKLVYHPSGKEPIIYSGSRRGLPYYPRGRNQKQGGAMAWPRLLTKENLERWHRSGLLTGETFFDYLKKDAELFYYKKIIEEHHLPISRKTFDHDFLSLSSEECLGKYPALLPYKWSWSYLETPLTYQDESFAETSRAFIEGQIKEAEKGNCTGALTSTFDALKDWRDPIRQAIEWHVFSAKEYKEILWGWFTHLNSFLTIGPPVIRTKELAALIDAGIFHLIEPPLDIQQKQNHYVISLQDKEISSRYLIEARLPQTSFSRSSNPVIKNLKENKLVRPFSFSDNTGSYHSEAIDVERGTNRVIDASGKIQSGFYCYGIPVEGVDWLTAAAARPYTDPWNLRQADKIAQLILTDK

SEQ ID NO: 5522 - protein, 151 aa, Enterococcus faecium
  misc_feature (B) LOCATION 1...151
  hypothetical: YES
TLKDFYSVNELAEQLGVTTRSIRNYLHEGKLKGTKVGGQWKFSERNLFEFLYGDQAEEAAKEMQRFMLNAPITMRFNLQYRDFTAINQFREQLVQYHNDVYANKKDRLLQYDLYKDNHAEILIGGNFNYVVNFSQWINEKLLIQTDISLVS

SEQ ID NO: 5523 - protein, 431 aa, Enterococcus faecium
  misc_feature (B) LOCATION 1...431
  hypothetical: YES
EMKEWLDRAFLPMITSVVNLRPLTALRNGMTYTIPIIIVGSLFFLFAHFPVDYIAQWIDKTGFSMYFTQVYQATFDVIAFWIVFAIAYAYAKEEDIDRLPVGITALSAYLLLIQPLNTQIDTVWTGAEGILGAVTTGLIIGWGYARLVRLAKGWKQREKIPANVWQSFTSLIPIIVIVTYTLIGSAVFQQLFRMTVVQGVWTYVQLPIQSFIDTLFGVLLLGFFVPFLWLFGLHGSAMVNGLVSPVLQANSLANAEILASGQELTVANGGHIVTQQFLDQFMTVTGAGLTLGAVFFMTVFAKSKKYRELGNLALLPAFFNINESIIFSTPIVMNPMMAVPFIFAPVVSGLITYSALYFGFVPLFTAVQVPWTTPPILSGFLVGGVPAAILQGIVLSISFFIYFPFLKKIDSANCKKERQTKNDGAAEKMND

SEQ ID NO: 5524 - protein, 499 aa, Enterococcus faecium
  misc_feature (B) LOCATION 1...499
  hypothetical: YES
GMKEKEFLQEVKEINLLQQALGILDWDTQTGMPEKASAYRSEVDSYLYSIYFSKKIGPKIKEAIRYFSEHPEELSEVGTAVFAKVKEEYDLEHRVPEDLMRKYTAAVSSAHGQWQKARETQQFSDFQHALNQNIELTKQLIPYWRKDEKTNYDVLLNQYEPGMTVEILDKVFDQLKEGILSIRRTLQEKGTEPETDFLNRRMTKKQQKRFVVKVIEQLGYDFSRGRLDDTVHPFMTGINPNDARITTRWNETDFKMAVFGVIHEAGHGMYEQDIDDKYAYTPVYEGTSMGIHESQSLFNEIIIGSSRSFWKKQYPFFQECAEGTFDDIPFDKFYRSLNHTKSSLVRIEADSLTYPLHIIIRYEIEKMIFNEGVDVAELPEIWNQKYEEYLGIRPTNDVEGILQDVHWSGASFGYFPSYALGYMYAAQLLHSLQQEIDVENVLASDDYSPIKNWMSEHIHQYGASRKPNQLIMDATHEPLNPQYLIDYMKDLYFNVYQVK

SEQ ID NO: 5525 - protein, 190 aa, Enterococcus faecium
  misc_feature (B) LOCATION 1...190
  hypothetical: YES
AVKEFLKNWGILILVLAAILLARVYVFTPVTVNGHSMDPTLSDGQRLISSKISNYERMDIITTKEPGDEERMIVKRIIGMPGDTVKMENDQLTINGKKYDEPYLDEFKKEFSEDKLQGEYAYSSGFQAQAESSSTFTSDFEYTVPKGKYLVLGDNRLISKDSRMFGLVDKDMIQGKVVFRYWPLSEIKIM

SEQ ID NO: 5526 - protein, 101 aa, Enterococcus faecium
  misc_feature (B) LOCATION 1...101
  hypothetical: YES
MTKEVEIMKYYDVTFHELSGKTVVKRDIPSEKNGFDVWKDACADYNENELFILINDGAYVTMNRKFIVRIDTEEVEDPTEKARSRKDEIMGVVNTLSNMGF

SEQ ID NO: 5527 - protein, 89 aa, Enterococcus faecium
  misc_feature (B) LOCATION 1...89
  hypothetical: YES
ERKETLMKTQHKLLTVEEVVQILVDKEVISEKVAEALLSPRHWTIEIPLVEDGPTMLFEDLVKIAGYELHYQENMETYENEYWLTKLEN

SEQ ID NO: 5528 - protein, 97 aa, Enterococcus faecium
  misc_feature (B) LOCATION 1...97
  hypothetical: YES
QGKDFFIFGMFFRPPIVPTIPFKYGISTTHMKGKASPVIISSDFGLGRIEIVKNDSTLMVYNLEIAFVNMLKPTYDTDFEQFILTIKGYVAYRLSYY

SEQ ID NO: 5529 - protein, 244 aa, Enterococcus faecium
  misc_feature (B) LOCATION 1...244
  hypothetical: YES
VVEEAFGENSKPQPAGSSELAEVSEDGLTYKIKLREDAKWSNGDPVTAADYVYGWQRTVDPATASEYAYLYAPVENAEDITAGKKDKSELGIKAVGDYELEIKLTKQTPYFQYLLAFPSFFPQKQSVVEENGDAYASASDKAVYNGPFTLEDFDGPGTDTEWTYKKNDHYWDKDTVKLSEIKVSVVKESSTALNLFKDGQADDVILSGELAQQNANDPAYTSVKEARTSYIEFNQREKTHHSTM

SEQ ID NO: 5530 - protein, 427 aa, Enterococcus faecium
  misc_feature (B) LOCATION 1...427
  hypothetical: YES
RGEDLLVAEDRLGYGRVICAVWLLSIVEKKLHKVVPDAVDIIVTPTLSLIAIGLIEIFFIMPLAGFISDGMVGGINWVLGVGGTFAGFVLGTLFLPMVMFGLHQILTPIHVQMIDETGRTLLLPILAMAGAGQVGAALALWIRCKKDKELTEMIKGALPVGILGIGEPLIYGVTLPLGRPFITACIGGGIGGAVIGMIGNVGAIAIGPSGAALIPLISDGKWLGYILGLLAAYAGGFVATFFFGIPKDRLEKEELATETATVNEVPEKVVPQTSAESVTILSSVADGTVVSLDKASDPVFAQKMMGEGYFVEPENGHIYSPVTGVVSSVFPTKHAIGITTPNGLEILLHMGINTVDLGGTPFDVKVTEGQQVTPDTLVAEADLEAIKAAGKETSMIVLVTNMDRVKNFVLEKTGKAKAKAPVMDVKA

SEQ ID NO: 5531 - protein, 648 aa, Enterococcus faecium
  misc_feature (B) LOCATION 1...648
  hypothetical: YES
MTEERSLVERAKEYDASQIQVLEGLEAVRKRPGMYIGSTSSEGLHHLVWEIVDNSIDEVLAGFATKIHVIIEKDNSITVIDDGRGIPVDIQAKTGRPAVETVFTVLHAGGKFGGGGYKVSGGLHGVGSSVVNALSTQLDVKVYKEGNVYYQEYRRGAVVDDLKIIEQTDRHGTTVHFTPDPEIFTETTEFDFSKLATRIRELAFLNRGMRISIEDKREEEPVINEYHYDGGIKSYVEYLNANKTVIFPEPVYLEGEQQDIAVEVSMQYTDGYHSNIMSFANNIHTYEGGTHESGFKTALTRVINDYARKQKLMKENDDNLTGEDVREGLTAVISIKHPDPQFEGQTKTKLGNSEVRTVTDRLFSEHFMKFLLENPSVGRQIVEKGLLASRARLAAKRAREVTRRKGALEISNLPGKLADCSSNDPEKCELFIVEGDSAGGSAKQGRNREFQAILPIRGKILNVEKASMDKILANEEIRSLFTAMGTGFGEDFDVSKARYHKLVIMTDADVDGAHIRTLLLTLFYRYMRPIVEAGYVYIAQPPLYGVKQGKNITYVQPGKNAEEELKQVVASLPASPKPSVQRYKGLGEMDDHQLWETTMDPSNRMMARVSVDDAIAADQIFEMLMGDRVEPRRAFIEENAHYVKNLDI

SEQ ID NO: 5532 - protein, 66 aa, Enterococcus faecium
  misc_feature (B) LOCATION 1...66
  hypothetical: YES
VTEERGTLTAIEADCTRTLYISDAREIEHADPEDETTSNMESNTMSGLCTSHIPEQITQVKRKRGK

SEQ ID NO: 5533 - protein, 89 aa, Enterococcus faecium
  misc_feature (B) LOCATION 1...89
  hypothetical: YES
CKEDSASKPALSVHLLVFQPCGGGLPAGGGRGYGDKGNGRSIRPGGADFQKPAAQLLPARPAARRCRRGHYPGRSLFQGEKRQEIPPRS

SEQ ID NO: 5534 - protein, 116 aa, Enterococcus faecium
  misc_feature (B) LOCATION 1...116
  hypothetical: YES
KKEDFLLGEIIMKDYASRKFIHLEPMKELVINGNEYNDYKSLFVKEQPKGGIRMKNLPDFRFIEVNNLGIIEDYLDKLDEAIKQSIEKNGEDHILTVVLKDLKDRLEAEAEYFNKD

SEQ ID NO: 5535 - protein, 106 aa, Enterococcus faecium
  misc_feature (B) LOCATION 1...106
  hypothetical: YES
REEDIEEEETFESFEEARQAYEKQWNEIHQNYEYINAKSNFLSAFWNDGDERWCEECDDDLQQYKGLALLKNHQPITVESRKEFYETTNSSGKTKRCERPKQGAWC

SEQ ID NO: 5536 - protein, 60 aa, Enterococcus faecium
  misc_feature (B) LOCATION 1...60
  hypothetical: YES
IKEELFQKVKEIINNGHFGCAKRFIGEHKEQLGPYKEKAQNLLKDVNIDSVKDKFKNLFK

SEQ ID NO: 5537 - protein, 161 aa, Enterococcus faecium
  misc_feature (B) LOCATION 1...161
  hypothetical: YES
EEEEKMKEVQLIRKSELSEGGCNACGVVEATSYTLKLDSNQAIISELTVGGLVDSLALAEGFTGEDIYEMFSEVRQLKKGEKCIEVHHESPNVRFKRGDNEMIFKNHVSDHTELYEIVNQILSGIFELGPYEFKEENGNPKLNEEWQETIETQRNNPHLFQ

SEQ ID NO: 5538 - protein, 282 aa, Enterococcus faecium
  misc_feature (B) LOCATION 1...282
  hypothetical: YES
EEEEMNNTVTKWFQYGFILLLGLVMIYPVLWMIAGSFKTDQEIMSGSLNLIPETFQWENYAKGWAGFAGISFFTFFRNSFVISAVSTIGTVLSSTCIAYALSRIDFKGKRFWFVVMLVTMMIPAQVILIPQFIIYNRLNLVGTYVPLILPHFFGQAFFIYQIMQFMVSIPKELDESAIIDGCSKYSVFTKIIFPLLKPSIITTIIIQFYWKWDDFMGPLIYLNKPRSYTVSIAIKLFADAGSSTTYASMFAMSTLSLLPVFLIFLFFNKYLVQGISTSGLKG

SEQ ID NO: 5539 - protein, 247 aa, Enterococcus faecium
  misc_feature (B) LOCATION 1...247
  hypothetical: YES
RREEDAVRCSCCSKDIVQNLTFSEIIGVSKYRLPQTCSVCRAQFHLLETRGCSGCQKPIHFNLESTKKKVKSIPVYCSDCQEWKKKYPTYDFQHRAFFVYDENMKAWLNQYKFMGDIRLAGTFAYKWTQIKKEYPTYIYCPIPLSEKRRTERGFNQVSEMLKAARIPFQMLLKREKHLLAQAKNTRKERLEMPQPFELAVTFSKIQNKKILIIDDVYTTGQTLFHAADCLQVAQPKNHPNHFILTQI

SEQ ID NO: 5540 - protein, 225 aa, Enterococcus faecium
  misc_feature (B) LOCATION 1...225
  hypothetical: YES
LKEENAPIGIRLVINFGQMKTAVPSWWCLKLLTANLILEQLPEKVKGHPLVTVINEEINEIPEGITVVATGPLTSHPLAESIKAFNGSDGFYFYDAAAPIVDKATIDMDKVYLKSRYDKGEAAYLNCPMTEEEFKAFHEALINAEVAELKSFEKEKYFEGCMPIEVMFKSYRGFFHSMIQESSANMLDDVETIDDQLSIREKLFHQRNIRRIHINNNQLNGFTSR

SEQ ID NO: 5541 - protein, 272 aa, Enterococcus faecium
  misc_feature (B) LOCATION 1...272
  hypothetical: YES
RKKDVAIMVKTHQDDVSAYQKRLIELGSEAKKNKLELMVDISGEALERAGFSLEDLTPLKAIGVTGLRMDYHISNQQIADWSHQLKISLNASTITPKDIDELKEAEADFSQIEAWHNYYPRPETGLDKEWYQKKNQWLKIQGLLVQGFVPGDTELRGPLYQGLPTLEEHRGIHPLAGALDLLASNTDIVYIGDAGLSENVQEQFASFQKEQTVLLHTEPVDEEFYEYILGKHTNRQDDARDVIRSVDARFREIPPIPARNTATRMKGSITIR

SEQ ID NO: 5542 - protein, 319 aa, Enterococcus faecium
  misc_feature (B) LOCATION 1...319
  hypothetical: YES
IYREPRRILLMVKAGPATDATIQELLPHLDKGDILIDGGNTFFKDTMRRNEELANSGINFIGTGVSGGEEGALKGPSIMPGGQKEAYALVAPILEQISAKAEDGAPCVTYIGPNGAGHYVKMVHNGIEYGDMQLIAESYDLMKNILNLSVEEMADIFKEWNQGELDSYLIEITADILTRKDDEGTGKPVVDVILDAAGNKGTGKWTSQSALDLGVPLPLITESVFARYISAYKEERVQASKILSRTNDFEFTGDKKELVEKIREALYFSKIMSYAQRFAQLRVASKEFDWDLPFGEIAKIWRAGMYHPSSILAKNYGCL

SEQ ID NO: 5543 - protein, 268 aa, Enterococcus faecium
  misc_feature (B) LOCATION 1...268
  hypothetical: YES
QIRERGFKMNLDYYVVDAFADEVFKGNPAAVYVLEEWLPEGTMQKIAIENNLSETAFTVKKNQEFELRWFTPDREIDLCGHATLATAFVLFNYYKIPDETIKFSTQSGNLFVTRIKDYYYMDFPSIMPKKVPILSEYEEAIGAKIKEAYLARDLFFVLEDEKTVAKLQPDFTAIKNFELGIGVIVTAESVQKDFVSRTFFPKLTINEDPVCGSAHSNLIPYWAERMNKTKLSAYQMSSRGGDLECELKEDRVIIGGKAVLFSKGTSFI

SEQ ID NO: 5544 - protein, 62 aa, Enterococcus faecium
  misc_feature (B) LOCATION 1...62
  hypothetical: YES
NVRDIKRTNLSMYIAQSGVRTEKVRTSLSRSVSFKVSNRYTVDIIPKGGSKLLGIQSFRKML

SEQ ID NO: 5545 - protein, 200 aa, Enterococcus faecium
  misc_feature (B) LOCATION 1...200
  hypothetical: YES
PNREVRKMLIDVREKKNFLTWMVNHVSFSRREVFWILNYLANHEAILSNVHFVEGANFADRGLQISDLSVEGEPMKLFLQGKEFTDTDQIFHEIRLNWKKPLYVECIFENAWQTREYLSILEDNPFSSWDSSVSEEDTELIERYFQEKEEEAKLKMLYAQIDQALEDGDRDAFLKLSDEVNRKILLQTQKKSNRVSEHNN

SEQ ID NO: 5546 - protein, 344 aa, Enterococcus faecium
  misc_feature (B) LOCATION 1...344
  hypothetical: YES
VMREFEKSNKLEGVSYDVRGPVLEEAERMQEEGISILKLNTGNPAPFGFEAPNEVIRDLIMNARDSEGYSDSKGIFFARKAIEQYSQLRHFPNVTINDIYTGNGVSELITMCMQGLLDNGDEVLVPMPDYPLWTASIALAGGTPVHYICDEEAEWYPDIDDIKSKITSRTKAIVIINPNNPTGALYPKELLEEIVEVARQNNLIIYSDEIYDRLVMDGLEHIPIATLAHDLFVVTLNGLSKSHRVAGFRVGWMVLSGDKSHVKGYIEGLNMLSSMRLCSNVLSQQLSQPALGRLSKVSDELLLPGGRIYEQREYIYNAINDIPGLSAVKPKDAFNIFPKTERTD

SEQ ID NO: 5547 - protein, 127 aa, Enterococcus faecium
  misc_feature (B) LOCATION 1...127
  hypothetical: YES
SKREGEKVKKLLIGLLVFIVVVLAGVKIADYVVMGGEEYYVQITTDGTKTVSKSDSGQETVNYRYILPGYTKEGKEKELDFKGQLTRPLRKGAYLKITWNKNKGVTSYEEVEKKDVPKTALEKLIKG

SEQ ID NO: 5548 - protein, 152 aa, Enterococcus faecium
  misc_feature (B) LOCATION 1...152
  hypothetical: YES
VRREKMIRTTTKLSAKELESVLSIWLHANLDSHEFIPSTYWENQVESVRKALPDAVIYLAEIDQEIIGFAGVIDQFIAGIFVKREYRQQRIGTQLMKKIKETNKTLTLTVYQKNQSAIHFYLSQGFTIQTQQKDEAVNEEELVMKWNQNADF

SEQ ID NO: 5549 - protein, 264 aa, Enterococcus faecium
  misc_feature (B) LOCATION 1...264
  hypothetical: YES
ESGEKMEETISLKEIFETLRKHVITILISMFAGLAISGIVTFFILTPKYSSQAQLIVTLPQSDTANVNDVNTNLQMINTYKDMIVSDLVLNEVKDRLETEDNVKMTAGQIKDAISVNQSQNSQMFSIQATSTNAVTAQQIANTTSQVFQENAKDVMNVDKISIISGAVANTTPISPNNKLNLVIGLVLGMMVGVGLAFLFELLDRTVKDEKYVTDTLGFPILGTVSEMSAKELNAGIRKKGPAQTQPKATNDKTAPSRRSRSRV

SEQ ID NO: 5550 - protein, 161 aa, Enterococcus faecium
  misc_feature (B) LOCATION 1...161
  hypothetical: YES
KIGEKVEKKVFVIWEVVKSRVQEMNEHFSVSFAENPSKYFRRLVFLLILSLLLTVAMFLLPEKIREEQVNSLVYSSIPTSKLKPFDYSKADQKIKQSRAISVMFSKPNGKTYQDMLDVFNDPELMEELNRPIFYYPIVYDVHELEQKYNIRTDEVTFIFFD

SEQ ID NO: 5551 - protein, 416 aa, Enterococcus faecium
  misc_feature (B) LOCATION 1...416
  hypothetical: YES
LKGENTMYENLLPRFLRYVKTETRSDATSKTTPSTQTQVAFAQELKKELEELGLADVFYNEDNGFVMGTLPSNVDHEVRSIGFISHMDTADFNAVGVNPQIIENYDGESTIVLDAEERYTLNTKDFPNLKNYEGHTLITTDGSTLLGADDKSGIAEIMTAMEILINNPSIPHGTIKVAFGPDEEIGVGADKFDVEQFDVDFAYTVDGGPLGELQYETFSAAQANITIQGKNVHPGTAKDTMINALQLAIDFHNQLPADEVPEKTEGYEGFFHLMALDGNPEEASMSYIIRDHDREKFEARKAQITHIQEELNQRFDQERIKVDMYDQYYNMKEIIEKDMSIVELAKQAMIELGISPVIEPVRGGTDGSKISYMGIPTPNLFAGGENMHGRFEFVSLQVMEKATDVIVKIAELNTKS

SEQ ID NO: 5552 - protein, 306 aa, Enterococcus faecium
  misc_feature (B) LOCATION 1...306
  hypothetical: YES
NEGEKSAMYSQKENLKKLKKTYKEQAIPKGLKEEIRQRFIIEEQSFIKAKRRKRRLQGFGVSLAIVMITTSSLLFNSQVRSFAEDLPILGSVIELILGERFTDRSEKIDIQVPKINTQNEKENKTIHGLNQKYFREGQADFEKAEKEYGNFETDHYQVLGDYQKIVDDNRFLVIERQITQTAADSHVEKRYDTIDKKNSVQLSLPLLFKDDTYLSVLTKEVKRQMAEQVKEDPSKYYWTEQDIQEGTIEKPTLVTPTRSFYLNKEHQLVLTFSQYEIAPGYMGTPEFVIPKSVTKTILASEDYLDH

SEQ ID NO: 5553 - protein, 282 aa, Enterococcus faecium
  misc_feature (B) LOCATION 1...282
  hypothetical: YES
RQGEISTLYAYFADITEPNERTKVFGWMGALVGIGTTLGPIIGGLLAELGNSVPIFIGALFTFLNAVYGYTFMLESLPIKKRSVDLSFSHVRPFHQLQQLFKISSVIPLLTAGFAVWLAAGSLQSIFSQFSIDAFQWKAGLVGLSFSLIGILDTVSQLFIMPRLLKKFSEQQITRIGMFSEILAYLFITLSGILLLPILFLFGIICYGFGDSIFTPVFNGQLSNSVSDNQQGLVMGGTQSIQSLSRVIGPLIAGQLYAAAPFLPTVFGFLLMIFAYYHYNKK

SEQ ID NO: 5554 - protein, 227 aa, Enterococcus faecium
  misc_feature (B) LOCATION 1...227
  hypothetical: YES
LGGEKMIFSITMKLVFGLIGLLLVVRLLGKKSMSEITPFDLVYTLVLGGILEESTYDDNVHVGHVLFAIALWAVMIYGIERIVQKNEKVNRWVKGEPSVLIKDGVINMTELTNNHIEMEQLRAILRQQECFFLENAKHVILENAGQMSVLKKSDEDKALSILLVDEGQIQHKVLQSNQLTEAWLMENLKKEGYADVKQLIYVEWSEEKGLYILNKEDVMHESYRIDG

SEQ ID NO: 5555 - protein, 386 aa, Enterococcus faecium
  misc_feature (B) LOCATION 1...386
  hypothetical: YES
FDLEPRGWPSSIEYEINSTNCGENTIGEGFFTAVVVERMWWTMNQSKRLFVSFFSILSLFFIFPSISQAKDSAGDFGIKPVFPENQIDKAIGYFDLLVAPEQNQTLEVIISNSSDEERTFEVSVNPAVTSDGGTIDYSQKNPTLDETLPFDVRDVLLIAKKEINVSAHAETTIPIEVKIPAKSFKGRVLAGIHVSPKEEAETENATEGAQIKNRIAYNLAVVLQESQETIEPDLKLLSGDLDEVNAKPTVQLRFQNPQPRIISNLIFTSKIFYENQLYIENTSNEFLVAPNSNFHLNLDLAGDKAKAGDYRAEIIAKSGDSNEWRFTQNFTIKKEKAQKVNENSVFAVQEQSFPWLYAGLVAAVLVLWLILLFLWVHKKKKKGETT

SEQ ID NO: 5556 - protein, 68 aa, Enterococcus faecium
  misc_feature (B) LOCATION 1...68
  hypothetical: YES
IPLEDIRSIQIIAINIDGTLLNEERELTKEVKEAIAAAVAKGVSIVLCTGRPLPGFQEQLERVEPFSR

SEQ ID NO: 5557 - protein, 200 aa, Enterococcus faecium
  misc_feature (B) LOCATION 1...200
  hypothetical: YES
LELEELGVETVRLWIFMKNFRSALRYVILESKSGYYLIDTDHYTFWGGYLFPIFNWIIPHKVMKINLPAEEINRLILNKDLQRKREKEHSNVAWIGPAFAVVTSSIVGPMLESIYSDFSIGIRYLFVTLSIAVLLCIKGYVSKKNKDILTLIGVNNLSSTKIILFPESIKEGSRLLIIFIMLILFSVLFGVMFIDYYLSN

SEQ ID NO: 5558 - protein, 241 aa, Enterococcus faecium
  misc_feature (B) LOCATION 1...241
  hypothetical: YES
NGLDERSLTFHIGPIWFDGTVCIMVLLTCLIVFFLAYFFTRNLKLKPTGKQNAIEWVIDFSRGIVTDNLPRKELSNFHLLAFTLFLFVFVANNIGLVTKIVLPNETTLWKSPTADPFVTLTLAFIMILLTHLFGVKKLGFKGYFVNSFLKPYSFMFPMKLIEEFTNLLTLALRLYGNIYAGEVLLTLIAKMVISLGWFSLPLAIPLEMVWIAFSLFIGSIQAFVFVTLSMVYMSHKIEVEE

SEQ ID NO: 5559 - protein, 137 aa, Enterococcus faecium
  misc_feature (B) LOCATION 1...137
  hypothetical: YES
NELEETAMPKGEGKLIAQNKKARHDYSIIDTMEAGMVLQGTEIKSIRNSRINLKDGFIRVRNGEAFLHNVHISPYEQGNIFNHDPLRTRKLLLHKKQIIRLENELKNTGITVVPLKVYIRNGYAKVLIGLAKGKKSL

SEQ ID NO: 5560 - protein, 213 aa, Enterococcus faecium
  misc_feature (B) LOCATION 1...213
  hypothetical: YES
NLSLEEVILLQSIFSAIAVYISTSIDYLFILLIIFSQSHTQKGIRHIFWGQYLGTGILVAVSLFAAYVLNFIPQDWIIGLLGLIPIYLGIRVAVIGEEEEEEEEVVEKLESRGTSWLFWTVALITIASGGDNLGIYIPYFTSLAFSEIVITLIVFAFSVAILCYVSYKLAKISFVSETLEKYERIIVPIVFIGLGIYISIENGTIQTLLSLFN

SEQ ID NO: 5561 - protein, 62 aa, Enterococcus faecium
  misc_feature (B) LOCATION 1...62
  hypothetical: YES
AKLEEEAHVAEVPVIPHETVVFLKFLLGQLQPERILEIGAAIGFSSSVMATTIGEKRSCYDN

SEQ ID NO: 5562 - protein, 233 aa, Enterococcus faecium
  misc_feature (B) LOCATION 1...233
  hypothetical: YES
KMLEQLKEEVYQANLDLPKHGLVKYTWGNVSAFDPETRYFVIKPSGVSYEEMTADDMVVVDLDNHIIEGKLNPSSDTPTHAVLYRSFPQIGGIVHTHSTWATIWAQAGLDVPAMGTTHADTFYGSVPCARFLTQQEIDSGYEYETGKVIIETFKERKIDPLAIPGVLLHGHGPFTWGKDAQSAVMNAVVLDEVCKMNLFTRQLNSFSEELPQRILDKHYLRKHGKNAYYGQNK

SEQ ID NO: 5563 - protein, 538 aa, Enterococcus faecium
  misc_feature (B) LOCATION 1...538
  hypothetical: YES
KWLEGKRQEMDRMYKRQLLELIRVNLLYVNPQLTNKAREKGKKGKRLTIYLLSQNLFSGLIFLLIYGFAMFAMNFVKLPGFFTYYVALFGMLGLTQSISVIYNIFFEGNDLQVFLPLPFGQEQVFSAKILVVALTIIPFVFPLLVMFILTGWRADLGILLTIIISILLFSLFLIILFCLASLIVFGLARTAVFKKHRKTVSSILLGSSMLIAFAGIMWMNHQTGTIENELTDRHPISILLPFYDAASQPLSQQGLLGWGILAITALGFFLAVKQLIVPKLTEQLTDSNSEFKIKRTHKKNQNVHQLLFSYNAQLVKEPNLIMQVLSSSLLTPIIFILAFALGGEIKLTDLDNKLIGVVFLVGIALAFLTVNQTSFISNLISLDQENFLFIRSLPISMNQYLKEKFRFGWILQSFLTGGIALLSGLSFQLPLFFIPSLLFGSLFGCYLLSLRYFARDYRLLLLNWTNINQLFNRGSGSLGLVATMMGSLIISIILIVLYGMLALFYPFWLVNIPVIGLVLILSALWIVYYQRTFWKKFE

SEQ ID NO: 5564 - protein, 550 aa, Enterococcus faecium
  misc_feature (B) LOCATION 1...550
  hypothetical: YES
LIMEKPNRNWASKREKKAQRLEKISNLLNGKYVETEKIVEVMEKLIAPGDKVVLEGDNQKQASFLSESLEKVDAEKVNDLHLIMSSISRPEHLNIFEKGIASKIDFSYAGAQSLRVAQMIEDGTMKLGDIHTYLELYGRLFIDLIPNVVLVAADKADKDGNLYTGFNTEETPTIIEAAAFKDGIVIVQVNEVVDSLPRVDIPGDWVDVVVKADKPYQLEALFTRDPQNITELQILMAMMAIKGIYAEHGVQSLNHGIGFNTAAIELLLPTYGESLGLKGKIAKNWVLNPHPTMIPAIESGWVESIHSFGGEVGMEKYIAARPDVFFVGKDGTMRSNRTLSQAAGQYAIDMFIGSTLQLDYEGNSSTVTKGRLSGFGGAPNMGHNPGGRRHSTPAWQSLRDNDDPLGKGQKLVVQMVETYGSNKKPVFVEELDALAVQKQAGLANAPVMIYSEDTTHIVTEEGIAYLYKAKTKEERQAAIAAIGGVTPLGMTSTKESLDSLRAAGIVKLPEDLGIKRSEAKRSLLAAQTIDDLIEWSDGLYEPPMKFRTWS

SEQ ID NO: 5565 - protein, 88 aa, Enterococcus faecium
  misc_feature (B) LOCATION 1...88
  hypothetical: YES
NYMEIRRQKEVVEAFHYDMRLPNQEVETDLKVGFSPLKETIENYPKEHSIVGARLEFRLVFDTYVLSGSVSQINHILNRKIEGQNDVT

SEQ ID NO: 5566 - protein, 213 aa, Enterococcus faecium
  misc_feature (B) LOCATION 1...213
  hypothetical: YES
RDMEGYAMKISHLGNNIQTIRKFRGMKQQELADKIGINMQSLSKIERGLNYPAYETLEKIMEVLDVTPNELLSGEWKYVNQSEKEVCQFLRAEERLNAELKHGHYDNFFDSEEEWLEYELEKLREYITDYINGTNIEASDLYPIKEFIQHLKFQKLLDRYDDLYSMDMFGESIEGHKYRTPYQVVKMINPNSKEDMELLREVLRNNHFDDEDE

SEQ ID NO: 5567 - protein, 120 aa, Enterococcus faecium
  misc_feature (B) LOCATION 1...120
  hypothetical: YES
LGMEKISFETFKRPNGHDEFLEWLETLPKKDSAKLLRTIEETEKNGMLVAQRLKWVKKLDTNLYELRSKVGSNIQRAIYFHVVNGRYVITHGFTKKTEKTPISELKHAKELREEWFTNDD

SEQ ID NO: 5568 - protein, 397 aa, Enterococcus faecium
  misc_feature (B) LOCATION 1...397
  hypothetical: YES
LIMEIKRSLNTKFAETFGPKKTTQYFSPGRINLIGEHTDYNGGHVFPASITYGTQGVAAPRDDNKILVYSTNFDDIGVISFTLDELEYDKKANWANYVKGMVLKLKEAGHSIDHGFELLVEGTIPNGAGLSSSASLELLVGVVLEDLFDLKTDRLELVQTGKKVENEFIGVNSGIMDQFAIGFGELDHAILLDTNTLKYEMVPVKLDGYAIVIMNTNKRRELADSKYNERRSECEEALARLQKTLPISSLGDLDEEEFESTIDQIGDDTLIRRARHAVSENQRTLKAKAELEAGNLEAFGQLLNDSHHSLRYDYEVTGIELDTLVDAAQKQEGVLGARMTGAGFGGCAIALVKEENIPAFKNNVYDEYMKVVGYAPEFYVAHIGNGTTKIDPEAVHV

SEQ ID NO: 5569 - protein, 64 aa, Enterococcus faecium
  misc_feature (B) LOCATION 1...64
  hypothetical: YES
FYMEDYPSPAEGNGLENRQAGKTVQGFESLILLFHIIAGWSSLVARRAHNPKVVGSNPAPAIKN

SEQ ID NO: 5570 - protein, 61 aa, Enterococcus faecium
  misc_feature (B) LOCATION 1...61
  hypothetical: YES
DNMEKMTCPNCGKKFAYEEVNNVVEHNDKEMPVVCPYCRTEAARIVTHGYFITEKIEDFLK

SEQ ID NO: 5571 - protein, 126 aa, Enterococcus faecium
  misc_feature (B) LOCATION 1...126
  hypothetical: YES
ANMDKMKIQEIIVVEGKDDTRRLREVVDADTIETIGSAINEEILMQIEHAQETRGVIVFTDPDFSGEKIRKIIMEAVPQAKHDFLPRKQAKPKKKGKPWCRACKRCCYFRSIEKGRDARHFPNGCF

SEQ ID NO: 5572 - protein, 423 aa, Enterococcus faecium
  misc_feature (B) LOCATION 1...423
  hypothetical: YES
EGMERDTDREKMWQALSDEDLSQAQIFLEKALNADPADILAEVGEELLAIGFLIEAKQIFEQLINQYPENDGLNIPLAEIAIEDNEIDLAFEYLEKVDKQSDYYPQSLLAIADLYQVIGIPEVSEAKLKEAAGLLPDEPLIQFALAELYFSVDRFKEAAVVYETLLASGINEISGISMQERLGQSLSMQGEFEAAIVPLEEALKEERTDDRLFQLAFTNLQLKENQQAINYLEELREVNPHYQSLYLYLGQALQEEEMIEEAQTVLEEGIKENPYQVELYHLASENAFRLHDRQRAEELLLKALEVGDKQDETLLTLSNLYLDDERYEDVIQVINQMEETANPYAEWNLAHAYNELEDFTVAAVHYEQAYHELSHEPDFLKEYAFFLREEGQLKRAQELLTYYLTLEPGDMEALSLLDDLTER

SEQ ID NO: 5573 - protein, 136 aa, Enterococcus faecium
  misc_feature (B) LOCATION 1...136
  hypothetical: YES
ILMEEVCNMSDNDERVNAQLIRFFEKVILNTANTYYKKQEEIQKHEQLDQLPPYLFTKDTIKFKQPINVLNVTLLVEDIKLAKILPLLKEPEQIFLIEKFIFDKTDKEIGKVLGITRQGATNLKHRLYKKIQKMLV

SEQ ID NO: 5574 - protein, 112 aa, Enterococcus faecium
  misc_feature (B) LOCATION 1...112
  hypothetical: YES
VIMEEEKMNKEELQMLGFEIVAYSGDARSTLLKLLKEVRQGNFEHVDSALKEADENLTLAHNSQTKILAEEASGKEMEMGFIFIHGQDHLMTTLLLRDLIQDFIVLYRQNQG

SEQ ID NO: 5575 - protein, 132 aa, Enterococcus faecium
  misc_feature (B) LOCATION 1...132
  hypothetical: YES
QTMDIITKFAEGFMRLFQTGAETFISWMTGIVPVVLMLMVAMNTLIAFLGEDRVTKVAKLSAKNPLTRLLVLPFLICFYGGNSNLIQQCFFFSRENPPPGRVFQPIFYKDRGFPPPIFRGGFFWRGGGCFRG

SEQ ID NO: 5576 - protein, 76 aa, Enterococcus faecium
  misc_feature (B) LOCATION 1...76
  hypothetical: YES
SAMDAYTKKVSVSCLIFVHRGRKEGKVDLKYSDEFLLLYFQAMVEGISKPEIYAKLLPYTAEWTEVLIKGIAPKKK

SEQ ID NO: 5577 - protein, 102 aa, Enterococcus faecium
  misc_feature (B) LOCATION 1...102
  hypothetical: YES
AQMDSLSKKLAIQVLNDEAERIKRLIRNQNNSLCISQCKAFEEVVDTQMYGFSRQVGFAVRIGVIGKNEGQLMLSELERELNQLYSEVYQEIYDKKEVGKEE

SEQ ID NO: 5578 - protein, 527 aa, Enterococcus faecium
  misc_feature (B) LOCATION 1...527
  hypothetical: YES
VTVDALCLQFFYEKGVIMSILTLNNITQQFGDKILYEGVDLQLNAGEHLGLIGQNGAGKSTLIKIITGEILPDDGQIHWQKNIHKGYLDQYVEVDETLTIEEFLKTAYAKEYEKEEKIAFLYQTYSETFDDSLLEKAGKLQTELDQGVFYQIDTLVAEMSSGLGIDVLGLDSLLKNLSGGQRSKVILAKLLLENPDVLILDEPTNHLDDQHIQWLTQFLQDFDGAYIVISHDQEFLDQITTHIADIEFGKITKYTGHLKQALKQKEQNRESYLRQYHAQQKQIEKTEAYIRKYKAGSRSTMAKSRQKQLDKIERLTPPASASKAVFDFPFSPIVTTLAVETTDLVIGYDRPLLAPINLTIRFGENIAIRGFNGIGKSTLLKTLIGEIEKISGDFHFPDNTKINYFSQDLYWENPLETPLQYLSSQFPKATIKELRRQLAKAGLVNQLASEPLTTLSGGEQTKVKLAQLTMNQGNLLILDEPTNHIDQETKESLQDGIQKFPGTVIIVSHEQEFYQDLVQRVIEIEPK

SEQ ID NO: 5579 - protein, 224 aa, Enterococcus faecium
  misc_feature (B) LOCATION 1...224
  hypothetical: YES
SIVDKSFSETYLDFKQINPETMNQAILDTLYMTLISMVLVTIIGLVLGLILYSIGRKNKPYARIIYGIVSIISNIFRSTPFMILMVLIIPFTKAIVGTMLGAQAAIPALVLSAAPFYARLVEIAFREVSPGVLEAADAMGASYWEIIWKVLIPESIPALISGLTVTTISMIGFTAMAGAIGAGGLGGLAWQEGYQRGNLTVTFVATLIILLIVFIVPVSTTRPR

SEQ ID NO: 5580 - protein, 310 aa, Enterococcus faecium
  misc_feature (B) LOCATION 1...310
  hypothetical: YES
YLVEDVGKELKRIISKRNYQEKYAEMIAEVLNDADVQAFLSAHQEELTQADIEKSYAKLYEFVQEKRKYQKNDPTMIAPGYEPKLTLNFHYVDVTYVPTEALLARQRQEEIRSRVKAMDMPKDIQSASFENFERTDGRGYASLEALDFVEKYTADPKGYHKGLYLVGSFGIGKTYLLGATARELAIAGFTTTLVHFPTFAVEMKQAIGKDQVAEKLDAVKRSPILMIDDIGADAMSSWIRDEVFGVILQYRMQEQLPTFFSSNFTMDELEQHLSVTQRGDEEPLKAKRIMERIRYLTKEIEMTGRNRRNG

SEQ ID NO: 5581 - protein, 213 aa, Enterococcus faecium
  misc_feature (B) LOCATION 1...213
  hypothetical: YES
IGVEESMRKKRPFLLFWLFGFFLLLILSAAFSGKMTADLAQKETEKIVASKESVDNFKKEFSTYWWAEYKITANYEKGELDIYLPKGKEENQFINIDDVLSAISLRQYQFKDKHLTVLLLTHDGDKVARLKNGKVITAYSEKVDKKVVADRLAEWKKTNEQVKKTTVSSQKNESTGTSPSDSGSGQTITGSEENQASIITNESSQGQYQSYGQ

SEQ ID NO: 5582 - protein, 239 aa, Enterococcus faecium
  misc_feature (B) LOCATION 1...239
  hypothetical: YES
TEVEPRIIRPLGICQEDFFILKEEKKMEYLIEVMPQLLVGALTTLKLFLFTLIGSLPLGIVLALGLSLHFKPLRYLLQTYVWVMRGTPLLLQLIFIFYGLPTIGIVFDRFEAALIAFILNYAAYFAEIFRGGIQSIPQGQYEAAQVLQLSPFQTVTKIVIPQVTKIVLPSVGNEVINLVKDSSLIYILGLGDVMRAGKIAMERDATLLPLLGVAIIYLTLTGILTIVMKQVEGKLNYYR

SEQ ID NO: 5583 - protein, 123 aa, Enterococcus faecium
  misc_feature (B) LOCATION 1...123
  hypothetical: YES
KVTEAPKGSLRMVGNHSKSVKAEGSLTARPTSRAGTKVGLSDPVVPHGRAIAQRIKATLGITGLSPPRVHIDGEVWHLDVGSSHPGAVVGPKGWAVRPLKRHASWVQNVVRQFGPYPSRALEI

SEQ ID NO: 5584 - protein, 123 aa, Enterococcus faecium; identical to SEQ ID NO: 5583
  misc_feature (B) LOCATION 1...123
  hypothetical: YES

SEQ ID NO: 5585 - protein, 303 aa, Enterococcus faecium
  misc_feature (B) LOCATION 1...303
  hypothetical: YES
TKTEVALIKGQIRKAISGFYYVYANGETYQTRGRGNFRNRKITPLVGDQVIFESENQTDGYLLEILPRKNQLVRPPVTNVDLGIIVTSIVEPAFSYNLLDRFLVTLEYESIEPIIFLTKTDLSDDPEKIEEIKQTYTKIGYPVIVPNHTGDTTELIRYFPERLSVFMGQSGAGKSTLLNQISPELNLATGEISDALGRGRHTTRHVELIPIYGGLVADTPGFSSIDFLTIEAGELPRQFPEFVEASVHCKFRECMHAKEPGCEVKHRVETGGIAQTRYDNYLQFLQEIEKRKPMYAKKEGKRK

SEQ ID NO: 5586 - protein, 76 aa, Enterococcus faecium
  misc_feature (B) LOCATION 1...76
  hypothetical: YES
KKTEDSYLLFDTEPTPYQEKRNGEPSVRTFNRTKTLEETKQSEEKKSKKSHGILERSLQGLIDDQGNSLGENSYFK

SEQ ID NO: 5587 - protein, 193 aa, Enterococcus faecium
  misc_feature (B) LOCATION 1...193
  hypothetical: YES
EKTEIIGEVMLMPIYEAATIDEAVQLGLADLGLAKDQVEIEILEEGKKGFLGMGRKNARLSIQPSISEKVSETVEQTVEEILEEEPTAEIEVVNETILEEKTEEVSELGDEAALTELAVYLTEISKQLDAPALVKMERESNNMVVSHGETQKQGILIGKHGKTLNALQYLAQVFIHRLARNQAVCSSQCRQLP

SEQ ID NO: 5588 - protein, 80 aa, Enterococcus faecium
  misc_feature (B) LOCATION 1...80
  hypothetical: YES
GKTELFVTLRPIKKVLEDILSFAAQGGYDVLELSYSPITGGEGNIEFLAHLRKVPESGTINSAINMAEVVSNAHEQFDHK

SEQ ID NO: 5589 - protein, 242 aa, Enterococcus faecium
  misc_feature (B) LOCATION 1...242
  hypothetical: YES
RRTDMSVFNNKVMLGNCYVNHIGFYDGGTYRVLFLRLSVFSYSKDGKGHYENINAQISCPLDRNGETTTTSSHPKALMNKFIFEKLDRNLVEGMKISIHGNIRGTEQVLLNSGWKNFGQLSPLEKEEYQKIPKNELVTRNQTYIYIEEVSMPEKEEFRKSQSKVTKEDVEVAEPNQADEILSDDTDPVNDEGEVIEVFEAEIIEEEEEIKSFDKRMYREKPKGYVNFEDMYYDEYSNEPPIN

SEQ ID NO: 5590 - protein, 219 aa, Enterococcus faecium
  misc_feature (B) LOCATION 1...219
  hypothetical: YES
KKTEEIIIAHVKNTGRGKEVLIPGAEVAIVFAPGPKRKTAYDLIAVKKKGDWFNIDSQLPNRLAIDGILDGTILLPGLTGPFTVYKREVTYLHSKFDIYLETVVGQKAFVEVKGMTLENKAIGAFPDAPTLRGLKHIGELTYAAQDGYAAYVLFIAQFEHLHLATIHEEMQPALADMVRHAQQSGVQILAYNCQVSADEVTVKQAIPFDVDIPFEDPIQ

SEQ ID NO: 5591 - protein, 184 aa, Enterococcus faecium
  misc_feature (B) LOCATION 1...184
  hypothetical: YES
KETEVRMMGRVTNYSKEYLLFKSMVYVEEYGMKSITARELAEFCGCSTYPIYTHFKSISGLKEKILEEITVYFENYLAECSSDDVLSIVYLLKDFFSIHESIREIIAKSDLDMDSLFKRPFFSYVKGHTKIKEEKSLELVWLNALGSLRSDDSSQDFLEMMNAVWDKNEVTDEYLENILKEQSP

SEQ ID NO: 5592 - protein, 355 aa, Enterococcus faecium
  misc_feature (B) LOCATION 1...355
  hypothetical: YES
RNADGTIGPRIYQDLMNGVSHMLPFRYWWDDSLLRLSFMIDQFIGVPHDQLSNLGNYNQAASWFNQIGQAAFGFMLPVLAGFIASSIGDRPGLIVGFAAGALTNTGGAGFLGALIGGFLAGYVIVFLRKLFKNLPKSLDGIKTILFYPVFGLLITGFLMLLVNVPMKAINDALNGFLTSMSGSNAALLGALLAGMMAADLGGPINKAAYVFGTATLATTVATGGSVVMASVMAGGMVPPLAIFVATRLFKNKFSKTDQDAGLTNIVMGLSFVTEGSIPFAAADPIRAIPSFIIGSALTGGLVGAFGIKLLAPHGGIFVVFLLSHPVMYLVFIAIGAVVSGVIYGLLRKAPAVAEA

SEQ ID NO: 5593 - protein, 117 aa, Enterococcus faecium
  misc_feature (B) LOCATION 1...117
  hypothetical: YES
LGADWGCGSNMPSFEFTLLTILGCTLATWLSRVLPFVLLKKFDLPQPLLEYLSFVPIVIMSALWFSSLFTQNIGHLPQINLENALASVPTLLAAILSKSLLVIVLAGILSLSLIRLL

SEQ ID NO: 5594 - protein, 201 aa, Enterococcus faecium
  misc_feature (B) LOCATION 1...201
  hypothetical: YES
NRAEKEENIMPKNRLEAFTDAVIAIIMTILVLELHEPNGDTWEALAALGYRFFIYIVSFIILAIYWNNHHHLFQVVHKINGRVLWANSFFVFALSLFPFATSWISEYINSLAPEMTYGFVTLTANIAYYILAKELVKANKGHEKALKAMLNNYNKSYLSIGLNVLGIVLGYLLXPVAVLIANIVILAAWIIPSRTIESQYR

SEQ ID NO: 5595 - protein, 86 aa, Enterococcus faecium
  misc_feature (B) LOCATION 1...86
  hypothetical: YES
RIQEYRKVYDLLVECVSVVEMPTKYGNFKAHCYINKLNGEHHVALVMGDLNNGNDVLCRVHSECLTGDAFGSLRCDCGQQLDKAMC

SEQ ID NO: 5596 - protein, 317 aa, Enterococcus faecium
  misc_feature (B) LOCATION 1...317
  hypothetical: YES
IMQEPMFLKPVFQEKIWGGSRLRSVFGFDIPNDKIGEDWAISAHPHGVSVVENGEFKGKRLDELWSEHKELFGHPSEPVFPLLIKILDAEDDLSVQVHPDDAYGMKHEGELGKTECWYIIDAEPGAEIIYGHHAKTREELAEMIKDGRWDDLLKKVPVKKGDFFYVPSGTIHAIGKGIMILETQQSSDTTYRVYDYDRKDAQGQTRELHIQQSIDVTTVPAKTPELQIKEVRKGNSSIVTYLETEFFNVYEWDIKGITSFKKQAPYTLMTVIEGAGDLVVDGKTYPLEKGTSCIIPNGVSEWAVQGELAIIASEPGK

SEQ ID NO: 5597 - protein, 139 aa, Enterococcus faecium
  misc_feature (B) LOCATION 1...139
  hypothetical: YES
WTQERSSKQMPKRTDIKKIMVIGSGPIIIGQAAEFDYAGTQACLALKEEGYEVVLVNSNPATIMTDKEVADQVYIEPITLEFVSRILRKERPDALLPTLGGQTGLNMAMELAASGILEELNIELXGPXXXXIRXFTTIA

SEQ ID NO: 5598 - protein, 323 aa, Enterococcus faecium
  misc_feature (B) LOCATION 1...323
  hypothetical: YES
KKQDLKPARYATTPEPDSAKNEACRVAELGFDLVVAAGGDGTINEVVNGIAPLEHRPKMAIIPAGTTNDYARALKIPRDNIKAAAEVIKKHQTVKMDIGLSDNSYFINIAAGGYLTELTYEVPSELKSIFGYLAYLAKGAEMLPRVKPIKMRLKYDEGEYIGNASMFFLGLTNSVGGFEQIAPDAKLDDGKFSLIIVKTANIFEILHIAALMLNGGRHVDDPRIIYTKTSSLFVETEDDINRPVMINLDGEYGGEAPMHFQNLHQHIEFFANTDQIPDEAITGTDEEELEVVSKEFVKEVERLTDEDIDGDGKIADETPNQKN

SEQ ID NO: 5599 - protein, 81 aa, Enterococcus faecium
  misc_feature (B) LOCATION 1...81
  hypothetical: YES
ALKEESVKIAFHIFADFDLMPKVSFAITVYREAVKAPCSSDDNKQAFLELGFLDSKYAAYFNELVLERDFKKVENRHDFST

SEQ ID NO: 5600 - protein, 97 aa, Enterococcus faecium
  misc_feature (B) LOCATION 1...97
  hypothetical: YES
INKENLLKMILLYRIVLIVGTELKILKKEQLFKVKEHHNQLLCIKTGTMNIQYRTEYLELTNQTDFLSIREQHKQEKLMATYSQLIDEWEQFKESKT

SEQ ID NO: 5601 - protein, 294 aa, Enterococcus faecium
  misc_feature (B) LOCATION 1...294
  hypothetical: YES
KSKENDGMVTIKDIAKAAGVSHTTVSRALNNSSLIKNETKQKIRQLAKEMNYSPNYSAKGLVNQKKYLIGLFFSSLHKGTSSNFLADSIAGIHSVLDTNYSLSVESIDVVDLTEINLQRYDGLIVMSQSDDDQPFIDYLKEKEFPFVVVNRHINDPAVINVTADDAAGVMQAVDYGIGCGHTKIAYIGGKKNFRSTKEREKGVLKSLKKASIPVNPAYFLTGDYSLESGLQNMEYLLSLSDLPTLVFCGNDDIAIGALRAVHLAGLRVPQNISLIGFDDSPVVSYLNPPLTTVR

SEQ ID NO: 5602 - protein, 214 aa, Enterococcus faecium
  misc_feature (B) LOCATION 1...214
  hypothetical: YES
ISKEDGLTVILFVGVNGVGKTTSIGKLAHQFKNEGKKVLMAAADTFRAGAIDQLVVWGERAGVEVVRGNAGGDPAAVVFDALERAKTEQADVLLVDTAGRLQNKVNLMNELEKIKRVIQRELPEAPQETLLVLDATTGQNAMVQAKQFKETTDVTGLVLTKLDGTAKGGIVLAIRNELHLPVKLVGLGEGIDDLEPFDPNDFVVGLFKGLLKEE

SEQ ID NO: 5603 - protein, 515 aa, Enterococcus faecium
  misc_feature (B) LOCATION 1...515
  hypothetical: YES
NIKECIHMSNEKNVLFTIFGGTGDLAQRKLYPSLFRLYRKGNLGEHFAVIGTARRPWSDEHYREVVKETIRALNPSDEEATTFASHFYYQSHDVNDSTHYQTLKELSDRLDGHYQLNGNRVYYLAMAPQFFGTIVSHLKSQNIMTKNGFNRLIIEKPFGSDYQSAFELNQQIREVFPEQDIFRIDHYLGKEMIQNISAIRFANNIFEAQWNNRYIDNIQITFGENLGVEDRGGYYDHSGALKDMVQNHILQVVALLAMEPPVAFSEKEIRTEKIKALKAIRIYNEEEVLENFVRGQYAQGELDGVQFKGYREEDKVDAQSETETFVAGKFTIDNFRWSGVPFYVRTGKRLTEKGTRINIVFKQVPVNVFKTSVDEPCDDTTLPPNVLTIYIQPTEGFSLSLNGKEVGQGFETEPIKLEFRNSAEMVENSPEAYEKLLLDALNGDGTNFSHWEEVAQSWHIVDVIRKAWDQTQPDFPNYKAGSMGPKAAFELLEKDGFEWIWQPDNWYRERGKLND

SEQ ID NO: 5604 - protein, 203 aa, Enterococcus faecium
  misc_feature (B) LOCATION 1...203
  hypothetical: YES
IVKESLKMKTAITFLLEEYADWEGAYITSTLNQNEKWQNKTASIQSEVTSIGGLKTKIDYLIEQIPEKVDLFIMIGGNSWDIKNHHLYQIIDKLLKTDVPVAAICGAVDYLAQSGLLQGYKHTGNAQFPWLESENYQNKEDFIEQQAVKDRNLITANGTAPIEFTDLILQAVHFETEEIREKTIRLYKLGFYDYYKKYGDPFS

SEQ ID NO: 5605 - protein, 109 aa, Enterococcus faecium
  misc_feature (B) LOCATION 1...109
  hypothetical: YES
QKKDLFTLFVKRLRNVRDNSVKNALIENRGYFVKQGFTLERASKDIKKLYNVKASSSFLVYLAKGAGIDEVIKELILSGVELVPIYQFTSVTRDDGRRVRNRRDPIILN

SEQ ID NO: 5606 - protein, 151 aa, Enterococcus faecium
  misc_feature (B) LOCATION 1...151
  hypothetical: YES
KKKEAVPMSKRYQNIMVAVDGSRQSIKAFAEALDLAKDNEAHLFIVSIINKVELTHSAYAFSKIYADEKQRTEVAMLKKINDAKEYGIAEIHAIVETGDPRNLIANVIPGQENIDLIVMGATGKGAIQQALVGSTASYVVSHAPCSVLVVK

SEQ ID NO: 5607 - protein, 600 aa, Enterococcus faecium
  misc_feature (B) LOCATION 1...600
  hypothetical: YES
YEKEIEILQIGKIIKVSGPLVMAENMSDASIQDMCLVGDLGVIGEIIEMRGDVASIQVYEETSGIGPGEPVRSTGEALSVELGPGIISQMFDGIQRPLDTFMEITQSNFLGRGVQLPALDHEKKWWFEPTVEAGETVSAGDVIGIVEETKVIKHKIMVPNGIKGTIKTIEKGSFTIDETVCVIETENGDKNLTMLQKWPVRRSRPIKEKLNPDAPMITGQRVIDTFFPVTKGGAAAVPGPFGAGKTVVQHQIAKWADVDMVVYVGCGERGNEMTDVLNEFPELIDPNTGESLMERTVLIANTSNMPVAAREASIYTGITIAEYFRDMGYDVAIMADSTSRWAEALREMSGRLEEMPGDEGYPAYLGSRLAEYYERSGRVIALGSEGREGSITAISAVSPSGGDISEPVTQNTLRVVKVFWGLDSSLAQKRHFPSIDWIQSYSLYSTEVGKYMDHILQADWASMVTEGMRILQEEQQLNEIVRLVGIDSLSDNDRLTLEVAKSIREDYLQQNAFDDVDTFTSREKQFKMLKMILTFGEEGRRALSLGAYLSEIMDGTVSIRERIGRSKYIPETELEKLDQIIGEIKQTMQTIVSEGGMSND

SEQ ID NO: 5608 - protein, 185 aa, Enterococcus faecium
  misc_feature (B) LOCATION 1...185
  hypothetical: YES
KEKESEMDKSKVIYVSGYRSFELGVFKENDPKIQVVKNVLKKELHQLAEEGLEWVLVSGNLGVELWAVQIVAELKEEYPELSLGILYPFSDFGNNWNEGNQEKKQLAEQLADYVEAVSHQPYQSPSQLKNHTRFILEHTVGCLLIYDEEFPGKTKYFFEDAQNYQADHPYEIRLISMDDLQNFSE

SEQ ID NO: 5609 - protein, 227 aa, Enterococcus faecium
  misc_feature (B) LOCATION 1...227
  hypothetical: YES
NRKEKKMNTGEKIRTYRRNCKLTQKELGEKIGVSDKTISSWENSRTMPDLEMLSLLHHTLGLPIDFPSIESATESIEPTLPDEPLVNKKSYSSKQPFSLKKTLSFFLLVFCLVYLFLINYQYKNETIDRFNPFLKPQIGYTTLPVGYVDNSIERWVCNDIFGHGTWLSFHAGEVEKEKNHAVIKHKGKHVMNVRLLTWEAIPSDYQEILSQDYDDALKRSPQEPDRH

SEQ ID NO: 5610 - protein, 174 aa, Enterococcus faecium
  misc_feature (B) LOCATION 1...174
  hypothetical: YES
GRKEWRMIFTGYKKKRQIEKYRHLLNGLIETDYQKMFRITMNYVHDKEEALDVMQDSFHKALNYFEKEKEIEHFSAWFYRILIRTALDSWRRQKRTPVDLFEIQDIPQQLPLETSVAELHMILDKIDSPEKEILILYFFEGFRLKEIATILDMNENTVKTKMYRSLNALRQILE

SEQ ID NO: 5611 - protein, 188 aa, Enterococcus faecium
  misc_feature (B) LOCATION 1...188
  hypothetical: YES
KRKERSMLSLLILFLLLIAFFSGARRGFALQIIFAIGYVLSFIAAQHFYKPLASHLELYIPYPAVTPTSKLAFFDQVFAFHLDEAFYAGTAFLIILLIGWLLTRFVGVFVHGLTYVPILRQVDWIAGGILSLIMAYVTIFLILQLLAFVPLDVVQNQFGEHSFARFIVERTPFLTNKMYELWVTNILN

SEQ ID NO: 5612 - protein, 704 aa, Enterococcus faecium
  misc_feature (B) LOCATION 1...704
  hypothetical: YES
NQKEIISMKTRTIEILHRIMTAQYPVKAKHLASEFNVSQRTIRQEVLEANIWLSSKKLPEIRTIRNKGFLLKLEKEKQARLETEIKDVKDGFLNRRERIFDLVLAVAYSRIPIHLNKKEEEFQISKSTLDEDMRRLRATLVSYGIEIVSYGKQGLVYKGSERSIRTMIYDFINQNLGMTDFFMNQDAQLTPAQKIFLHYFPLVEIKKIQEIYSNKLLKQEDDIYKKQILLFTLIWIQRIRKHEFISAINWKNTEIKDSSFSAFIDHMIEEFQLDNVPQVERNYLRFTIETFNARDISNSIEWVQAQLLTIQLIQFVENETHVPFHLKEEALFENLYKHMAALIVRIKNHIQVMNPLKENIRTNYFPIYRAVTHFVPTIEEVIGGKILEDEIAFLVIHFSTIASVIKRDLNYVYKSVVVCNHGMATGNLLAENLKEKFPQIEITAVLSSKEIELVDKLDVNLVFSTFQLNYRNKPLLVVDPILTETNILVIEDFLKRNEELQRLEPNSHESTELFTQIIDVMKESGGRVDRIIYGKLEKLFETNNLEINKREIQPMLKDILTDSNIMIKEKATTWEESIELAARPLVKENIVEERYVEAMIRAVNDYGPYIVIGKHMALAHARPEDGVNKLGVSVATIEQPIDFGNPEMDPVKIIFCLAAVDSYSHLNIMKELIELINNEEKLDRLIECTNIEDFKQLLFSVVEK

SEQ ID NO: 5613 - protein, 96 aa, Enterococcus faecium
  misc_feature (B) LOCATION 1...96
  hypothetical: YES
LWKEAIKRMTEGRNQRKVYQGRVVSDKMDKTITVAVETKKNHPIYGKRMNYSKKYKVHDENNTAKVGDIVRIMETRPLSATKRFRLLEVVEEAVII

SEQ ID NO: 5614 - protein, 79 aa, Enterococcus faecium
  misc_feature (B) LOCATION 1...79
  hypothetical: YES
SWKESGIMVNKKETFKVGMEVQGVVIGSGELIEGEVISLLANVAVVKAIGKAPVVMKKCSMMCLDGLNNPITQRFENVI

SEQ ID NO: 5615 - protein, 276 aa, Enterococcus faecium
  misc_feature (B) LOCATION 1...276
  hypothetical: YES
LRKEGPLLNKKLIAIDLDGTTLNQDSMITSKTKETLKKAINAGHHVSIATGRPFRMSHQFYQQLELTTPMVNFNGALVHIPNQHWDGERETLINREIAFEILSQKKQLNLDFIAAENRDTFFIDSFDFFDEKIFASSRPGEKNLLSPKNLTTNPTSLLVRTDKRFAGAVSAELTRQFGSYVDVRTWGGPTAILEIVSKGIQKAKGVQEIANYLSIDQKDVIAFGDEHNDLELLDYAGWGVAMANGTDQLKGIANDVTPLSNQEDGLAVYLEKLLKL

SEQ ID NO: 5616 - protein, 172 aa, Enterococcus faecium
  misc_feature (B) LOCATION 1...172
  hypothetical: YES
SSEEEGVLQMDIRLARIDDRLIHGQVATVWSKQTGVERIIVISDVVAQDKLRKFLLKEAAPPGITANVITVQKMIQIYHSGLLSRAKVMLLFTNPQDVEAVVRCGVQLKSLNIGGMSFTEGKSMITNFVSVNQQDIDSFRYLNSQEVELEIRKVPADRKILLMELLAKIKKV

SEQ ID NO: 5617 - protein, 142 aa, Enterococcus faecium
  misc_feature (B) LOCATION 1...142
  hypothetical: YES
LSEDSSQNPLLNFTKVVKLKMLYIGLQHRSFFDCALGKKYYEVKIDDDTFLTAHQMKQLQKRNDQLEENLILKKRLPYSRLARRIIKVQDLTEESSFLGKLETFYVAQCIYNTTMMFSPDIPLRVRCNETDTLAKENSPRIY

SEQ ID NO: 5618 - protein, 72 aa, Enterococcus faecium
  misc_feature (B) LOCATION 1...72
  hypothetical: YES
YVEEALSQKNYKLFLCNANGSAEKEKEYIQMVKQSKVDGIIGITYSDIDKYVSSNLPFVSIDRHFSEQVSYV

SEQ ID NO: 5619 - protein, 150 aa, Enterococcus faecium
  misc_feature (B) LOCATION 1...150
  hypothetical: YES
KGEEIFMHKGTEIDFVLNDSLKALELYQTIFDEIQLIEATDYPRGNNEVIFTLYGTRFHMLDENTSLGLTAPTAEHPNTIWFNIIVSDIEDTHNKALRNGCVEIQEMTEMMDFGVTNSMFRDPFGYLWMLHQVHREVSFEERKQLFEKYM

SEQ ID NO: 5620 - protein, 465 aa, Enterococcus faecium
  misc_feature (B) LOCATION 1...465
  hypothetical: YES
LLEEKFMEETKTYSWKQLLMVSSLIFGMFFGSGNLIFPVHLGQMAGSNWISAGVGFAISGALFPLLAILAVVVTKSDGLYDLAKPVGKWYAALFLILVHLTIGPFFGTPRTAATAFEMAAKPFLPEKYDSLGMFLFSALFFLLAYFLNVHPTRLVKYVGKYLNSLFLALLAIIFVVSLFQPMGNLNQSAADSYQTNALTNGVLEGYNTVDAVALLALSVTFVHAVRDLGFKDKKVTELTAKAGSLSVALEVMIYFGLVLLGAMSLNKMPLSENGGTALSQITNFYLGNFGASFLGVMVTLGVFTTAMGLVVSFAQDFHKLFPKVSYMTWLRLTTFVSFVVANAGLDNIIQWSLPVLMLLYPLSLALILLSLTAKFFQKSPFVYQVTMFFSAVPAVLDMLANSPALVSQQTVVASLLGFYHHHVPFAALGLGWMVPTLLGYAGSLLFYYAYRLSGYKQEANELPEE

SEQ ID NO: 5621 - protein, 151 aa, Enterococcus faecium
  misc_feature (B) LOCATION 1...151
  hypothetical: YES
LLEECMMIKLYTGSGCSSSRRAKRWLIVHDIPFIEQNLIRQPLTKNEFIHLLKLTNNGVTEMLSTHSISYKNLVHRIDELSLSELYIEIRTSPSLLKKPIIYDQSAKLLTGFSEDKIRMFLSKTKRKQELNELLLSGHLVDFKENNLFAMS

SEQ ID NO: 5622 - protein, 291 aa, Enterococcus faecium
  misc_feature (B) LOCATION 1...291
  hypothetical: YES
KMEEESMRIACYGVRPNEINIFEKLNIYHYDLSLYEELLTHDNIVSAKEHDAVLLRGNCIADETNLAKMQEYGIRYVFTRTVGVNHIDLQAAADFGMTVARVPSYSPNAIAELSLTFAMMLLRNTAYTTIRTSFKDFRVDEQMCSREIRNCTVGIIGTGRIGLTEAVLFKGLGAKVIGYDIHQTEAAKKVLTFHSLEELLAKSDIVSIHVPHIPGENDQMINEGFLAQMKKGSILINTARGELQDNEAILRALKSNHLAGFATDVFANETEVFFRSFQAMGRRFQTLLSSN

SEQ ID NO: 5623 - protein, 78 aa, Enterococcus faecium
  misc_feature (B) LOCATION 1...78
  hypothetical: YES
QTEETMARRRRKSRGKKIFLIILAVLIVLVLAIVGVGSKIYLDLSHSIEKTYESVERNPKENERHQLIWTNKNLSLFY

SEQ ID NO: 5624 - protein, 300 aa, Enterococcus faecium
  misc_feature (B) LOCATION 1...300
  hypothetical: YES
QQEEGMKKEKLKRFLDQDNVVGYVFASPFILGFLLITVIPMILSLYYSFTDYRLGNPVSWIGLDNYIKMLSDARFLNSIRVTFLYVFASVPVKLIFGLLIAYLLTRNIKGTTFFRSLYYVPSLIGGSISIALVWRELFSKNGLVNIFLERLGAPALSWFSDQKLVMIPLVLMSAWQFGSAMIIFAAGIKEIPGSYYEAAEIDGANKWQTFYKITLPLLSPIILYNLVMQTIAAFMTFTQAFIITQGGPNDATNFYALYVYNQAFSFNSMGYASAISWIMLLIMGAVTFLIFKSSKKWVVV

SEQ ID NO: 5625 - protein, 232 aa, Enterococcus faecium
  misc_feature (B) LOCATION 1...232
  hypothetical: YES
SKEEDKMTDFFKTYLPNVYLIPDEFVEATKQTLYMSFWTAFIGGMIGIILGVTLVVTRPNGLLANRLLFEILDKLINIIRSIPFIILLSLLALTTRFLVGTTIGAKAALVPLIFGVVPFFARQIENALLEVDPGVIEAAEAMGTSPIGIILRVYLLEGLPGIIRVSALTIINVIGLTTMAGAVGAGGLGNLAISRGYNRFQTDVTIVATLLILILVFLSQFISNQLIKKITH

SEQ ID NO: 5626 - protein, 434 aa, Enterococcus faecium
  misc_feature (B) LOCATION 1...434
  hypothetical: YES
LEEEHMDRKNVTPKMKKSKNNSLWRKLGLGLVGGIVGGLLTAGIFYAAMGTGNNSSTATSGNQNSAGETVVENVKVNVDSDITKAVDKVQDAVVSVINLQSQNQSSGFGGLFGQQEESSSSDDSNLEAYSEGSGVIYKKDGNTAYVVTNNHVVDGQQGLEVLMKDGTKVKAELVGTDAYSDLAVLKINSDKVETVASFGDSSALKVGEPAIAIGSPLGSEYANSVTSGIISSLNRQVTSTNESNETVNINAIQTDAAINPGNSGGPLVNIEGQVIGINSSKIASTSESTSNVSVEGMGFAIPSNDVVNIINQLEKDGKVTRPALGITMVDLSAVSTQQQEQILKIPSSVTNGVIVTNVQTATPAEKAGLKQYDVITKIDDKEVSSGVELQSALYKKKVGDSVKITYYEGSKEKTTTVELTIDQSALKQNQNSEN

SEQ ID NO: 5627 - protein, 676 aa, Enterococcus faecium
  misc_feature (B) LOCATION 1...676
  hypothetical: YES
RREEKFMRSLDDPITMLAGVGEKRAASLASLGIQTIEDLLTYYPFRYEDIQERNLNEIQDQEKVTLKGIVVSPPVMNRFGYKKSRLQFRMMQEHDVFNVSFFNQPYLKEKVILSEEIAVYGKWDAKRKALNGMKILGSQTMDDFSPIYHVNKSIRQTTLVDLIKKGFQEYGTLIEENLPNNLVEKYRLLDRASAVRSMHFPKDHEENHQAKRRVVFEEFFLFQMRLQGLKKAEKAETNGLEILYDVQKLKQFTQKLPFELTNAQKRVTNEICRDLRSPQHMQRLLQGDVGSGKTVVAAIALYATVTAGFQGALMVPTEILAQQHMESLQQLFDPNEVTIALITGSTKAKERRELLEKLEQGEINVVIGTHALIQDGVEFQNLGLVITDEQHRFGVNQRKVLREKGWRPDVLFMTATPIPRTLAITAYGEMDVSIIDELPAGRIPIETRWVRTPQLDSVLDWTKKELARGHQMYVICPLIEESEALDVKNAVEIYEKLRELFAPKYEVGLLHGKMKNQEKEVIMEAFKDNQMQILVSTTVIEVGVNVPNATVMLIMDADRFGLAQLHQLRGRVGRGSDASYCILVANPKNELGVERMKIMTETTNGFVLSEKDLELRGPGEVFGFRQSGLPQFAIADLVTDGNVLEVAREEAAALWQIKDWQMLPEYQPLARTLAHS

SEQ ID NO: 5628 - protein, 101 aa, Enterococcus faecium
  misc_feature (B) LOCATION 1...101
  hypothetical: YES
FCWDSAGILFYYFVGECXCAENDFAISSGLQFVFLVGIDHHVYLFPNSVRGLVFVSQHEGSEKGMAGVRTIAGRFISVCLVQGGFAFFATIDCQHLCHLIC

SEQ ID NO: 5629 - protein, 168 aa, Enterococcus faecium
  misc_feature (B) LOCATION 1...168
  hypothetical: YES
RLWEEDPREELVTQLLEYRKYKYAAERLTEKAEERSLYYTKEPMNIDGLADAEKPLKRGQVKKIDLIRAMQKILERKKFSQKVEKTITPDDTTIEERMVFIEERIKRNAHGCTFDSFFESPSKSEVVTTFMALLELMKKGQIIAQQKENYESIMLYPAVGDTEHDEIK

SEQ ID NO: 5630 - protein, 71 aa, Enterococcus faecium
  misc_feature (B) LOCATION 1...71
  hypothetical: YES
RSWEITYTIQFLFLERKQWKKLDWLLHMNEEISEEEQRLIETDLRLLLADHPPHFLARNGQYFYIHRLKVN

SEQ ID NO: 5631 - protein, 289 aa, Enterococcus faecium
  misc_feature (B) LOCATION 1...289
  hypothetical: YES
EEWEMAEIMDNQTGAPEEITKKDVTKAYLRWHFANEIPHSFERYLAPSLLYGMMPILKKLYKDEDSLKAAYKRQLLFFNTQLSWGGGVITGLMSSMEQQRAEEEYEEKEILMQDDLMYNTKAGLMGALAGIGDAIDSGTVQYIFIAIAVPWAQQGSPLGALFPFICFGLYQVLLGVFFARQAFTMGRNATGLMQNTGVQTAIEMLSVLGLFMMGVLAGNYVKVESSLKFAISGREFVIQEILDQIVPGILPLAVVMGVYLFYTKKGLKVTQALLWLTGILIVLAGIGIL

SEQ ID NO: 5632 - protein, 250 aa, Enterococcus faecium
  misc_feature (B) LOCATION 1...250
  hypothetical: YES
KRWEKVKIFRRILIGLVIILGLLGGAGYYYIQQNTYEPSSEAQVLVKEGKNKEDYLFFEGEKKNHGKSPLLIFYPGALVEPESYSIWAQDLAKNGFSVAIVKMPLDLAVMGGNKADKVKEDFPNSDYVIGGHSLGGVMASRYVNKNHSDKHLKGVFFMASYPDKKGTLTESAVPVLSITATKDKVLNQEAYQEAKQYLPERTEYVSINGGNHGGFGSYGEQKGDGEAEISNADQQTVIVNTLENWLKKLK

SEQ ID NO: 5633 - protein, 179 aa, Enterococcus faecium
  misc_feature (B) LOCATION 1...179
  hypothetical: YES
SYRDSCFSASIRDLSKEAHPNVLFAGSDVQEEVGLRGARTSTHLVNPDIAFALDTGTAGDTPGMTPKEADSILGKGPQILIFDASMIPHKKLLNFVIDVAEEMDIPFQYTVISGGGTDAGQMHLTRDGVPSVAITVPVRYLHSHTSVIHEDDYLNTVKLVTELVKRLDSETVEKIRSYE

SEQ ID NO: 5634 - protein, 70 aa, Enterococcus faecium
  misc_feature (B) LOCATION 1...70
  hypothetical: YES
KKRDTQAAYAFLKRLHKQFGEPKAIVTDKAPSLGSAFRKLQSVGLYTKTEHRTVKYLNNLIEQDHRPIKR

SEQ ID NO: 5635 - protein, 302 aa, Enterococcus faecium
  misc_feature (B) LOCATION 1...302
  hypothetical: YES
SMREKHYFNQDRNFWINVQQNDVLAVKNLKEEYGISDEMLTYSLDKNERARVEYDSFDEALLLVSNVPHQQKVDNHYETSPIAFILKEDGLFTFTTPNTEYVIRLIRSLLERMPDMSVYSLLFRTLFLISDSFFPLIEEVNSERQRLNLKLREKTTNKNLLQLSDLEIGLVYLVTGTKQNVVLLEQIKALAIYRKLSEKEKEELDDALIEARQAVEMTNLASQILDQLSGTYNNLLNNNLNDTMKFLTVWSLILTVPTIVTGFFGMNLQLPFTHSVFGWGIALIISLVLSIWMLIALWRRIR

SEQ ID NO: 5636 - protein, 74 aa, Enterococcus faecium
  misc_feature (B) LOCATION 1...74
  hypothetical: YES
LFRDTRITLIKSGTDIFEEKDDSNQKRNDVVEQAIEQDPHNDYFSWHTNSGQPDNHHYIETPNFSWNHRHDSYH

SEQ ID NO: 5637 - protein, 125 aa, Enterococcus faecium
  misc_feature (B) LOCATION 1...125
  hypothetical: YES
IHREGAFVEVKVYGSAHCVTSLKAKQWLEHHQLPYQFVDLEERDLSTEEAEELCSFEEVQAEQLFATWSEAFHNIAIDLSCVGKKQLIFLCTQHTNLLRRPLIIIDEVLFIGYNEQLMEQLILNK

SEQ ID NO: 5638 - protein, 200 aa, Enterococcus faecium
  misc_feature (B) LOCATION 1...200
  hypothetical: YES
RKREMVTMRRFAINGYGEAQDVFEEIDAHPREVGSGHVRVEIKAFSVNPYDVALRLGEMKEIRTWKFPYVPGNDGAGIVTEIGSDVTTVHVGDRVAVHAVGGTYGEKVVLPSAKVAKIPDKMSWEEAAGMVTPGITAYNLINHLTEIQPTDTVMILGASGAVGSSLIQLLHEKGIRILTSASSKNEEKVTKFGASPFAGL

SEQ ID NO: 5639 - protein, 339 aa, Enterococcus faecium
  misc_feature (B) LOCATION 1...339
  hypothetical: YES
SEREKKMKKNMVSVAVLFAFVFSLFSVGSLANADEKTPSDEFRVGMEAGYAPFNWSQQTDENNALPIQGQNSYAGGYDVQIAKKVADGLGKKLVIVQTKWDGLAPALQSGKIDAIIAGMSPTAERRKEIDFTDPYYESQLVVVVQKDSKYAKAKSLADLSGAKITAQLNTFHYTVIDQIPDVQKQQAMDNFSAMRTALASGMIDGYVSERPEGVTATSVNKDLEMLEFSGADGFQTNPEDVQISVGMRKGDPDIQKVNQILSGISNDERTKIMDQAVKDQPAATDSEEKPGIISDFTTIWKQYGNMFLRRCWTYLVHRIDRDSCRYYTWITDWCLPFGT

SEQ ID NO: 5640 - protein, 65 aa, Enterococcus faecium
  misc_feature (B) LOCATION 1...65
  hypothetical: YES
NMRDYFSIFFSNTQVNSLISQPLDKWCSKASFSVLSPIYAKMWKAIFTKFFLILETKRLFHSLFI

SEQ ID NO: 5641 - protein, 65 aa, Enterococcus faecium
  misc_feature (B) LOCATION 1...65
  hypothetical: YES
ARREGINMSKTVVRKNESLDDALRRFKRSVSKAGTLQESRKREFYEKPSVRRKKKSEAARKRKKF

SEQ ID NO: 5642 - protein, 293 aa, Enterococcus faecium
  misc_feature (B) LOCATION 1...293
  hypothetical: YES
NRRETCMAPESSITVTVNSRKAVSGKKIIRTISMLVILLVIAFPFLWLIISSFKHEKDIISFPPRIFADSYTLDNYIKVWTTIPLLDYIKNTVIFAGGTVITSVFFDSLAGYAFARMRFKGKSVLFYFVLLTMMIPFQVFMIPLFIEVNLLGMLDTYAGLIIPRMTTAFGIFMMRSFFITLPDSLEEAARIDGLSEFNIFLKIMLPLSKPTLLSLGIFTLMNSWNDLLYPLILTSSSKMRTLPAGLALFTGQNISFYGPVMAGTVISMLPLLVVYIFAQKYFVQGTAMSGMKE

SEQ ID NO: 5643 - protein, 150 aa, Enterococcus faecium
  misc_feature (B) LOCATION 1...150
  hypothetical: YES
ERREIIMLVPKRVKHRREFRGKMRGEAKGGKEVAFGEYGLQAVDSHWITNRQIEAARIAMTRYMKRGGKVWIKIFPHKSYTAKAIGVRMGSGKGAPEGWVAPVKRGKIMFEIAGVPEEVAREALRLASHKLPMKTKIVKREEMGGESNEG

SEQ ID NO: 5644 - protein, 183 aa, Enterococcus faecium
  misc_feature (B) LOCATION 1...183
  hypothetical: YES
WPGENTLRYILLGLLSKKKMTGYELNQSFKNEIGEFWQAKHSQIYPELAKMEEQGIIQHQVEITGEKLEKKVYELTEEGKEQLAEWIHTPTNELPVNRDEFVLKLYFVKDVNDPALVEIIQQQRDLHEEKRLHLLERKKTIFPTEKEKHENYGHYLILAHAINRETEYANWLTDVLEESNRKK

SEQ ID NO: 5645 - protein, 702 aa, Enterococcus faecium
  misc_feature (B) LOCATION 1...702
  hypothetical: YES
KRGDEGMNFKHSWTRRLKYVFPIMMMLGILFGLKTANVFAEKVIVDPSNPIQNVKNNFIIPKDVPNAKTNITVNGASKVYKYHVDANKGGFTDDYVGLVEGNKNIRYPSFQKEYGEINLVLEGVTTNTKVNIDYGKIGTYNGKKVNIKLVLSNIHLYSDTLPWNLLDNNYTKTHFRDDGYKNTNGAMSKSKKRTVLWISDNLFSGIVYHSTQMNVQLVATYEDGSPVQFSGDTFISFNSLNPAGGKSTDLKGEYAHYDKMNTTDWYVRKDTVLSEFKSFYNNLNVVGGHPGGSSKLTQADNDFNNLHDKLGDPKFGQGTVSFKISEANPTFVIGSSNVQTWFTLSSATIFSVVPDQPEKTGVDKNGNNVNDKMLQVGDTIQYRIKQKVNRLGVDLLAVYDRFELIDNLPKEVNYVDAHVESGTNKKFDVSGEVTCDKTKHQVKYAAKADTLKNRMKYNGETYELVINVKVNELANQNSVAKNQGTSIINKVEKDTNIITVYFPKIPVKEVQQNGKDVNGRNDGKKGTPTAPLNAGSEVQYLVTQKWHTKGVDAASDHYKQFSIQDPIEARLTYKEVSAQVIDKSKGKDITSEGTLTYDSNSRTLKWEASADFLSNNLLDGREIQLIFTAKTPLQSEKNIDNQAVVAVDNVSNKTNVVTIGVDPNLPQVIVPKTGSTHLVTISAVSLLLLVLATFSYAVLRYI

SEQ ID NO: 5646 - protein, 855 aa, Enterococcus faecium
  misc_feature (B) LOCATION 1...855
  hypothetical: YES
TGGDRMNWYRLTVEDVLKNYQTSTEGLSQEERQKRLTDQGYNEIKARQQTKRWKKIAKHFTDLLMIVLIIASFLKFASSEYIEGSIILFVVIVNGLVSYWQERKAEESLNGLKQLMGQEAIVLSNGMQEKIPAKELVKGDVIVLRAGDVVPADIRLIEAHDLLVEESILTGESEASEKSHAVLTEEESIGDQKNMGFSGTLVQSGSAVGVVVETGNTTEIGKINQALQSVEQQTTPLIKKINRLNKQIFQGILCLSLFLVIFTTFRYGMDWHILLSATIALVVSMVPEGLPAVLTMILSVGVHEMAKEKAIIKGLPSVETLGSMTVICSDKTGTLTKNEMTVVDVAAKEEACVLSIMKNCQELKTKEEQKTENLSGNPTEVALIRHTETANLPLKKIEAKIPFSSEYKYMATMHAEEKGAVIYVKGAPEVLFAKSTLSSAEQEAWSQTAAEFARKGQRVLGFAYKKVDSKQELTHETLTQLTFAGIAGLIDPPKESAVKAVKECQQAGISVKMITGDHKDTAKAIAEQIGLKHTAKVLEGIDLDLMSDEELIQQVPIVDVFARTTPEHKLRIVKALQKNGEIVGMTGDGVNDAPALKRSDVGIAMGIKGSEVSKQAADMVLGDDNFHTIAKAVKEGRRILDNLQKTINFFLPTALAQGLILIWALMLNRPLPLSPVQILWVNMVTTITLSYALGFESPDPEIMKRPPRDPKQGILSGYHLFRIIYVSLLIMVPAYLLAMQFEGQSLQQTILLQNIVLAQAVYMINCRELSKPSLNQGLLQNKALFLSLGILALLQGMVIFLPVGQQLIGTVSLTMTQQLLIGANVILLFLVVEIEKGIMNKLFRKKEKTAREYSR

SEQ ID NO: 5647 - protein, 240 aa, Enterococcus faecium
  misc_feature (B) LOCATION 1...240
  hypothetical: YES
IKGENELTKHTHHEIGDHAACIRLVPIFNHLEDSAMNYIAEKAHTKQYQKGEFLFRSQAKEDTLYIINRGKIRIYRLADSGKEQLVRILSPGDFTGEWTLFNLDAVHEEYAEATRDTVVCMIQQKDVQDFLEQYPAISLKLLAEMSTRLESSERQTTQVAVESVITRLVLFLAENVEPEMGNSPTITLPMAKKDIASYLGTTPETISRKFGELEDEGLIQQLSGKRIKIQDLDDLLLYSE

SEQ ID NO: 5648 - protein, 541 aa, Enterococcus faecium
  misc_feature (B) LOCATION 1...541
  hypothetical: YES
GGSFMREQQNYRAAIYCRLSSEDGADHESMSIGNQRALLAEYVQKQGWEIVDTYIDDGFSGTNFDRPGFQRMIADIEKGRINLVITKDLSRLGRNYIMCGQYTEIYFPERHVRYIALNDGVDTLNQTSSMDITPFKHILNDMYAKDISTKIKSTLHTKAKRGEYLGALDPYGYLRHPDDKHKLIINEETAPVVRRMFEMCAAGIGSKSIATTLNREGILSPTEYTRFRKHNPERDGEFERRSFWTRTYVQFMLKNEIYVGSMVQGRQYTPSYRSKKREPIPKKDWIVVPNMHEPIVSRELFDEAQKRMGARKKTIKAKDEPDLFAGLFFCEACGTSMVPKVSQQKYFYYTCGRSHAIGNLACSAHYINRDTFHQAVLEDIRRNARLFSEDTEKAAQKLMELKCADQQKQTAAMKRDLASAKKRLADLDVKLKRTYEDNMSGKLPDHIFAMFIADYDTERETLKAKVAELEKALEKVRDAKADIDRFAALIQKYTSFEKLDRFMLHELIDRITIYETPGMGRCRKGKEKRITTYYKFVGTIQ

SEQ ID NO: 5649 - protein, 129 aa, Enterococcus faecium
  misc_feature (B) LOCATION 1...129
  hypothetical: YES
ITLLLSERKKRHLEKELSKRIIDELLTYLYSHEITEIRIGVEFAEEGLFIEIQGTTESQPEDLDVLADLLNNPRDPSMEIYYQELLGNPRHDREDYHLLGSLIDDVEIMYAQPIINIKIFRRASPRPYY

SEQ ID NO: 5650 - protein, 483 aa, Enterococcus faecium
  misc_feature (B) LOCATION 1...483
  hypothetical: YES
KRLLEEVGGIQMLSQNAVTANTIKKEKKEFGISDKIGYMFGDLGNCFILGLVNSFLMIYYTNVLGVSGAIVGTLFLISRILDAFADVMVGRLCDVSELTETGRFIPWIRKMKYPFCLVTVILFLPFVQHLPMTVKIAYIFVSYIVYGIFLSTINIPYGAMAAAISSNPNDRTSLSTFRSIGSAIGGSTTGFFIPILMYTHNKSGQQVVSGNHFFWISIGCAAIAFVAYMLTCKLTTERVRVVKNEKVSASQLVKGLLANRALIILVIVDIFIVINQILAGTNMTYLFNDYFHNKQAMSVALLFTYGTVVVLAPFATKLTKLFGKKEASVFALLASSCMYLLMYFLHITNAWVYLILLFIATLGSGLFNLMVWAFITDVIDYHQYKTGLREDGTVYGVNSFARKVGQACAGAVGGFMLALIGYQSSTTGGAIQSVLVQERIYTMANLLPAFCLFVSAIILLVGYPLNRSKTVFIGEELKKINER

SEQ ID NO: 5651 - protein, 67 aa, Enterococcus faecium
  misc_feature (B) LOCATION 1...67
  hypothetical: YES
HDLLNMWGLLAVYIGVCIGLRDHCLNRRGRLIIKDKVVNPTFDLVIVEGTSGTNLYKAMLLDLYDTF

SEQ ID NO: 5652 - protein, 323 aa, Enterococcus faecium
  misc_feature (B) LOCATION 1...323
  hypothetical: YES
NMSLENEKPYYVVVGGVNGAGKSTIYQVQNLKRKELDTDRINADEILRSFGGNWKKQADINQSMREVLREIKGHFKEGKSFHHETTFGGNPYPDKMRLLKAKKLGYESFLIYIGLDSPERAIERVKIRVAKGGHGVPEDLIRKRYEFSLRNLAELEKYFDNVSIYDNSDEFSYIYVKENHTVVANNTQEYAWVPKAIQEKNAETPISKQIMMDISQEEMNPKETLERIYSASDDFISDRFSKEAQVDDFYRNHKNEIKERILSISFSTGVSQDELVGQDKRRNSCKLAYINSVGELLVKTDSELLSMELNRDRNIQKTDFEVE

SEQ ID NO: 5653 - protein, 308 aa, Enterococcus faecium
  misc_feature (B) LOCATION 1...308
  hypothetical: YES
KRILAMTEIARQKNNSTSSVYRVMKRFYRPLNPFKQTLPKVLCFDEFKSVRSVASAMSFIMMDGQSHALLDIVENRRLPYLERYFSRFSLATREAVQLIVIDMYAPYVSLVKKLFPNAQLIIDRFHIVQHIGRTFLNHRVKETTVRLKGNSHSQRGLGKKLKRYWKLLQKEEAKLNYEKRVWRASFKDYLTESEIADRLLAACPNLRQGYQLYQDILYAVKKRDQSLFEDCLTRDISGLPETYTTTLRTFKKFLPQIQNALHYSYSNGPLECLNNHIKVLKRNAYGFRNFYNFKLRIMIRHGKTFLTK

SEQ ID NO: 5654 - protein, 217 aa, Enterococcus faecium
  misc_feature (B) LOCATION 1...217
  hypothetical: YES
FSSLLTEYIYKFMIMVKYIYNHELRIFLRRETIVSYNVQPLRTNEEIQDFQFWLRRTSNPERDSFLFLFGINNGLRMSDIIGLKVGDIRGKSKPIIVEHKTGKRKPIFIDNLREEILLYTEGKEENDWLFPSRQQGRHITRDRVYQIYADIAEKLGRDDIGTHTLRKTFGYHYYKKTRDIATLMFIFNHSSQAITKRYIGITEDEIGASLRGFKLGG

SEQ ID NO: 5655 - protein, 319 aa, Enterococcus faecium
  misc_feature (B) LOCATION 1...319
  hypothetical: YES
DYSLRGKLFAFPIIKRKELVVTIELKNEYLTVQFKTLGGQLTSIKDEDGIEYLWQADPNYWNGQAPILFPICGSLRNDWAIYRPQERPFFTGLIRRHGFVRKEEFILEEVNDNSVTFSIKPNAEMLDNYLYQFELRVVYTLNGKSIRTEFQVTNLEMEKTMPYFIGAHPAFNSSLVEGENYEDYYIEFSEVESCSIPKSFPETGLLDLQDRIPFLENQKILDLDYSLFSHDAITLDQLKSRSVTLRSRKSGKGLRVDFDDFPNLILWSTTNKSPFIALEPWSGLSTSLEEGNFLEDKRQVTKISPQETSRKIYDITILN

SEQ ID NO: 5656 - protein, 146 aa, Enterococcus faecium
  misc_feature (B) LOCATION 1...146
  hypothetical: YES
QVSLSFNYWKKNTQFLFMYTLKMEKMDMPYGQKTISRKCYKGSILFSVLLLFLLCTFLLMAALESYRLSMDLNIRIRNYYIAKIMKQMALSEQSTLAESSEGVFYYTTGSVTYQWVQQSLFLEVEVSPFIFRFTEEVKNDTDTSTE

SEQ ID NO: 5657 - protein, 369 aa, Enterococcus faecium
  misc_feature (B) LOCATION 1...369
  hypothetical: YES
VDGLGRPKDTEPEIVRERHLDINGEVINPVARDYPDEFIQTGISAIDHLNTLVRGQKLPVFSGSGLPHKELAAQIARQATVLDSSDDFAVVFAAIGITFEEAEFFMEDFRQTGAIDRSVMFMNLANDPAIERIATPRMALTAAEYLAYEKGMHVLVIMTDMTNYAEALREISAARREVPGRRGYPGYLYTNLATLFERAGRIRGLKGSVTQIPILTMPEDDKTHPIPDLTGYITEGQIILTRELYKSGIQPPIDVLPSLSRLKDKGTGPGKTREDHAATMNQLFAAYAQGKQAKELAVVLGESALSDVDKIYAKFAERFEKEYVNQGFYTNRSITETLDLGWELLSMLPRTELKRIKDDMLDKYLPEGK

SEQ ID NO: 5658 - protein, 262 aa, Enterococcus faecium
  misc_feature (B) LOCATION 1...262
  hypothetical: YES
KIPLLYLHCGYSQLGETSMQNTFQSKSLYYQLVEILKQRIENSMVAHDKLPSERELTSFYGVSRTTVRLALQELEKMGYIYRQHGKGTFVSELRTNATDLAGAYSFTEQMRAMGKHPETKILAFKKIEATKYLASHLNVQLGEPLFQLDRLRLADDLPMMIEKSYLPVKLFMSLSQEILFLKPLYNLFSENFNQIVRLADEEFYASIVQKEDSELLNIPEGSPVLHLVRSTYNLENEVIEFTLSVARADKFHYKIRHLRSTN

SEQ ID NO: 5659 - protein, 168 aa, Enterococcus faecium
  misc_feature (B) LOCATION 1...168
  hypothetical: YES
KGGLLMALTPLDIQNKTFPTKMRGYNQDEVDDFLDLVVRDYEELTQRNRELEKAVKHSEEKLEYFNELKDALNQSIIVAQDTADKVKTSASKESEVIVTSAQNKADELVANAEKRAHQLTTDAEEKARKILTDATEKARQLATETEDLKKKTRVFHQGLSLMLESSYA

SEQ ID NO: 5660 - protein, 78 aa, Enterococcus faecium
  misc_feature (B) LOCATION 1...78
  hypothetical: YES
TAALTKLNMFLSSFNCCCLLIYVLEGRKMKLSVEGTPEEIQELLQAIGSSKEQKVSVSNSDIDGICNCLNREKISNPY

SEQ ID NO: 5661 - protein, 73 aa, Enterococcus faecium
  misc_feature (B) LOCATION 1...73
  hypothetical: YES
KGALVMLKISYKPSTDSKEMKKEYETVNDFLQGQYLEVPPLQDHFVVTTVTLDGKEIEMPDQTISGLFNYFNK

SEQ ID NO: 5662 - protein, 77 aa, Enterococcus faecium
  misc_feature (B) LOCATION 1...77
  hypothetical: YES
NRGFFPILPSHGTTIPDPAIQQLVEMYPRVLVTPHVGSNTDEALSNMISTSFENFREIIETGKTKNEVSLPKARQLR

SEQ ID NO: 5663 - protein, 75 aa, Enterococcus faecium
  misc_feature (B) LOCATION 1...75
  hypothetical: YES
LLQLNGRRLALCCRNKSSREQSLILQGTSIAVAHNDDLPLTATPSMSKAVATSWGCNPSKLNATTPVRKFGSCGP

SEQ ID NO: 5664 - protein, 342 aa, Enterococcus faecium
  misc_feature (B) LOCATION 1...342
  hypothetical: YES
KLQLKSYDIFTESVHNMDVRKSLQTILLKEAISMKERERILDLVKKGILSTEEGLDLLESMATEKDEKQIKKEADKVTASHKEKDQASQLIDKLENGEEEISEPVDPKERERQDQENLEKILDELATEANKTSARLDEVNAQFADNKAARNEKQEALMQLNTKEELGELTEEELAQRQTLEAEIKELEASGDTLLEEQLKLEAELKDIRKNQWSEKKETFTDKFELPDDWKDQATDTLNQVGEKMSEAGSQLGKFLKKTFQTVSETVNDNMEWKDVSLRVPGIATTKFEHEFYYEAPAASILDIKAANGNVTLKTWDSNDVKVEAKIKLYGKMGAEPFEAFL

SEQ ID NO: 5665 - protein, 62 aa, Enterococcus faecium
  misc_feature (B) LOCATION 1...62
  hypothetical: YES
LLQLLLIVCFSFFHSCKVNLFIYYNQASIQSTQKDNGQSGHCLYTKNRIDSNLCGSQCSCLA

SEQ ID NO: 5666 - protein, 122 aa, Enterococcus faecium
  misc_feature (B) LOCATION 1...122
  hypothetical: YES
YQQLPKSPAQINDRTWKLVPSTIPNGPGVTHGRLAENEFMFNVSTKNLKIQTLTIGAKMNGTKKIGFNTIGAPNKIGSLTPKNVGTTEARPMARLRSDLQIHMNKNGTINVAPVPPMVTINI

SEQ ID NO: 5667 - protein, 823 aa, Enterococcus faecium
  misc_feature (B) LOCATION 1...823
  hypothetical: YES
RSKLVFLRGFLIWTRLTSIYQHYLLKEKARMANEQTRSSRRQKQPTPKKSVKKNSGKGSGKSSGTHKKGLFIKILLGILSFFCILFLAGVGLFWYYAKDAPELTDKKLDATVSSKLYTQDGELFEDLGAEKREKISANELPKTLEDAIVSVEDRRFYKHIGVDPIRIIGSALSNFTSGGLQGGSTLTQQLIKLSFFSTSAEDQTLKRKAQEAWMAVRLEQKKSKQEILTYYVNKVYMSNGLYGMETASEMYFGKKLSELSLPQTALLAGMPQAPSAYDPYVYPDQAKKRRDTVLYTMLQNEKISQTEYDQAVNVPVTDGLQELTQSDDNTKIVDNYVKEVINEVQEKTDKNVYTDGLEIYTNLDLDAQKKLYDIVNTDQYVSYPDDEMQVASTLIDTNTGKVKAQIGGRHIAEDVTLGNNLAVNTSRDFGSTMKPVTDYGPAFEYLKYSTGKTITDAPYNYEGTSTPVGNWDNQYMGTITLRQALYLSRNVPAVKLFNEVGSDKVASFLKNLGIEYSTIHQSNAISSNTEEQDGTKYGASSLKMAAAYAAFANGGTYYKPQYVNKIVFQDGTEETYEPDGKTAMSPETAYMITDILKDTITEGTGTNAQIAGLYQAGKTGTSNYTDDEYAKLGISSGVYPDILFAGYTPNYSISVWTGYNKKMTPVTSESSHVASDVYRELMQYVSANVTNTDWEMPSGLIRVGGELYYKDQYTARSNAITPSTTIPSSSYVQTPGSSTTETTTQSSSSTSQSESTAESSKESTTAETSEPASSTTVPSSSSEESSTPSSSAPPASSSEPATSGADAANDHTPSSSTSASGNR

SEQ ID NO: 5668 - protein, 390 aa, Enterococcus faecium
  misc_feature (B) LOCATION 1...390
  hypothetical: YES
GGGFMYHVHLIDAIPEQEIEKLQGEYFKIIDDLPAEGIVIRSTKVKDEWLTPDLLAISRAGVGVNTINVEKASENGTIVMNTPGVNANAVKELVLCCLLLSSRPIIEASRMVQTLTGPNILEQAENKRSAYVGRELQGKTIGLLGLGAIGTKVALSCYSLGMDVLGYSIRDAQLDYVRQADLETVLSTSDYIVVMLPLTEDTKGLIDQANIEKMKKDAVLINVGRSEIVDKYAVMQALEKQHLAKYLTDFPEEEFLENDRILMLPHLGGSTQEALADSGRLAVEALKDYLLFGTVREAVNYPSARMFFQAPFRFTIFYQKKTNILAEIFSLLNENELAIADISRNHKNEHVYILIDIDSTDFEQLNQVKQQLEKISGVRKVRLLKKPERP

SEQ ID NO: 5669 - protein, 216 aa, Enterococcus faecium
  misc_feature (B) LOCATION 1...216
  hypothetical: YES
VQKLAFLNKYYIKNSMFFVKFICFFQKYVTVISQGGFTEMNFVAMDFETANHQPYSACSLALVMVKNSQIVDEFYTLIQPETPFFWRNVQIHGIHQEDIRNAPKFPEVWQTIQPYFQKNRLVVAHNAAFDTKVLAGCLDYYHLEQPNYLSLCTVKSSRRLFPEFPNHRLNTVCENLNIQLDHHHDALEDSRACAEILLYQEKKFGTDPLKKLVTIK

SEQ ID NO: 5670 - protein, 260 aa, Enterococcus faecium
  misc_feature (B) LOCATION 1...260
  hypothetical: YES
IIFCLNQTSKKPIKAPPILETTRLIPAFTAEKDPVISAPRANWKAVTPDASFKRPSPSKICIAFLGIFTRPERELTATASVGPNAAPKAKQAASGTLGNRNDNVAPTPTRVKMTPPNAKNKIVPKFLRIEEISAFSPSLNNNGAIIITKNNSGSKSIDCPHSVRPNTTPRKIWISGAGIIGKMRLAMFDKVIVTANTITNSANSIVHPLYFLFCVSIFKNCSFFFKILVSTTSTCVWFPSNSHCTRFDSKRSRSCFRRSN

SEQ ID NO: 5671 - protein, 72 aa, Enterococcus faecium
  misc_feature (B) LOCATION 1...72
  hypothetical: YES
FVFWWLAIDLPLFPTTDRRTARKLPDKKSTTTDPAIRCRKPPSSAKQNCFGRIRPSVERTDHFNGCYWKNLI

SEQ ID NO: 5672 - protein, 482 aa, Enterococcus faecium
  misc_feature (B) LOCATION 1...482
  hypothetical: YES
KNFCTLNNQWKMIAEKQRKIFQLKIWGNPITNYTKGLLNLKLMNRIINFIIILFFVSNVFLLLTVPTSFFVSISFLLFLVILIVGFVRELITSKIRLSLFIYIFGYFFMYLSPIMQLQYGSFPNFIMYNTDKILKTNIIICVFYFLYLITDIFTRKNNAKQKDTSFQNLKFNYKMQQYYFVFTLIFSIITFFMFRFEYFTTRYTYSNLITNSSLYLIFFSATKGIATASLIMEAQKFLTHHKNIRRLLVSSFLFIYNVNPFNVSRYYISYVVILFMLIFFTKKIKVNQMLILLILGMFFIFPLLNFFRNGLTFVDFSSYINLIREQFVSLHFDSYSQLVADLYYVDINGYTNGWQFLSALFFFIPRAIFPGKSEGSGALIGQFLNENTGFYYIARGFSNVSNPFIGEIFLNFGFIGVVFVPILLVYFMKWVEYKNEFIYMIICSYAIFIMRGDFMSSFAYAIGSIVFISIIPQIKYERNKQK

SEQ ID NO: 5673 - protein, 406 aa, Enterococcus faecium
  misc_feature (B) LOCATION 1...406
  hypothetical: YES
RNFWCRSLPSRAWQKNRRNVHQDGSRTECRTKNITGLLTRTWRKFIMEMTFRWYGSQEEKITLDEIRQIPAVKGIVGTLMDIPVGEVWPRERIKELKEEIESRGLTLKVIESVNVHDAIKIGLPSREQYIENYKQTIRNLAEYGIEVICYNFMPVFDWVKSDLDYRLEDGSSTLAFISDDIPDDPREIVARIEHSSNEFELPGWEPERLAHIKSLLEAYASVDEEKLRENFAYFLQSIIPTCEEVGVKMAVHPDDPPYSIFGLPRIVKNREDLDWLCRIVDSPYNGITLCTGSIAEDPENDVYGILAEFCQRDRIPFAHVRNIKFLANRDFYEAPHKSEYGSLDMYRILKTMYDNGFNGYIRPDHGRMIWNETGRPGYGLYDRALGAVYLNGLWEAIEKGNKSKDN

SEQ ID NO: 5674 - protein, 84 aa, Enterococcus faecium
  misc_feature (B) LOCATION 1...84
  hypothetical: YES
KSFWIMLVCNSKGVLIMKNFDTYYVIVFSISLLLILLTLMQYKEYPEYFILTFVYLVSSYTLLYKFRSSSRVSKVCFLISLLIL

SEQ ID NO: 5675 - protein, 387 aa, Enterococcus faecium
  misc_feature (B) LOCATION 1...387
  hypothetical: YES
ILFCMSWIDFIQGMYFFGGVKMSDTEYMKLAIKLAKKGAGYVNPNPMVGAVIVKDNRIIGQGYHEIFGGLHAERNALKNCRESPVGATLYVTLEPCCHYGKTPPCTEAIIKSGITRVVVGTLDCNPIVSGKGVKVLEENNIQVVIGILEMECQQLIKVFRKYVTRHIPYVFMKYAMTMDGKIATYTNQSKWISGEKARKQVHQFRHKVTAIMVGVNTVIQDDPLLTCRLENGENPIRIVCDTDLRTPITSKIIKTANDIKTYIATSSIDESKIALYRKCGCEIIYTKKKGNHIDLMNLMQCLGNMQIDSLLLEGGNAMNWSALEQQIVDEVQIYIAPKIFGGSAKSPVSGQGVAFPNDAIMLKPYAFSQVGNDYFIESEVIYPCLQE

SEQ ID NO: 5676 - protein, 358 aa, Enterococcus faecium
  misc_feature (B) LOCATION 1...358
  hypothetical: YES
NTFWISHCIDWRSVFTDTSKEGTTVKIIYWTLYFLLFLLIVLSVGSLMIGTPFIYLDQLFDTFIGKGSSSLALIVGEFRVPRLLISLLTRACLGVSGYILQGVTRNELTDSSILGINAGAGFLVMLYLGFFSQYSLPFLLLVVAFIGGILAACCVYLAAYDRNGFLGMNRILLSGIAVNAGLSALTLLCTIQLSKENYGFVNAWLAGSIWGASWSYVWALLPWAIILIPLGGFYAQRIGLLSFGQERAQGLGLNVNKSQKILLLLAVALASGSVAVTGNLSFVGLLAPHAAKLVVRKENHWTFILSSLFGSVFVLSADIVARVILPSGEIPTGILIAFFGAPYFLYVLFIRQKHVLSS

SEQ ID NO: 5677 - protein, 438 aa, Enterococcus faecium
  misc_feature (B) LOCATION 1...438
  hypothetical: YES
SNFWGAHQNMGVINFIIENILTQASITIALIAMLGLLLQKKSAGQVISGTLKTLLGFQVLSAGSSIIVGSLTYFGKIFTEGFHMQGIIPSIESINGQAMNDLGLGRDIALTFLAIFVFNIILARFTKWKYIFLTGQAILWMATMTTVFGYFAGLRGIVLILVGGFIGACFAIAMPAVAQPIIRKITGSNDIALGHFCTIGYLFEAGVAKLFGEKGENKKSIEDIKLPTHFEFLQDTYLSVMVVMVPLYIITVLFAGEPFASELSGDQNYIMFAFLQAIQFVVGVYVLLAGVRLLLGEIVPAFRGIAMKLVPDAIPALDCPVFFPYSPNAVILGFITTTIGTIIAMFTLPMFGLAMILPGMLTNFFAGGTAGIFGNAVGGRRGAIIGGIAHGFFITLLPALLVTIFNSMGFNNATATDVDTVAAALLYAWILSPVLKAF

SEQ ID NO: 5678 - protein, 583 aa, Enterococcus faecium
  misc_feature (B) LOCATION 1...583
  hypothetical: YES
RNFCKMRKKIKEHELFAKLLFILFIGLFLQAIVISLFIYHRSRDAYIQLFNQSNDVVLKKIQSEFESLNDTIENTLAAFDSNPAVKSYFSNDPAQHMEQLQQLRTIQKMNDSLSKIHPMIDYDVLIFGENGRTFVGNDMLTAVSADSFFQSAIAQRVNERAADTQMLFAHHGLTLRDKKAPSVFFVKKLKNTLNHVYGYAVLSISSKQLANLFQSVVNPEISKISFMNEEQTIIASNEENTIGSRSMIFKKLTVGETTISNGQQLTRLPLYRQDCTLLSQVDLHSLSNQMGVIFPIILYNIVTLAFAGSLVFMYLDRHTKSIYRLIDSLKRLEEDGLKATVPVQGSHEVQLLGNTINQLLSNAQHHYEQTIQDEKKKRSLEIQTMQAQIQPHFIYNTLTSLKFLIWQKKTDEAVQGIDSFITLLRSTIGKKEEVIPVKEEIKSVQSYIDLLSMRYGERISAKIMIPDELQSLSMPNMILQPIIENAYLHAFHNKTQGFITVYGKTKNQLLLFEVIDNGDGFDTENTKQKNDHFSGIGISHVDERIRLMYGDAYGLTIQSVIGTGTTVTICLPLLPKNQSEYQK

SEQ ID NO: 5679 - protein, 338 aa, Enterococcus faecium
  misc_feature (B) LOCATION 1...338
  hypothetical: YES
SRKLFFFFFNRRSYGNTRNEKYLETIHKGAFMRMKDKLIIGKNAIDTPTDFETIQEGIDYLAGLPDSHPKVLIVKEGRYDEYIESRLSNFKLVGAGTVVISGNRFAKQEYLDGSQLGTFRSATFFLEGSNVVLENLHIENTAGPGEKVGQAVALFNSGDRVSLKNCRLSGYQDTLCTGPLPDLQKDGTPFCTPASANPEYCRQTYEYCWIEGTVDFIFGGADAVFHQCHIHSLASKNPGYITAASTPKNQKTGYRFESCTLTAEPDTRNVYLGRPWRPYANVLFEACKIGGHVHPTGWDNWDDKKNEQTVKFSERNNNYETSIKRPEWIHLEKQGVQK

SEQ ID NO: 5680 - protein, 216 aa, Enterococcus faecium
  misc_feature (B) LOCATION 1...216
  hypothetical: YES
KSFWLLRQPLALFITLLRRETMKVHQAEIIISAVAPKQYPDTQLPEIALAGRSNVGKSSFINTLIDRKNLARTSGKPGKTQTLNFYLIENALHFVDVPGYGYAKVSKTERAKWGKMIETYLTTRDQLRAVVSLVDLRHKPSQEDIQMYQFLKYYDIPVIVVATKADKIPRGKWNKHESEIKKALDFDRNDTFILFSSVTKQGKEEAWAAIEQAIES

SEQ ID NO: 5681 - protein, 129 aa, Enterococcus faecium
  misc_feature (B) LOCATION 1...129
  hypothetical: YES
LMFCKDYAILWEEVSMMELTQTEFVLCPKFEKTFSILGKKWNGLIIDVLLENGPQRFVELAAKIPMVSDRVLVERLKELEKEGIVTRNFACSEKSRSEYLLTEKGADLQKAMRQIQVWSEKWITEEECG

SEQ ID NO: 5682 - protein, 269 aa, Enterococcus faecium
  misc_feature (B) LOCATION 1...269
  hypothetical: YES
EKFCKKGRTSMIVQAVLLGIVAFVAQSEYALGTSLLSRPIVTGLFTGIVLGDVKTGIIMGATLELAFIGSFSVGASIPPDVVTGGILGTAFAITAGAGTETALLLGLPIATLTLILKNIYLGLLIPIMNHKANNYAEEGNYKGVEHMHLLAGIGLSLMLGVVVMVSYMVGSNTIGNLLNMIPDFVQKGLSVATGLIPALGFAMLARLLINKQVAPYFFLGFAIASYLEIPVTGVAIFGAILAVVVVNIMNVRQLPLQTTAGEVEEDEEF

SEQ ID NO: 5683 - protein, 267 aa, Enterococcus faecium
  misc_feature (B) LOCATION 1...267
  hypothetical: YES
SNLCCRRSRSSGLVERSVTRLLQIRRFINGQRGVKNVEAQEIIRYIQTASKKTPVKVYLNVTEPIEFKESKVFGEGSSFVVFGDYETIAPVLEAESEKIIEIEIETAARYSAVPLLDIKKINARIEPGAIIRDQVSIGNNAVIMMGAIINIGAVIGENTMIDMGAVLGGRATVGKNCHIGAGAVLAGVIEPASAKPVIVEDGVLVGANAVIVEGVHIGKDAVVAAGAVVLEDVAAETVVGGIPARVLKISDDQTKENTALIAALREL

SEQ ID NO: 5684 - protein, 312 aa, Enterococcus faecium
  misc_feature (B) LOCATION 1...312
  hypothetical: YES
FMKLWMKILLGVALALIVALVFAGNYFYNYAVVPSEKDFLDEDTPGTTQTSKETDAHKWFSSKENRSDWTITSKDGLKLSAIYLPAETKSEKTALVAHGYMGNAETMTNYAKMFHDMGYNVLVPDARGHGKSEGDYIGFGWPERKDYVQWINKVLENNGKSQEIVLYGVSMGAATVMMTSGEKLPDNVKAIIEDCGYSSVHDELAYQLDDMFSLPAFPLMQVTSLVTKVRAGYFFGEANAVEQLKKNQRPMLFIHGDEDTFVPFEMLDKVYRATKGPKEKYVVKGAEHAEAYKTDPEKYQQVVQQFLSQYVH

SEQ ID NO: 5685 - protein, 698 aa, Enterococcus faecium
  misc_feature (B) LOCATION 1...698
  hypothetical: YES
DGLWTLVNMVAPGAYEERWAKWSLENLPIFPETFRYEVPMDKRAQFSIVKRELQSADTIIIATDGDREGEAIAWSIIRQANAFSKEKNYLRLWINSLEKEAIYEGFKNLQPGKNYFPKYKEAQARQNADWLIGMNGSPLYSLLLQRKGIDGSFSLGRVQTPTLYMIYQLQEEIKHFKKETYFEGEGLITTNKGQFSGKIVPKKAFKTQEELTKEIEKLGAHLGKQNGRILEVTKKEKRLHSPRLFSLSSLQTKMNQLMKASAKATLDAAQGLYESKFLSYPRTDSFYITENEHQYLVKHLQNYKKFLGIEEVQTTEIKAKKRYVDAKKVQEHHAIIPTKTIPTPARFAKLSKLQQAIYLQVLRTTVAMFAADYIYEETTVMTGVQQLKLKSIGKIPLQQGWQEILRIKSKKKEAQTLPPIVENEEAEVELKSMEKETQPPKPYTEGTLITAMKTAGKTLDNDEAQEILKEVEGIGTEATRANIIENLKQKHYIEVNKNEITVTPKGITLCKAVANEPLLTSAEMTARWEGYLRKIGKQEGTPSVFLENIKKFILHLLAEVPNQIDKVDFSDEISGTRQIKAMEKKNDQLGRCPKCKKGIVMLYPKIATCLNPECDFKLWPTVAKKKLTKTNLRDLLSKGKTSKVVKGFTGKKGKFDAVLVLKEDMTIGFSFPWIENSGTKAVDGNKETSRKNNENEVE

SEQ ID NO: 5686 - protein, 71 aa, Enterococcus faecium
  misc_feature (B) LOCATION 1...71
  hypothetical: YES
YSKLSDFFTTSDKRCSKASFSVLSQIYAKMWKAIFTKFFLILETKRLFHNLLINGVQKLASAVISPTKRKI

SEQ ID NO: 5687 - protein, 745 aa, Enterococcus faecium
  misc_feature (B) LOCATION 1...745
  hypothetical: YES
FMLCQNCGKNEATIHLYATVNGQRTQLDYCQSCYQKIKNQQNGGLTNMAQNDPFGFGSLDDLFRSMSRQMQQQGNYEQTPPTQFGGNNNFNGGQPPQGNTEGLLGEYGINITEQARQGDIDPVIGRDDEIKRVIEILNRRTKNNPVLIGEPGVGKTAVVEGLAQKIVDGDVPQKLMDKEVIRLDVVSLVQGTGIRGQFEERMQKLIEEIRQAENVILFIDEVHEIVGAGSAGDGNMDAGNILKPALARGELQMVGATTLNEYRIIEKDAALERRMQPVRVDEPTVEETISILKGLQKRYEDYHHVKYTDEAIEAAATLSNRYVQDRFLPDKAIDLLDETGSKKNLTIQIVDPKTIEKKLQEAEEQKVLASREEDFEKAAYYRDQINKLQKMKERQLTEEETPVITEKDMEKIVEQRTGIPVGELKEKEQTQLKNLADDLKAHVIGQDNAVDRVAKAIRRNRVGLNKQNRPIGSFLFVGPTGVGKTELAKQLAYELFGSQDSMIRFDMSEYMEKHSVSKLIGSPPGYVGYEEAGQLTEKVRRNPYSLVLLDEVEKAHPDVLHMFLQILDDGRLTDAQGRTVSFKDTIIIMTSNAGTGKVEANVGFGAAREGVTRSVLNQLNNYFTPEFLNRFDGIIEFSALSKENLMTIVTLMLDDVNQMLAAQQLHIEVPTNVKEKLVDLGYDPSMGARPLRRTIQEQIEDGIAEFYLDHPSIHELKAKLDKDGKIIVTSKPERLAKESAEETAE

SEQ ID NO: 5688 - protein, 108 aa, Enterococcus faecium
  misc_feature (B) LOCATION 1...108
  hypothetical: YES
RVIWKMNTVNRQKAMNLIGLAMRAGKLITGEELTIAEIRKQKAKLVFVATDASENTRKKIKDKSSYYEVPCFELFSEAEITQMIGKPRKVFGIMDAGFAKKTKELIEG

SEQ ID NO: 5689 - protein, 110 aa, Enterococcus faecium
  misc_feature (B) LOCATION 1...110
  hypothetical: YES
LDIWADVDLTVYIDGISLYLLLNHNNKRQRNNLVGLFVIQFIFNFIWSAVFFNLRNIFIAAIDITLLVIFLSVLMYQLWLHHRLAMWLMIPYYLWVLFATLLNYSIYFLN

SEQ ID NO: 5690 - protein, 176 aa, Enterococcus faecium
  misc_feature (B) LOCATION 1...176
  hypothetical: YES
RAICNDLFDTEPLSHGNKGLIRSLHHRGKTRHTKNHVESRGKICLTHSIHGRPKSADDRSDFGHWKADIVAGKTGGTCLVTLTDRKSCFLLAGKKVPRKKAAYVSEKMIELLSSIPNEAVKTITPDRGKEFSNHFAVTEALNNMPFYFPDPHALGNNEQIKIRIDSFENTCQNRKR

SEQ ID NO: 5691 - protein, 210 aa, Enterococcus faecium
  misc_feature (B) LOCATION 1...210
  hypothetical: YES
HKICGGGTYEMKDKVVNKLLEALFSGDKSEEDMVYVQVKFVLEVLLNNLGKLAVVLVFSLVTGSWAETGITFLSYICIRRYAYGLHSDSEFVCLLWTLLYLWGVPLVMKHLQLTISFPMMVFLLISCFLLLLRYGSRGTAINPIEPEKRPPLLKKAISMFLIFSLITLFFSASYFSTYLLLGIVLEIATLLPITNYLMNFGGIFHEKNNH

SEQ ID NO: 5692 - protein, 138 aa, Enterococcus faecium
  misc_feature (B) LOCATION 1...138
  hypothetical: YES
LKIWIMGSRRHLPMEDAIKQGQLFLSELTAEERSCLYNDLLSIKDVYLCNKDTSFYTFRKIRRATKRCAECRKRTFLYQTEHKGELSISQIHEQKRFKNHYRIQILFNGQEMEYAFLENLLQHLHNQHFSYNSQAIYA

SEQ ID NO: 5693 - protein, 402 aa, Enterococcus faecium
  misc_feature (B) LOCATION 1...402
  hypothetical: YES
NGIWNRSDYLSYLLGIIGLFVTLGLAFLISSNKKAIKLKPLIVMFVLQLVLGFVLLRTTFGTAVVSVLAKMFDHLLAFAGQGVDFVFAGVANKGSAPFFLSVLMPIVFISAIIGILRYIKILPLFMKAVGLGLSKINGMGKLESYNGVASAILGQSEVFISIKKELPFLSEKRLFTMSVSAMSTVSMSIVGSYMALIDSKYVITALVLNLFGGYILASIVNPYVLEEKEDELIIEENKEQTFFQMLGEYILDGFHVAITVAAMLIGFVALIAMINAIFHGIFGITFQEILGYIFAPLAFISGIPWKEAVDAGSIMATKLVTNEFVAMTELANGNFHFTERTTAIISVFLVSFANFSSIGIISGAMKGLNEEKGNLVAKHGLKILLTATLVSFLSAIVTGLLV

SEQ ID NO: 5694 - protein, 251 aa, Enterococcus faecium
  misc_feature (B) LOCATION 1...251
  hypothetical: YES
SRICEKINENRKACKILIKSVVFDVDDTMYDQQQPFRNAVKRVVPLVSDADMHPLYIRFRHHSDENFPKVMAGDWTLEYMRAHRISQSLKDLDYPHITEEDGLLFQKIYEEELDNICLHEEVKKTLDFLKEKNVPLGIITNGPTDHQTKKLKQLQLNNWIPSRNMLISQATGFQKPEKEIFQLAEKEFHMLPEETLYVGDNYDNDVLGAKSANWQALWFNHRERKIEQTPICDIEISSFDQLLETMKTIFV

SEQ ID NO: 5695 - protein, 63 aa, Enterococcus faecium
  misc_feature (B) LOCATION 1...63
  hypothetical: YES
SISCITKNGDDKFFLFSIIFPLVGRIIFMSILSKVVFPTPFFPTKPITSPTLTSKFMSFRIFS

SEQ ID NO: 5696 - protein, 72 aa, Enterococcus faecium
  misc_feature (B) LOCATION 1...72
  hypothetical: YES
ISSCLVCVGKQSRESVTGSPVFSNSLLTKLEQRSAAGPEIPKWVKSKSIVCSVNTRPFLFRTRKVMSCKESP

SEQ ID NO: 5697 - protein, 68 aa, Enterococcus faecium
  misc_feature (B) LOCATION 1...68
  hypothetical: YES
ISSCLVCVGKQSRESVTGSPVFSNSLLIIGVEPEGSVLNGGDPAPHEIEGIGVEFIPPFFLPFQSISH

SEQ ID NO: 5698 - protein, 70 aa, Enterococcus faecium
  misc_feature (B) LOCATION 1...70
  hypothetical: YES
QKSCHSPFFRTNGVLLPTPRSQVTIFNKHEKLFFELVPCDSELDGRLTTSFLNGVQKLASAVISPTKLKT

SEQ ID NO: 5699 - protein, 473 aa, Enterococcus faecium
  misc_feature (B) LOCATION 1...473
  hypothetical: YES
RRSCQKNKNDSREELSMDKLLNLFVSIVSQPSILVSLIALLGLVLQKKKFSEVIQGTIKTFVGFLVLIGGAGLISNSLTPFASMFQTALHTQGVVPSNEAVVAIALQQYGTPTALIMLVGMIVNILLARFTRYKFIFLTGQAMLYVSCLTAVILVSAGFTANLWMILLGGVFEGTLLTITPALCQPFMKNITGNNQVALGHTGNIGYASSGWIGKFFGNKDRSTEDIKIPKSFSFLRDSTVSIMLLMSIVYVALALLAGPGFVERELSNGDNAVIFALIQAGTFTAGFVIVLQGVRMVLAEIVPAFQGIAKKLVPDSKPALDVPIVFPYAPNAVLIGFFVSFFVGTLSMFAMIGLQTTVIIPGVVGHFFCGAASGVFGNSTGGRRGAVLGSAFNSLLISWLPLFILPVLGDLKIASSTFADTDYLVPGLVLGKLGEYGQIALTVGIIAFFLLVVLSSFLFAGKRTNIVSKEQN

SEQ ID NO: 5700 - protein, 67 aa, Enterococcus faecium
  misc_feature (B) LOCATION 1...67
  hypothetical: YES
QKSCRSSFFRINGVLLPTPRSQVTIVNKHEKLFFEIAPCDSELNGRLTTSSLNGVQKLASTALSPIR

SEQ ID NO: 5701 - protein, 182 aa, Enterococcus faecium
  misc_feature (B) LOCATION 1...182
  hypothetical: YES
LNELSKLKKIQNAVGFDISKERVYAATEQSAEAFWCVADLTNLPFADQTFNAVLNIFSPSHYQEFQRVLSEDGKVLKVVPQENYLKELRQAFYPNQPEKQSYSNERVVAKFAEAMKLTERQRVTYEFEIPEENQKDLLAMSPLEWQVEERIKADLYKNPLKKITIDIELLKGTKRKRFSSSF

SEQ ID NO: 5702 - protein, 608 aa, Enterococcus faecium
  misc_feature (B) LOCATION 1...608
  hypothetical: YES
RITCSISRISGNRRITGGRIVMKVKKLSLQTLRRFIPYLTAYAKDIWLAVILGIINGIATVVMTLQIGQSIDQMIGEGQVRFNRLFHLLILFGGIVLINVVSQWLIQVLSNRLAYLSVAKLRKDAFAHLNRLPLRYYDQNSHGNIVSRFTNDMDNISIAISAAFNQLFSGVAIIILSFIFMMRLSPLLTLVVLCSTPIIFLVSWIVARASQTNFDRQQRIIGDISGFVTERIGNQKIVKAFQQEEASQQQFELLNADLYEKGQRAQFSSSLTNPSSRFVDHLAYLSIGLVGGLLALKSGSSITVGVISSFTIYSSQFSKPFIELSGITTQLQTAFSGLERAFDLIDQPEEKPDLPDAYALEPKNIKGKVSFDHVSFYYDPKQRLIEDFNFTAYPGQTIAIVGKTGAGKSTLVNLLMRFYDTTKGTITVDDHDIRSIQRDTLRKSFGMVLQDTWIFDSTLRENLRFGNPEASDAEINDALKASYMYEFVERLPEKLDTKIGGQGLKISDGQRQLLTIARTMISNPPMLILDEATSSVDTLTEKKIQQAFLAMMEGKTSFVIAHRLSTIKNADQILVMDQGAIVEMGTHDELLQKDGYYRRLYQAQFTAQ

SEQ ID NO: 5703 - protein, 115 aa, Enterococcus faecium
  misc_feature (B) LOCATION 1...115
  hypothetical: YES
SNTWILHRVNYSGGQRQALSLLMATITAPELLLLDEHTAALDPKTATALMRLTNQRINEQKLTGLMITHRMEDALKYGNRLIVLQKGKIVQDISEKEKQHLTMGDLLQFFEEVMD

SEQ ID NO: 5704 - protein, 104 aa, Enterococcus faecium
  misc_feature (B) LOCATION 1...104
  hypothetical: YES
AFACDGFSAKITVFIMTISLPFLLFALLKQHRTFLLSDLLLVDFMLQLIIPILFYFRYKFMFMIFIAFVVLFCFIREKNLSINIPFFLIKTIKIVRTIHAFTTF

SEQ ID NO: 5705 - protein, 471 aa, Enterococcus faecium
  misc_feature (B) LOCATION 1...471
  hypothetical: YES
RLAWNRTLKCRTYRIGRKIRMRHDGRKAQELRKLELQTNVFKYPEGSVVIRFGDTTVICSATIENSVPPFLRETGTGWVTAEYSMLPRATSTRNRRESSKGKLFGRTMEIQRLIGRSLRAVVDLEKLGERSIIVDCDVIQADGGTRTASITGAFVALKLAIEKLLREKELSEDPIKEHLAAVSVGILPDGTCVTDLDYQEDSAALVDMNLVMTESGKFVEIQGTGEEATFDGEQLNEMLFFGKNAIEDLIKEQKHALLTEFAQNDERIEETKTIIIATRNPGKAEEFRNMFKEAGYHVKTLLDYPELPDVEETGSTFEENARLKAETIAQLLDQPVLADDSGLKVDALGGMPGIYSARFAGEQKSDAGNNAKLLYELTDVPDEKRTAQFHCTLVFAAPKKDSLVVEAEWPGRVARIPSGENGFGYDPLFIPEGKKQTAAELSSEEKNKISHRAQAMKKLSAEWKQWLEGER

SEQ ID NO: 5706 - protein, 63 aa, Enterococcus faecium
  misc_feature (B) LOCATION 1...63
  hypothetical: YES
LIELLFCIRFCYSCYKVLFYYRTFLINKEQLEVKIADSHRVYDFLEILFQSVFSSVYEILFFQ

SEQ ID NO: 5707 - protein, 111 aa, Enterococcus faecium
  misc_feature (B) LOCATION 1...111
  hypothetical: YES
VLYCIFLTYLIKYAIIISEKGGETMANTTMNPSTARKNFYQLLKEVNENHTEIEIISDRSGNNAVLIGLEDWRAIQETLFLEQTGTLDKVRDREKDDSSFTNIDDIDWEAL

SEQ ID NO: 5708 - protein, 322 aa, Enterococcus faecium
  misc_feature (B) LOCATION 1...322
  hypothetical: YES
AIYCWRKEENRMSFAADVKKELTGLEVHREHAKAELAALLRMNGSLGIVNQQFILNVQTENAAIARRIYSLLKDHYQVRSELLVRKKMKLKKNNVYIVRLKQGTKDVLMDLDIMDGMMFNGHVSDEIMGNSQKMRSYLRGAFMASGSVNNPETSRYHLEIFSIYEQHNQDICDMLNYYGLHARTLERRNGYISYLKGAEKIADFLTLIGATNSMLRFEDVRIVRDMRNSVNRLVNCETANLNKTIDAASKQIENIELIEAKVGIHALPEKLQEIAELRLQHPEVSLKELGEMIPSGAISKSGINHRIRKINEFAEKLREEAV

SEQ ID NO: 5709 - protein, 830 aa, Enterococcus faecium
  misc_feature (B) LOCATION 1...830
  hypothetical: YES
MEELFTERAQAVLEIAQEEAKRLKHQSVSSEHVLLALVVEQNGIAGKVLREMDLNETEIYEEIEHLIGYGGIRSYPKGVFLPYSPRMKQVFALASSEVKKTGSQKVGTEHILMSLLKDESIMATRIMINLGISLSKARQVLKQKMGLAGDSAGKGMNRRRNVNVQDKRQTPQGTPTLDSLARDLTKLAKENKLDPVVGRSREVKRLIQILSRRTKNNPVLVGEPGVGKTAIAEGLAQKIILGEVPEDMQEKRLMMLDMGSLVAGTKYRGEFEDRMKKVIDEIYNDGQVILFIDELHTLIGAGGAEGAIDASNILKPALARGELQTIGATTLDEYQKYIEKDSALERRFARIQVDEPTPEEAEVILQGLRTRYEEHHGVEITDEAVRAAVNLSVRYITSRQLPDKAIDLIDESAAKVRLDQTDHLTKSTVIKLEIDELVQEKEAAIQKQDFENAAQLRRQEKALRKKLQKVSAIEAKQEQGYSDRVTEEDVATVVSEWTGVPLQQLEKKESERLLELEGLLHERVVGQDEAVKAVSRAIRRARSGLKDPDRPIGSFMFLGPTGVGKTELAKALSEVMFGSEDALIRVDMSEFMEKYSTSRLIGSPPGYVGYDEGGQLTEKIRQKPYSVILLDEVEKAHPDVFNLLLQVLDDGHLTDSKGRKVDFRNTIMIMTSNIGATQIREEKNVGFNVQDVTKDHKAMQKRILEELKKAFRPEFLNRIDETVVFHSLSKDEIHTIVQIMSKAIIKRLKEQDIQVKITPSAIDVIGKAGFDPEYGARPIRRALQKEIEDRLSEALLGGEIRLGDHVTVGASKGKITLNVRGPKKETVGSL

SEQ ID NO: 5710 - protein, 215 aa, Enterococcus faecium
  misc_feature (B) LOCATION 1...215
  hypothetical: YES
TGYWRRAQMNEYLNEVVDHLQEIPEDDRFDLIQYYEEYFLDSGKTLDQIIDEYGTPKQFALKLKISYFSEEEQAENELVKNPKRQIRLIWLIIIGLFASPVLIPLALGFILVIGGLLVALLALIFSIYVLCISILGVGLFMIISGISVFGQSILSGLFFIGVGLFATGSAVFISPLLLKGTKGLFYVMMNFVKWMGRRFITKRDLHFSGRLKEDT

SEQ ID NO: 5711 - protein, 86 aa, Enterococcus faecium
  misc_feature (B) LOCATION 1...86
  hypothetical: YES
LDYWNKANLLHSMSKKSYSPDNSACEGFFGRLKNEMFYQRDWKNTTINQFINKLDDYIHWYNNQRIKLSLGRLSPLQYRKKQRYIC

SEQ ID NO: 5712 - protein, 66 aa, Enterococcus faecium
  misc_feature (B) LOCATION 1...66
  hypothetical: YES
RRYCCTSDSTKWGNTDRDFDRLFWCAIFSVCIVYQTKTRAEQLKFIKRQEGQSLLGLLFLLFNTFI

SEQ ID NO: 5713 - protein, 646 aa, Enterococcus faecium
  misc_feature (B) LOCATION 1...646
  hypothetical: YES
SLYCPAVLDLRSNGEALSQITTLKTEATSYLDLIMKNMIGVYDTTKYGSIPFVYAGLLPLVLCLFYFASRKVPLKNKFLYGSLFAILIASFYLVPLNLFWHGMHAPNMFLFRYAYLFSFLVLLLAGKGWEKIEQDDRGLLLGIILVVAALFAVAWGIKPEGSYTYVTMTSFVLTVVFLGIYAFAVGFYQHKKLSFNHLSILLLLIMSAEALVNTNSMIHGILDDWNYASRSLYTDPYPDLKALVNETKKDSDSFYRLENLDPVSANDSINYGYSGISLFSSIRNRNSSSYLDKLGFRSRGTNLNIRYNNNTLLMDGFTGIKYNISKNESTFSKYGFRQAGQSGDYTLYQNVNALPLAFTAPLSVNDVEQPVTDNLTSQTNLINTLSGLNEQYFTFYTPTLKNQLNTTITKTTTGVTYSETADNQPKELTWEVHVPANTQAYLSLFPTNFAQLESSSATITVNGTSRKTQINISGQYYDLGYYPQETTVTFTASFYGTKEISFMEPKVVGLDVVAYQAAMNQIKEKGVEMEATGRKASGTVNTAEDSMLVTTIPYDKGWKAKIDGKPVKVSNFKDAFLMIKVPAGKHTVTFSYLPEGFTIGAILFVLCIALFILYVWYLDRNRPFYGTIDPAIEEQPRNTHRRRRRK

SEQ ID NO: 5714 - protein, 216 aa, Enterococcus faecium
  misc_feature (B) LOCATION 1...216
  hypothetical: YES
RWYCAIQMANLIIRMPLPSKKFKKKEIRSLNSAIGGCALRQAINESNKYYLSRGLAVIHKKPTPIQIVKVDYPKRSAAVIKEAYFTQASTTDYNGVYRGFYLDFEAKETKNKTSFPFKNFHAHQIEHMKACLEQNGVCFVLLWFSSLKRCFYLNSVHLIAYWDAQKEKGRKSLPLSLIEELGIEIKTGISPRIPYLDAVDFYLSTLSIEGESKNGK

SEQ ID NO: 5715 - protein, 495 aa, Enterococcus faecium
  misc_feature (B) LOCATION 1...495
  hypothetical: YES
PYHCISFPWFPELRISSQMLFLKGFIVMTKTLPKDFIFGGATAAYQAEGATHTDGKGPVAWDKYLEDNYWYTAEPASDFYHKYPVDLELAEKYGVNGIRISIAWSRIFPTGYGEVNEKGVEFYHNLFAECHKRHVEPFVTLHHFDTPEVLHSDGDFLNRENIEHFVDYAAFCFEEFPEVNYWTTFNEIGPIGDGQYLVGKFPPGIQYDLAKVFQSHHNMMVSHARAVKLYKDKGYKGEIGVVHALPTKYPYDPENPADVRAAELEDIIHNKFILDATYLGHYSDKTMEGVNHILAENGGELDLRDEDFQALEAAKDLNDFLGINYYMSDWMQAFDGETEIIHNGKGEKGSSKYQIKGVGRRIAPDYVPRTDWDWIIYPEGLYDQIMRVKNDYPNYKKIYITENGLGYKDEFVDNTVYDDGRIDYVKKHLEVLSDAIADGANVKGYFIWSLMDVFSWSNGYEKRYGLFYVDFDTQERYPKKSAHWYKKVAETQVIE

SEQ ID NO: 5716 - protein, 60 aa, Enterococcus faecium
  misc_feature (B) LOCATION 1...60
  hypothetical: YES
NQELSGFPRLLRTTFDKEKPVLVNKRKTDFFDRSTMIDAKDVYDASSIVLVWILYSFACE

SEQ ID NO: 5717 - protein, 282 aa, Enterococcus faecium
  misc_feature (B) LOCATION 1...282
  hypothetical: YES
MNNWLEYFPENVLERGYSYHLHGFVRHLNYTSKYLSATVSGTEDYKVVITWDEKTNMTCDCLYAIEGKKCKHMAAVLFAYEERPIKKSNYSLSELSSLVSSASSSLVRELLTEILIEHPHFIERFKVKMPFHAINYSDKLTTIIHKYDHIIKKNKNRKTAKFIMEMRKFIQEAVESLIQQNAYLPAFELINEVIATLETFYWEPEDERTLLLIEDCYYLWKELLAEAPHAEKRQMFSWFVCQVDHTDASYSKRYSIKILKEDFREKEFSNQKKKIDKKLKKR

SEQ ID NO: 5718 - protein, 342 aa, Enterococcus faecium
  misc_feature (B) LOCATION 1...342
  hypothetical: YES
IINWFIENGEKKFRAAQVWEWLYQKRVSNFTEMTNLSKQLIEKLSEHFIINPLKQMVVQEASDGTVKYLFELPDKNMIETVLMRQEYGLSVCVTTQVGCNIGCTFCASGLLKKNRDLTAGEIVAQIMMVQHYFDERNLGERVSHVVVMGIGEPFDNYDNVMDFLHIINDAKGLAIGARHITVSTSGLAHKIKEFANNGLQVNLAISLHAPNNEVRTSIMRINRSFPIEKLMEAVDEYLEKTNRRITFEYIMLNQVNDRPEHAQQLADLLKDKKKLAYVNLIPYNPVSEHDQYSRSPKADVLRFYDVLKKNGVNCVIRKEHGTDIDAACGQLRSKQMKKTVAK

SEQ ID NO: 5719 - protein, 178 aa, Enterococcus faecium
  misc_feature (B) LOCATION 1...178
  hypothetical: YES
KKNWFGGTLMRRKAVIDRLYLFFWFFPIVLLPFTWVNAVVQGAEILGLIQGSGFVVSRNFPALTIFYLVISVGLLLPKSLINHYNWQLLYFSCLLIFTSMFSLLPRMIIGPNGLSESGLKDSAYPSMYFLTIKPCFYLVIVSFILATFFYFWKEIRIKSERSVSIKNNVDGGSSVTSI

SEQ ID NO: 5720 - protein, 190 aa, Enterococcus faecium
  misc_feature (B) LOCATION 1...190
  hypothetical: YES
KKNWQKKLAYEPKQDEVLSYLMYPQVFLDYQKAYNQFGDVTLLDTPTFFQGIRLGETINVQIERGKTLIIRLDEIGEPDIEGNRVLFFNLNGQRREITIKDNSIISTVQTRLKAEPTNREQIGATMSGSVLDVLVKKGDNVKKGDTLMITEAMKMETAIEARFDGKVAHVYVSSGNTISSGDLLIEVTEK

SEQ ID NO: 5721 - protein, 61 aa, Enterococcus faecium
  misc_feature (B) LOCATION 1...61
  hypothetical: YES
ILDWLCCESTLPVEVLVMEVVEVLLVEPTSVVEMAAEDSLTEFFVLYPQAEKSITVPNKPA

SEQ ID NO: 5722 - protein, 91 aa, Enterococcus faecium
  misc_feature (B) LOCATION 1...91
  hypothetical: YES
LNDCASAGENQIRGCSLSRAIGAITPQHSQHLIIFVKKSVAIPSGIKKGYEAFVFSCINFDFSIASLFSPLSSTGSVTTPTIFTPLLFISF

SEQ ID NO: 5723 - protein, 106 aa, Enterococcus faecium
  misc_feature (B) LOCATION 1...106
  hypothetical: YES
LNDCASAGENQIRGCSLSRAIGAITPQHSQHLIIFVKKSVAIPTNLIESFNKQIKRYSRRKEQFQNEESLERFLVSIFDTYNQKFLNRSHKGFQQVTDTLVSMFTE

SEQ ID NO: 5724 - protein, 772 aa, Enterococcus faecium
  misc_feature (B) LOCATION 1...772
  hypothetical: YES
EGDCMGNKRIYELAKELKKFSKDVVEKAQQLGIDVKNHMGAITSNDEKKLQQAFKNPSTKQQAAQQASRKPANQQPNDQRKKETTNNQQKNKNNRSYQDRGQGSGQVNQGKKPTTNQNNTGNTSSQNRQGTSQGGNQNRTNNNNKPNNNNRGKFNNNNRNRYNKKGKKGKQQQSTKPAVPPRKFRELPDVLEYTEGMNVADIAKKIHREPAEIIKKLFMLGVMVNQNQALDKDTIELLATDYGMEPQEKVQVDIADIDKFFEAEEVDPDKLVSRPPVVTIMGHVDHGKTTLLDTLRHSRVTSGEAGGITQHIGAYQIDIDGKPITFLDTPGHAAFTSMRARGASITDITILVVAADDGVMPQTVEAINHAKAAGVPIIVAVNKIDKPGANPQHVMQELSEYELIPEAWGGETIFVEISAKFGQNIEELLEMILLVAEVEDLKADPTQRAIGTVIEARLDKGKGPVSTLLVQEGTLHVGDPIVVGNTYGRVRVMTNDLGRRDKEAGPATPVEITGLNDVPQAGDRFVVFEDEKTARAAGEERAKRALLENRAATSRVTLDNLFESLKEGELKEVNVIIKADVQGSAEALAASLKKIDVEGVRVKIVHSAVGAINESDVTLAAASNAIIIGFNVRPTPQAKVQADTEEVDIRLHRIIYKAIEEIETAMKGMLDPEFEEKITGQMIVRETFKVSKVGTIAGAYVTEGYIRRDSGVRVIRDGIVIYEGQLASLKRFKDDVKEVKMGYECGAMIEKFNDIKVDDVIEGFIMEEVKND

SEQ ID NO: 5725 - protein, 201 aa, Enterococcus faecium
  misc_feature (B) LOCATION 1...201
  hypothetical: YES
KFDCYFSFFPIPFYERRKGDFLEQMKEKLRRQGIEKLKNLAKSGKKKGKEQRIYEQLFASEYWKSAQVIGTTLSNEIELDTQPIIQRAKKEQKKIVVPKTLPKRQMAFYEMDEHTIFERSSFGVLEPQSEKLYLPEMIDLLIVPGIIYNRAGYRIGFGGGYYDRYLKNFHRKTCSLVFREQLNEQWQPESFDQKIQQLFID

SEQ ID NO: 5726 - protein, 74 aa, Enterococcus faecium
  misc_feature (B) LOCATION 1...74
  hypothetical: YES
KSDWQASNMGIKEFLPFLIPLIIVQFGLLIYVLHHIFTHSAYKHGNRMIWVIIVIVGMQFIGPVLYLIFGKEDA

SEQ ID NO: 5727 - protein, 66 aa, Enterococcus faecium
  misc_feature (B) LOCATION 1...66
  hypothetical: YES
RSDCLFDLKNSKEAGIPFYPSFLAIIFLFLFLKVIQRLSSLSLTADQKKKSRYRKLESVQFCVLDG

SEQ ID NO: 5728 - protein, 65 aa, Enterococcus faecium
  misc_feature (B) LOCATION 1...65
  hypothetical: YES
KICWGAGLGWVFPSKRVGTGLQGWRIEKNFYLWAEESQKILLLGKMGIIEGDQHPTEEELVRTMT

SEQ ID NO: 5729 - protein, 155 aa, Enterococcus faecium
  misc_feature (B) LOCATION 1...155
  hypothetical: YES
KNCCPMLYDLLQTKHIYIVCGKTDLRKGNDGLASLIQQEYQLELYEECGFLFGGNVKKRSKLSNGNVNGFLPCYKRIKNGSPHGVWSQHHKKRXXXXXXXXKKXXXXXXXKKKRREXXXXGKKKKXXKGEEGGGEXXKLKRKKRVGGGLIEKKTA

SEQ ID NO: 5730 - protein, 122 aa, Enterococcus faecium
  misc_feature (B) LOCATION 1...122
  hypothetical: YES
KNCCPMLYDLLQTKHIYIVCGKTDLRKGIDGLASLIQQEYQLELYEDAVFLFCGNRQDRFKLLYWDGDGFLLCYKRIENGKLKWPRTKDEVRTLTNQQVRWLLEGLSIDQPRAILPGKKGVF

SEQ ID NO: 5731 - protein, 487 aa, Enterococcus faecium
  misc_feature (B) LOCATION 1...487
  hypothetical: YES
FWCCLMRYLYQQLLAFCGMVALILLIVGVSFTQLTKQTIEENNYQQLFGYAESVEKTTQTYADTLPQFSQDQAFQNALLLTEQVLTEQNVNFIFIDKNERVIYPTNTALLNFTLTTDQWKNLRSGRQEKFTSNKNILGQAQATSYALVPFNLNHEFYGALVVSQPARNIDNSVRPITLNLFKGFIFSSIVAVIASYAFAAFQVKRINRLRNATKEVTNGNFDVQLPVHDKDEFDELADDFNKMTNSLKESQAEIEEQENRRRQFMADASHEMRTPLTTINGLLEGLEYNAIPENQRENAIKLMKNETERLIRLVNENLDYEKIRTNQISMVIKKFNGTETLRNIVAQLEAKAEAAGDTLTLKADDDIDVYADYDRFVQIMVNIIQNAIQFTENGQIMVTLEKGYLETIITIEDTGIGMSEQQMKSIWDRYYKVDPSRKNTKYGESGLGLPIVQQLVRLHKGKLEVESELGKGTKFTVRLPDVEIKEE

SEQ ID NO: 5732 - protein, 149 aa, Enterococcus faecium
  misc_feature (B) LOCATION 1...149
  hypothetical: YES
ERCCMMSKTKKVTSAGSNGSGNPFGIKSGSGGFNIGQQMLKGKAGIKSTGDKRKSVRVPVELYDEVVKDLSYGAKYSLMTEILALFLKEFETHGNSIVTDFGKLKTRPVKISEEAFKVLKVIKFETDQSNTNIIASALTWYLDKRKGKA

SEQ ID NO: 5733 - protein, 575 aa, Enterococcus faecium
  misc_feature (B) LOCATION 1...575
  hypothetical: YES
SNRWERSQKRKGNPMYTKLLQAIYRDSDLSEKTASMIEQKVSVYQQKKGQAGKLHWDEEDIFLITYGDQFFEEQQPTLRTFKKFYQKYLADTFRVVHFLPFFPYTSDDGFSVVNYQAINDRLGTWEDIEEMRSETRLMFDFVCNHMSAESTWFQEYLNLNDTYKDFFIDLPLDTDTSSVTRPRTSPLLTTFIDKNGKEKHVWTTFSEDQVDLNFKNPEVLLKMIDILLFYLEKGASFIRLDAVGFLWKELGTSCIHLPETHKIIQLFRAIADEAAPGTVLITETNVPHKDNISYFGNGENEAQMVYQFSLPPLTLQAIRSGNTSKLKEWLKTIDFASKKTTFFNFLASHDGIGLNPVRGILPEKTILELVEQLKKEGARVNYKKNPDGTTSPYEINATYLDALSSPTDTTEWRSKRFLAAHSFLVTLPGVPAIYIQSVLGSRNDYKGVEKTGENRKINRQKFLLADIEKELQTDPLRTAVYGELTQMLSIRKKEKAFHPNSLIYLLDSADSFISFIREAKEEKVLVIHNFSNQSAGYLLPKGDYLDLFSGQIIHCSQERKLIFQPYEYMWLKIIK

SEQ ID NO: 5734 - protein, 580 aa, Enterococcus faecium
  misc_feature (B) LOCATION 1...580
  hypothetical: YES
INSWKVMNKFRILFSKGTLLNRLLRKYAVIMIGVTMTATVIFSIHTWEQNQKQAENMTSDAVQSTSRMLNDKTTLSRIIKNQLVGNSEKIENVTTYLTKPIDQYLMYVYEQQNSTDELVSFPNQIKDLYANYEELSAIYIVLNQLPEYYESSRENKGGEIKKGTPKLLDAFYIKLPITQGGAESGSIFIGFQKKELDMILENLTSFNGLSLYMISGTTNRLYTFHDNKIAKETFERQEMIITESLKKNSQLPIDDLEKNNFVQHQELSDDYRILAVLDKKSVKIETGKNLAPLIIGIIILDNILLIFLYKTFKRYSQQVSIVMQAMDQTAAGNLETRIDITNTEYELKELSIGINEMLDSINQFVEDIYKLEIKQQDAHMRALQAQINPHFLYNTLEYIRMYAISEGSEELADVVYAFSALLRNNTNQEKTITLKEELDFCEKYVYLYQMRYPNRVAYHFMIDPDLEKIEVPKFVIQPLVENYFKHGIDFTRFDNALSVKVLQEGKRVRIIIKDNGKGMTEKRLKQIEEKLSHPKVELHGSIGLQNVNERLRASFGSSYYMSLENNETGGLTVSITFKEG

SEQ ID NO: 5735 - protein, 107 aa, Enterococcus faecium
  misc_feature (B) LOCATION 1...107
  hypothetical: YES
KRSWQGGIDLPKKVKKRHLLDYSILIPYLILCVLGLIMVYSSTSYLLLENGQNPSASVINQSIFWVLSLIAIALLYKMKTDVLKNQRLIMAAIAVLTILLLIVVFSW

SEQ ID NO: 5736 - protein, 67 aa, Enterococcus faecium
  misc_feature (B) LOCATION 1...67
  hypothetical: YES
PRSWQENTIYLEIRGARRLSHLLIYLLFHLKFFSNDFLICLGLTLAMFISSLLCGLNFFCTHKGLKK

SEQ ID NO: 5737 - protein, 214 aa, Enterococcus faecium
  misc_feature (B) LOCATION 1...214
  hypothetical: YES
LFGCAYFSRKKKENEMGKVIFNSDDFGYSHGVNYGIMDAYQRGILTSTTLMANMPGFEHAVKLRKEMPRLGVGVHLTLTCGKPLLKTVDTLIESGEFRSLSYYQHPFNIDKDQLYQEWNAQIQKIYHAGIIPTHLDSHHHTHTLDENQEVVVTLAKKYDLPVRSNFERKDEVRHVDYFDPCFDVPREKTDEXKTTNQYECGRIFGKFTHDIERR

SEQ ID NO: 5738 - protein, 318 aa, Enterococcus faecium
  misc_feature (B) LOCATION 1...318
  hypothetical: YES
KVGCQMNNVKINELRQWMAQHQVELAYISDPGHIAYFSGYESDPHERVLALFIPLEQDPFLFTPALEVEDAQNSSWAYDVRGYLDSENPWEIIGKELRARYGQPGNVGIEKNALTVERFDAISDILTGTDSYTDLTSIIQRLQLIKTLEEKDKLIEAGKWADVAFEIGFKAVKEGVTEQAIIAEIEYQLKKQGVSQMSFDTLVLAGANAASPHGTPGNTKISPNELVLFDLGVVWNGYCSDATRTIAYQKPTDFQEKIYNITLEAQLAAQEAVRPGVTAGELDQIARNVINSYGYGEYLNHRIGHGIGTTVHEFPSLV

SEQ ID NO: 5739 - protein, 231 aa, Enterococcus faecium
  misc_feature (B) LOCATION 1...231
  hypothetical: YES
NGGCKVRYIEISDLTFYYDDEPVLEDVSYHVDAGEFVILTGENGAAKSTLVKASLGLLKPSKGMIKIAEKNQEGKKLSIGYIPQQVASFNAGFPSTVIELVRSGRYPRGRWFKRLSEKDHQHVQRALEAVGMWDMRNRRIGELSGGQKQRISLARIFATDPDLFVLDEPTTGMDEESRNEFYRLLRHSAHVHGKSVLMITHDHEDIKQYADRQIRLVRKEDSQWRCFHMNS

SEQ ID NO: 5740 - protein, 124 aa, Enterococcus faecium
  misc_feature (B) LOCATION 1...124
  hypothetical: YES
KDFCRSKQNYRFDYHYVRIVEEENEMKKPTLSELIEATEKAANPDDWYRQSLILEKFHGMSKTTLVEYCKEMETIPEFSEGIVRPGHSTTFIHYHTFIWFLKWKDANKYRVKILSPSDVLKEAS

SEQ ID NO: 5741 - protein, 131 aa, Enterococcus faecium
  misc_feature (B) LOCATION 1...131
  hypothetical: YES
TNIWREKMVQSINTKVDLVIDATSFTGLTDYGQIMIGDNGFEFYHARDRRKYIQIPWEEVDYVLASVMLKGKWIPRYAIQTKKNGTYTFSSKEPKKVLRAIREYVDEDRMVQSLSFFDVVKRGIRSMFKRK

SEQ ID NO: 5742 - protein, 406 aa, Enterococcus faecium
  misc_feature (B) LOCATION 1...406
  hypothetical: YES
TNSWKNISEHQREVITRRTVFEKEKAEARAHILEGLRIALDHIDEIIAIIRGSKSDDEAKATMIERFDLSDRQSQAILDMRLRRLTGLEREKIENEYQELLKLIEDLTDILARPERVTEIIKNELADLNQRFGDKRRTELLVGEVLSLEDEDLIEEEEIVITLTNNGYIKRLANNEFRAQRRGGRGVQGMGIHNDDFVKNLVSCSTHDTLLFFTNNGKVYRAKGYEIPEYGRTAKGIPIINLLGIDSSESIQAIIAVTGEAEEGHYLFFTTRQGTVKRTSVTAFANIRSNGLIAIGLKEDDELVNVLLTDGQSNIIIGTHNGYSVTFKEEAVRDMGRTASGVRGIRLREEDYVVGAALMKENQEVLVITEKGYGKRTKVSEYPVKGRGGKGIKTANITENNGPLVG

SEQ ID NO: 5743 - protein, 525 aa, Enterococcus faecium
  misc_feature (B) LOCATION 1...525
  hypothetical: YES
CGSCTSVNSRILAKFTRCFLCARGMGLFAEIRLRCDDKGYVGKTERKIGRDGIKQEPHPKSFLYFWDWLWYERGQGMEEYQATPVKEVKIENELKRTMGFFTALSTVMGTVIGAGVFFKAASVAEVTGSASLHMFSWFLGGMISVCAGLTGAELAAAIPETGGMIKYIERIYGNTAAFLLGWAQVVIYFPANVAALSIIFGTQFVNLFGLSQSMIVPVAVTAAVSILLINFLGSKAGGAFQSITLVCKLIPLFVIVIFGLFRQEGVDFQLFPIQAGENLSFFSALGAGLLATMFAYDGWIHVGNISGELKKPAKDLPKAISLGIIGIMIVYLLVNAVFLRTASIDGVAGNSNAASDVAKMIFGGFGGRLVTVGILISVYGTINGYTLTGMRLPYVMAKENNLPFSKLFAKLHDKTKVPVAAGILELVIAIGMMMIGGFDTLTDMLIFVIWIFYTMVFVGVILLRKKEPDLFRPYKVPMYPFIPLVAIIGGTFIVSSTLITQTFLASMGIVLTLAGIPIYLYLKRR

SEQ ID NO: 5744 - protein, 373 aa, Enterococcus faecium
  misc_feature (B) LOCATION 1...373
  hypothetical: YES
CEPCGEDRQNRSGMTISSAATTAQWKGHRINIIDTPGHVDFTVEVERSLRVLDGAVTVLDAQSGVEPQTETVWRQATTYGVPRIVFANKMDKIGADFLYSVSTLHDRLQANAHPIQLPIGAEDDFTGIIDLVTMKAEMYTNDLGTEIEETEIPEEYRELAEEWREKLVEAVAETDEELTLKYLEGEEITEAELKEGIRRATVNVEFYPVLCGSAFKNKGVQLLLDAVLDYLPSPLDIPAIKGIDPKTDEEVERPADDSAPFSALAFKVMTDPFVGRLTFFRVYSGVLQSGSYVQNATKGKRERVGRILQMHANSRSEISEVYAGDIAAAVGLKDTTTGDTLCDEKSLVILESMEFPEPVIQVAIERNSKADPR

SEQ ID NO: 5745 - protein, 624 aa, Enterococcus faecium
  misc_feature (B) LOCATION 1...624
  hypothetical: YES
NLPCHKEPIKKELVTLNYRNDIRNVAIIAHVDHGKTTLVDELLKQSDTLDAHTQLQERAMDSNALEKERGITILAKNTAVDYKGIRVNIMDTPGHADFGGEVERIMKMVDGVVLVVHAYEGTMPQTRFVLKKALEQHITPIVVVNKIDKPSARPEHVVDEVLELFIELGADDDQLDFPVIYASALNGTSSLSDDPADQEPTMAPIFDTIIEKIPAPVDNSDEPLQFQVSLLDYNDYVGRIGIGRVFRGTIKVGDQVALIKLDGTVKKFRVTKLFGFFGLKRLEIQEAKAGDLIAVSGMEDIFVGETVTPVDHQDALPILHIDEPTLQMTFLVNNSPFAGREGKFVTARKIEERLMAELQTDVSLRVEPTNSPDAWTVSGRGELHLSILIENMRREGYELQVSRPEVIEKEIDGVKCEPFERVQIDTPEEYMGSVIESLSLRKGEMQDMVHTGNGQIRLTFLTPARGLIGYSTEFLSMTRGYGIMNHTFDQYLPMLPGQIGGRHQGALVSIDTGKATTYSIMSIEERGTVFVEPGTEVYEGMIIGENSRDNDLTVNITKAKQMTNVRSATKDQTSVIKKPKQLTLEESLEFLNDDEYCEVTPESIRLRKQILEKNAREKASKKKK

SEQ ID NO: 5746 - protein, 202 aa, Enterococcus faecium
  misc_feature (B) LOCATION 1...202
  hypothetical: YES
DSTWVKPIDLPEKYENLMRVAQQALANQQYQQAKELFQRAYELKESFEANSLLVFCLYELDEKKEALKQALLHEKQYLQNEEFAEFYFDLLISTQDFLYARKLIASTDFYEAFEQRVIEKIQFAEELSGQMERQKIKALHNKSEELPSLEPARQLASIDEIEQLPYHEFIQTASKLIVSPEVHILARAKLLETLRQLNECHP

SEQ ID NO: 5747 - protein, 258 aa, Enterococcus faecium
  misc_feature (B) LOCATION 1...258
  hypothetical: YES
SNRLICLVNKERGMSMMKKEIVLTAAMMLFSMVASTTFVSATEVYPKEYNTEGTITFEAGDEGVTPPVDPENPDPNKPVDPSDPPSPGTGGALSIDYGSKFKFGTQKISTADKTYYAAADVMNDGSRKPTYVQVTDRRSTLSGWKLSVSQPEQFKTASGDELVGAQLKFTKGQAVSLVDPTYTPQTVNSELTLTPGGNNTLAINAKSGTGVGTWVYRFGANENENQDAVQLSVPGKSVKLAQQYSTKLVWTLEDTPNN

SEQ ID NO: 5748 - protein, 229 aa, Enterococcus faecium
  misc_feature (B) LOCATION 1...229
  hypothetical: YES
NNHWMNGASNMKNSRWQWMEYAGLFSLFLTLISLAVGVTINFRPLYVFDIGHLQILDYTSLDQETLLKNFDHLMNYLNNPFKTILSLPDFPVSASGAHHFYEVKILFLVDYAVFFITLIPSILFIKYLQKNDRLWRLIRPFQIGMLLPVVFGFFMMIGFDRFFILFHETFFNNDDWLFDPVTDPIINVLPEEFFMHSFILFFVLLELFFAVFLFLGKNSLKQTKKKELV

SEQ ID NO: 5749 - protein, 305 aa, Enterococcus faecium
  misc_feature (B) LOCATION 1...305
  hypothetical: YES
QAHWEIMGLNIKTPFRVFPNGFPDDLIKQIEEFSGRKVVCNKPYSGTAVIDDYGEHQMKTGDLIVYTSADPVLQIAAHEEIIPLEELYRICQFVRDITKDDPYMIGRIIARPYVGEPGDFTRTSNRHDYALNPFGHTVLDSLKEAGKDVIAVGKINDIFNGQGITESVRTKSNMDGVDQLLKVMKNDFSGISFTNLVDFDALYGHRRDVVGYAHAIEEFDLRIPELLEAMEEDDLLMITADHGNDPTFTGTDHTREYVPLLVYSKKMKEQGALPQGYYSDISATIAENFSVSSTENGESFLKLLK

SEQ ID NO: 5750 - protein, 105 aa, Enterococcus faecium
  misc_feature (B) LOCATION 1...105
  hypothetical: YES
SYNCISLLRCSFYILDHSLSGLFILRKGDCIMRNYWYVSLSNKYPQPNADDPIRVVQSVQIKKKYSIVEMTREATPNEIDKCKLIYCGHGYFSEQNIQTNIKKYH

SEQ ID NO: 5751 - protein, 143 aa, Enterococcus faecium
  misc_feature (B) LOCATION 1...143
  hypothetical: YES
LLNWACSRGNRGEKHGEKVDGSHDKIKLLDGYQPNTHMSAWNTGNNKILYTQESITDDMIAKRDQSIADAETSPILGFSFNTDSVKTELSNISNVMNQYLDGLNTGTVDPDETLPKLKDALDKAGYDKVLKEMQKQYDEFRQE

SEQ ID NO: 5752 - protein, 192 aa, Enterococcus faecium
  misc_feature (B) LOCATION 1...192
  hypothetical: YES
KEDCIVKENQEELDKEMTDAQPEPEIDVEAAEDSGISEAEAEEFETAKLKAELEEMEDKYLRARAEIANMANRGKNEREQLQKYRSQDLAKKLLPSIDNLERALATEVSDDQGAGLKKGVEMVLESLRNALEEEGIEKIPAKGEAFDPNLHQAVQTVPATEDTPADTIVEVLQEGYKLHDRVLRPTMVIVAQ

SEQ ID NO: 5753 - protein, 325 aa, Enterococcus faecium
  misc_feature (B) LOCATION 1...325
  hypothetical: YES
LLDCTLLDASTVRFSLFARIGKRSSGLRKCSFFFYYQTVITRRTQMKPKKRKLLDLLMLFLLLSGIGILAYPFVSDALNNYLDQQIISHYQQQAVKENEEVMAKIQENMTKKNQQLAKEGGNPGADPFTKKKEPAKKDRTYFEKHTIGILTIPEINVHLPIFDETNTVLLEKGASLLEGTSYPTGGENTHAVISSHRGLPQAKLFTDLPKLTLGDSFYIEINGRTLAYQVDQIKTVEPTDTKDLRIEKGQDFVTLLTCTPYMVNSHRLLVRGHRVPYHAKEVQKEVQKVSENKRFFLYGLLAACILIFLLLIYLFRQSFKIRNRS

SEQ ID NO: 5754 - protein, 369 aa, Enterococcus faecium
  misc_feature (B) LOCATION 1...369
  hypothetical: YES
SFCCDHLCHSIEFIAEWRLFIIEKRVLSYALYFLRKGDQMKKLWLLLPLLLLLSACGTAKETSSKQEIKDLKKVTLVLDYVPNTNHTGIYLAKEKGYYKEAGLNVQIIEPGDNSTSIGLVGADKAQFGVSYQEDVTYAHADGQNIPVKAIATVIKHNTSGFATLSDSNIHSPKDFEGKTYAGWQSPSEEAVLKAVMEKDGGDFSKLTMVGSNGEGPESLGKSSDIQWYFEGWDMIKAKEAGIELNYIPLKELDERLDYYTPVIITNDQLIKSDPELVQSFMDATKKGYQEAIKDPNDSAKLLQKYAKENDRTFLEESQAFLSKNYTDDPENWGLMEEKVWRNYTAFMQENGLIKQDVPSQELFTNQFIK

SEQ ID NO: 5755 - protein, 201 aa, Enterococcus faecium
  misc_feature (B) LOCATION 1...201
  hypothetical: YES
FVCCTDDFIVYIREIRYEIDFIASIFKIASNCIESNGATSISDMDIIIHSRSADIHTDMSLLYRDEFFFFSGQCIVDFYHSDLLTFSPLIRTTFAGTPTAVASSGTSFNTTAPAPILAFFPIVTGPNICAFAESMAPCLTVGCLLPVSFPVPPNVTPWNKITSSSISAVSPMTIPIPWSMNTPVPIVAPGWISTPVRKRQN

SEQ ID NO: 5756 - protein, 217 aa, Enterococcus faecium
  misc_feature (B) LOCATION 1...217
  hypothetical: YES
LACWYKIQKSKVTFKSFGNIFQSFFTCSIIKGEMTMNYCYVFIGPSGSGKTSLAEAIFQPEQKIITYTNRSPRPGEKDQEDYYFVSDNTFNQMIKGNEFAEWDQYAQHKYGSSKAEIKKKLTVGNCYAVLTANGFWHLYEYFGTVVRPIFITISKETLQSRLKKRGDSSEQISARLAVYVEDLAQLKRLKAIPSLLVVSNDGAFQEAADKIKKGLLI

SEQ ID NO: 5757 - protein, 248 aa, Enterococcus faecium
  misc_feature (B) LOCATION 1...248
  hypothetical: YES
NNCCFTMKGIFMIPEEFRQSLAEKGIELTDHQMNQFAIYYRTLVEWNEKMNLTAITDEKDVYLKHFYDSLTLAFEVDFTQPLSLCDVGSGAGFPSIPLKIAFPELQITIVDSLNKRITFLSELTRLLGIDASLYHDRAETFGQNPHFRASFDLVTARAVARLNVLAELCLPLAKQEGYFYALKAAKSEEELTEAKQAIALLGGKFLKEEAVTLPNVSDQRHIIVIQKKKPTPKKYPRKPGLPNKQPIK

SEQ ID NO: 5758 - protein, 256 aa, Enterococcus faecium
  misc_feature (B) LOCATION 1...256
  hypothetical: YES
YRRLFFSFWRESMLHEDERIDQLYAEDIKIIQSSKVFSFSLDAVLLAHFSRVPKKGKIVDLCAGNGAVGLFLSKRTQAAIDAIELQPRLADMARRSIALNHLNEQMTVHTIDLKDSLSVVRHNSCDLVVCNPPYFKGLPTNKTNPNKHLAIARHEIHTTLEEVIDISSKLLKTNGRFTMVHRPDRFLEIIQVMEDYRIAPKRIQFVYPKPGKEANILLVEGIKEGKLDGFKVAPPLITYNMDGEYTAEIREMLYGK

SEQ ID NO: 5759 - protein, 85 aa, Enterococcus faecium
  misc_feature (B) LOCATION 1...85
  hypothetical: YES
TGRCFVSKKIFPIYFPMIPRHNNWIPPMNRKIETMEGHPDVGSPNNNARKIMNKIAIPEPTQDKAPINEAIVNGASEKFTIPSIE

SEQ ID NO: 5760 - protein, 102 aa, Enterococcus faecium
  misc_feature (B) LOCATION 1...102
  hypothetical: YES
KVSWNYLAGKRCRIMGFTDETVRFGFDDSRKKEVSETLAIVYRALEEKGYNPINQIVGYLLSGDPAYIPRYRDARNLIRRHERDEIMEVIVKDYLSNHGVNL

SEQ ID NO: 5761 - protein, 83 aa, Enterococcus faecium
  misc_feature (B) LOCATION 1...83
  hypothetical: YES
RSSCGCTGVSLSDSTGHGDKRGQIFYKNTDRLSLTFAGERSWRICFNGSLSVKGIELLYSVVKERLKEENHLSYISRWKRVKA

SEQ ID NO: 5762 - protein, 223 aa, Enterococcus faecium
  misc_feature (B) LOCATION 1...223
  hypothetical: YES
SRSWIGFMNDEYKNDEDKMLFEEIENRCRLNFELRGKMSLIQQKKYLANKSEFTLGHVEKLISDWISSRSEFTKIKQPIKFDMKKLLLNKSEIGNRDQYIRAKGQEIIDSLGEMRSYNYLYVTHRADGMVITVGKSSSNDIFLDGDLFYQLNTNHLSGTENIILRTEYGNEIFAKYDEILKNYLDWAWIIPVESGDAKKLERLLGDELINKKVPILNYYSHRQ

SEQ ID NO: 5763 - protein, 192 aa, Enterococcus faecium
  misc_feature (B) LOCATION 1...192
  hypothetical: YES
RHGCLDLEVDERARLGLFLAMQYPSEIPGITNAEFMRAAINAKRDENDKISVMAFLKKLDEKMALLNMPEEMAERYLNEGFSGGEKKRNEILQLLMLEPTFAILDEIDSGLDIDALKVVAKGVNEMRGDNFGALIITHYQRLLNYITPDVVHIMMEGRVVMTGNADLAKRLEAEGYAGISKELGIDYKEEEA

SEQ ID NO: 5764 - protein, 220 aa, Enterococcus faecium
  misc_feature (B) LOCATION 1...220
  hypothetical: YES
FLGCMRINNAGDPVKVIETAYENGIDFFDHADIYGNGECEEIFADALAKTSIKREDLFIQTKCGIVPGVMFDFSKKHIIESVEKSLTRLKMDYVDALLLHRPDTLVEPEEVAEAFDELERSGKVRYFGVSNQKPMQIELLKKYVRQPLVANQLQFGLKHTGMIDQGIHVNMTDEASIDHDGSVLDYSRLHDMTIQAWSPYQYGFFEGVFIGNEKFRLFVK

SEQ ID NO: 5765 - protein, 348 aa, Enterococcus faecium
  misc_feature (B) LOCATION 1...348
  hypothetical: YES
VLRLTNRKEVSFLKNIILTGDRPTGKLHLGHYVGSLKTRVAMQADEDNQLFVMIADMQALTDNAKNPEKVSSNVLQVALDYLAVGLDPAKSTLFIQSQIPELAELTMYYLNLVSVGRVRRNPTVKTEIEQKKFGESVPTGFFIYPVSQAADITAFKANLVPVGEDQKPMLEQTQEIVQSFNHTYGEVLVEPKGVFPPKGMGRLPGIDGNGKMSKSLGNGIYISDPADVLQKKVMSMYTDPNHIHVQDPGQVEGNMVFTYLDVFGTDKEAIEEMKAHYRRGGLGDVKIKRYLIDVLEAEFAPIRARREELEKDPSAVMEILRKGSEEAAKVAAQTLSEVKSAMGINYFH

SEQ ID NO: 5766 - protein, 87 aa, Enterococcus faecium
  misc_feature (B) LOCATION 1...87
  hypothetical: YES
TPRLNKRLPEISEKKCEEIISTFGTISKTTGKSRLPATVLKNTDFPNRTAARSSIIRLMLQTVTERWIEKAVSTKCPMAPTPAEAIS

SEQ ID NO: 5767 - protein, 235 aa, Enterococcus faecium
  misc_feature (B) LOCATION 1...235
  hypothetical: YES
ISLCLERIMKNFINYGLIQKKVKNIPYRRLLKIIMIIILLPISAMADITFIKTYQRDLDIVHGITIDIFPLDVAPVSKFSRKIQKLWALVYALFCSQVVPEKHGGIMATGSKILLSIFRSPRTRYKIWSFAEKQMTKYNNEPTGYVTELCVGPKYMGNVYPAKDFESAVWVPFEDTEMPVPVGYDNYLSQVFGDYMQLPPEKDQVSHHEAVYIDPEHPYTMYKGKYYLTKGAEKK

SEQ ID NO: 5768 - protein, 200 aa, Enterococcus faecium
  misc_feature (B) LOCATION 1...200
  hypothetical: YES
TNLWRNYFMSEELLRAARNGDEEAFAALYQKYFPLLLRLKNTYYLRNYVSEDWEQEARIALYQALRTYEKSKGVSFGSYYKSIISNQIYSLLRKQNALKRRDQKDEVSIDQKIETEGPDFLAEITLQEPLAIQHLLLKEAIENCEIQFSKIEAKIFHYYMQGVDFVDMAECLAMDHKQVMSAYGRVKLKIKKHLKFYNEE

SEQ ID NO: 5769 - protein, 204 aa, Enterococcus faecium
  misc_feature (B) LOCATION 1...204
  hypothetical: YES
MSLCYFDYYHQLEEKLRIEEPLMLQAGTWIAKQINQGGRLQIYASRTLSGVAFEFWDQTPDLVPSILIENPAGGVYETLEGAGQAIIDQLSVKSEDIFLLLSNEGRNPAIIELAQWIKENGHPLIIVTGFDLSRSIKSQHSSGLRLFEFADLVLDNHANLHDAVLTLPNLDPAICGTASLATIFLLQQVLYFTAKQLVQDTSGK

SEQ ID NO: 5770 - protein, 236 aa, Enterococcus faecium
  misc_feature (B) LOCATION 1...236
  hypothetical: YES
GKLCFFIRNSCLEGGEIMSHDHLCVSFVPLFNHLVQQDQEKVHALVKHHYVEKGEQILAPNGEPQLVIVASGSMKVYQLSASGKEQLLRVIEPGGYEGESQLLGVPNESLFGEALEKTEICILRQKDFSELLLHYPALSLKLLAINVEKLTKVQQQTTFLMMEKVEERVAVYLLDLAKATGKDHFFLPMKMKELAAFIGTTPETLSRKFKLLEENGYVKRKNREVWIIDKEQLEDL

SEQ ID NO: 5771 - protein, 414 aa, Enterococcus faecium
  misc_feature (B) LOCATION 1...414
  hypothetical: YES
HDICLVCSARQMNMEVETMSSKELTMYLEKELDQLKEKGLYNTIDILESENGACIIVDGKKMINLASNNYLGFANREELKKACIEATETYGVGAGAVRTINGSLKIHQQLEEKIAEFKGTEAAIAFQSGFNCNMGAISAVMTKEDAILSDELNHASIIDGCRLSGAKIIRIKHQDMKDLEKKAKEAIESKKYKKIMYITDGVFSMDGDIARLPEIIPIVEKYGLITYVDDAHGSGVTGKGAGTVKHFGLSDKIDMQMGTLSKAIGVVGGYVAGSKTLIDWLKARSRPFLFSTSLTPGAAAAALASITLMQEHPELVEKVWENANYFKEELKKVGYNIGMSETPITPVILGDEKVTQTFSKKLIEHGIYAKPIVYPTVPLGTGRIRNMPTAEHTREMLDEAVAVYQKIGKEMEII

SEQ ID NO: 5772 - protein, 225 aa, Enterococcus faecium
  misc_feature (B) LOCATION 1...225
  hypothetical: YES
QIIWIMIKCGENNEGGKYMQIDWNNLGFSYIKTPWRFIAKWKDGQWEEGELTEDNYLTIHEGSPALHYGQQCFEGLKAYRRKDGKVNLFRPEQNSRRMNQSARRLLMPMVPEKMFVDAVKQVVKANEDFVPPYGTGATLYLRPLLIGVGENIGVHPAPEYLFVVFCTPVGAYFKGGLKPTNFIVSDYDRAAPKGTGAAKVGGKLRIEFTSRNRSKRTGLLRLCLS

SEQ ID NO: 5773 - protein, 383 aa, Enterococcus faecium
  misc_feature (B) LOCATION 1...383
  hypothetical: YES
TGICKKRIERVAKSMNILVTGSNGFIGKNLVAELKNEGFTDILSFDRDTPVHLLDEYCKKADFVFHLAGVNRPKDDEEFMKGNFGFTSELLEKLKAHGNTCPVMLSSSIQAELDNSYGKSKKAGEELLKKYQKETGAPVYIYRFSNLYGKWSQPNYNTVVATFCYKIAREEEVTVNDPSAVIELCYIDDVVKELLHCLNGQPYMEKGYCAVRETDEVTVGELKELITSFKNSRTNLSVPNLARRVEKNLYSTYLSFLPEDDFAYFLKMNVDDRGSFTEFLRTKDRGQVSVNISKPGITKGNHWHHTKNEKFLVVSGEGVIRFRKVDSNEIIEYFVSGEKLEVVDIPVGYTHNIENLGSSDMVTVMWVNEPFDPEHPDTYYVEV

SEQ ID NO: 5774 - protein, 325 aa, Enterococcus faecium
  misc_feature (B) LOCATION 1...325
  hypothetical: YES
FWICGSSFLCYCFLYCDIVDNPNESRRRKSMKNMVEKETIERPNVKKQALELRSTIGSVLKYTALSILSFISIFPFVWMVLGMTNTPVDITSGKIKIGSNLIINFQNLFSNELNFTRSLWNSAMIALLTTVFALLISSMAGYGFEIYQSKRKDLIFNILLLSMMVPFAALMIPLYRMFSQLNGTVLGINSFLVVILPSVSTAFLIFFFRQNVKSFPKDLVEAARLDGLKELSIFFRVYMPTAKNTYAAAAIITFMSSWNNYLWPLVALQSPDKRTVPLVLSAMGASYTPDYGMIMAGLVIATLPTAIVFFVLQKQFVQGMIGSVK

SEQ ID NO: 5775 - protein, 75 aa, Enterococcus faecium
  misc_feature (B) LOCATION 1...75
  hypothetical: YES
VDVWKVSRFFLCFKEVSSFSFTVNHFTISKTFDIFNVNWYFYFKNINVKAWIRENFHRFNDFARFHFCIFNRTCI

SEQ ID NO: 5776 - protein, 446 aa, Enterococcus faecium
  misc_feature (B) LOCATION 1...446
  hypothetical: YES
VSVCSLEFFGGNNMEEIIVRGGNQLNGTVRIEGAKNAVLPILAASLLAEGGITTLDNVPILSDVFTMNQVIRHLNVDVDFDEQKNQVTIDASRQLEIEAPYEYVSQMRASIVVMGPLLARNGHAKVAMPGGCAIGKRPIDLHLKGFQALGAKIIQKNGYIEAIADELIGNTIYLDFPSVGATQNIMMAAVKAKGTTIIENVAREPEIVDLANILNKMGAQVYGAGTETMRIEGVDHLHAVNHSIVQDRIEAGTFMVAAAMTQGNVLIADAISEHNRPLISKLIEMGAEIIEEKGGVRVIGPKHILPTDVKTMPHPGFPTDMQAQMTAIQLVAEGTSVVTETVFENRFQHLEEMRRMNAHVKIDGNVAIMDGNHELQGAEVYATDLRAAAALVLAGLKANGITRVRNLNYLDRGYYNFHIKLQQLGADVERVDMDQTSAEKTAQTIA

SEQ ID NO: 5777 - protein, 160 aa, Enterococcus faecium
  misc_feature (B) LOCATION 1...160
  hypothetical: YES
SIVCVTTLSMPITIIFISIFILKVWVNMVIDNSKEKERLNKQISAIKTSLEEHFGLKLFQDSVGEDELPDDFNYFILETGEIEMITEPKYSVGQNLYLTFYSENREDLTGDSLDIISLIQNRSIRFQRMDPNHLKLENQDRYIDQLVFTFRRLLKSDCHG

SEQ ID NO: 5778 - protein, 226 aa, Enterococcus faecium
  misc_feature (B) LOCATION 1...226
  hypothetical: YES
YEVCGRWTGKNMEAKITLEPFERILSGYRKVEELAVNVTDCSKLAQKYARFGVEGYRLGNYVGTGYLNRYLECMVDRAPMLIYRQNYLIPLLFRRSDSAFRLFEEEYRMEAFFLLLEWSLKHRPEKILIERNEKIDTKKNKVIDSAYLAFRVSEILDCGGYPISNFQSIDQFIEWNRIYRLIDNGGIGRHSKVFDPEYPENMEELKMIISLVKLKYPETDLDLYIE

SEQ ID NO: 5779 - protein, 123 aa, Enterococcus faecium
  misc_feature (B) LOCATION 1...123
  hypothetical: YES
KGVCTLFEEFIDINERQVYQFLNYCYERDEKLYVVKDIALDLNYTLAKMNSVIQQAESFCERYPEYKLSFLSENKMIKVEFSSQFLLSKVYSILLEGTIGYILLDSLYKGTYQSLENLSQKII

SEQ ID NO: 5780 - protein, 470 aa, Enterococcus faecium
  misc_feature (B) LOCATION 1...470
  hypothetical: YES
RNSCCFIRSTMASSYIWFFRYYSNEWNSFYFSKTSFSMGKNFFSFYLEKSQVAICFDKKTNSNKKRDERNITYFCQWRPIPAGKRTDLGTEGKIMRILIAPDSFKESLTALEAAQAIQSGFQEVFVQAEYDLLPIGDGGEGTVSSLADSLRLKRQTAVVTNAFGKNKEIQYASDGQTAIFEMAEIVGLKDVPLNQQQPLRLSTRGVGELIRQLLQQGVRHIIIGVGGSSTNDGGIGMAEGLGYAFYDQDNQKVEALGENLGKIATVDKTNVPIELIKAKITVITDVTNLLCGKEGASFVFGPQKGLKENELAVADQAMHDFYMRFAPQVIEASGSSAGGGMGAGLLAFASGKIVSGIDYVLDLLEFDKRVQQADLVIVGEGRLDGQSLKGKAPVGIARRVPEGVPVIAICGSVGKGSEKAADVGISAVFPILPAAVPLQEALQQATDNLHRTAKNIASLLQVVHFQGGNR

SEQ ID NO: 5781 - protein, 70 aa, Enterococcus faecium
  misc_feature (B) LOCATION 1...70
  hypothetical: YES
QKSCHSPLFRINGVLMPTPRSQVTIVIKHEKLFFEIAPCDAELNGRLTTSSLNGVQKLASAIISPAKRKI

SEQ ID NO: 5782 - protein, 93 aa, Enterococcus faecium
  misc_feature (B) LOCATION 1...93
  hypothetical: YES
KKPCTPGCLYRRKLEERRVNRSFFHYLMTLRGGGTHDALSVFATEAGKDIQFPKHSSSYEEISNYLELNVDYLPSMDIFDEAWEKYLENNHDI

SEQ ID NO: 5783 - protein, 208 aa, Enterococcus faecium
  misc_feature (B) LOCATION 1...208
  hypothetical: YES
LHAWTRKYPFSLILLKRSKNISNTRDRFISIITACEIGVKEFYQQEKPDLTLIFENLQSPPVDKLLGSMFKGYFNIEFPKEIRKEIKNFIEKRNKLVHSPQGSKPTIEECFECYMAVLKTFNFFYKINDSFMYRDFYEESIELTPTEPNKSQITLSKELERKVESQELAIGISITNVSTYKELYEAKSQDNKDFVENIDKEPTNTVGD

SEQ ID NO: 5784 - protein, 298 aa, Enterococcus faecium
  misc_feature (B) LOCATION 1...298
  hypothetical: YES
FLGLIVNHSISPFEHKKTKHTEAPLELNHHNTIKGAFCMPDLHLIKLLLGIKDGNIQITHVEKKKIHSINSIVVSATLIKTIQPCPQCKQVNQHGLIVKNGKKKSLVLLNKCANQRTYLALAKQRYLCRGCHTYFTANTYIVEKNCFIAKQVHYKILEELTEKQAMTTISKHCGVSWSTVSRTLASLLPMTNVKINWLPRCSLVDEFRSLKNQVGPYSFSCMDGDTGKLLDILPSRKKKDLISYFMQFERRARLNVKILVTDMNASYALLIKECFPHAKLVVDRFHIVKHLIRSFKDI

SEQ ID NO: 5785 - protein, 87 aa, Enterococcus faecium
  misc_feature (B) LOCATION 1...87
  hypothetical: YES
PTGLPPLHSSYVAVPIACDAFNAQAVAVREYHYLTAQVMAIKEDKSFTRTQIGCRSLLQEKGHGVSVSTARCLSKVLNCFIQLSKSD

SEQ ID NO: 5786 - protein, 566 aa, Enterococcus faecium
  misc_feature (B) LOCATION 1...566
  hypothetical: YES
RKQWRNFQMKNSFVELNARERVNALLDNGRELIDPFDQIIAPSLPAQGIVPESDDGIVVSRGTINGKQAVVIAMEGKFQGGGIGEVSGAKIVAALEHVLEENKKGNEIFPVIVLDTGGVRLQEANYGLLSISEIGNVIIALKQYVPVIGLIPGRVGSFGGMSITSALMSYLIATKKARVGLNGPEVIEQEAGVREFDSSDKDLIWNTLGSRQRVESKIIDELVTDSVEAIKAAVIAAMDERKDTHRSESSAFYLSLLDSLDLSKPMAIDDYNEAIANHQAKSIDLPEVAEGNEPAAASVGYDWFAALTGMKNPTSSISTVYYGKSSKFIEEAIVTSIVPDPKNPMYRVRNGEVGLVEGFRMGQILDHVYEEDKDKKVKRPIIVVIDVPSQAYGYNEELIGIHVALANSAAAYAKLRQAGHPVIGLIAGNAISGAFLAHGLQSSRLIALNNKEITVQAMSKESAARVTKRSVAEIEAAAEKVPAIAYDINNYTKLGAIYHFLEDITDQAASEQNVSKVIEAINEAIQDVRNTNDTMLTNRYTNETAKTFGRVETNKVRAKMDEEWDA

SEQ ID NO: 5787 - protein, 491 aa, Enterococcus faecium
  misc_feature (B) LOCATION 1...491
  hypothetical: YES
EKQWKTMVPQLSIITTRKRSENMGVPELEEYKFGFHDDVEPVFSTGEGLTEEVIREMSRIKGEPEWMLEFRLKSLETFNKMPMQTWGPDLSDIDFDAIKYYQKPSDKPARDWEDVPEKIKDTFEKIGIPEAERAYLAGASAQYESEVVYHNMKDEFEKLGIVFTDTDSALKEYPELFKEYFSKLVPPTDNKLAALNSAVWSGGTFIYVPKGVKVDVPLQTYFRINAENTGQFERTLIIVDEGASIHYVEGCTAPTYSSNSLHAAIVEIFTRKDAYCRYTTIQNWSDNVYNLVTKRAKAYEGATVEWIDGNLGAKTTMKYPSVYLDGKGARGTMLSIAFAGANQIQDTGAKMIHNAPNTSSSIVSKSISKDGGEVNYRGQVTFAKNSAGSISHIECDTIIMDEWSKSDTIPFNEIHNSQVSLEHEAKVSKISEEQLYYLMSRGLTESEATEMIVMGFVEPFTKELPMEYAVELNRLISYEMEGSVGYPCYRS

SEQ ID NO: 5788 - protein, 228 aa, Enterococcus faecium
  misc_feature (B) LOCATION 1...228
  hypothetical: YES
MEGLSVIKEIKKVQIALLAFGVFVVCYNFYEFITQKYSTSQGITFIVESLLGIALIFMPQVILKVFKLKIPAAIVLFYWFFLFISVFLGTGMHLISIISFWDKILHAVSPMVLTALGYGLIGYLMKDAEISKTSPWLFLLFGFAFAGLCGVFWEFWEFLCDQFLGMNLQRFAASDGTLFVGRAALMDTMGDLLTNTIGAALMGLFAWSQSKKDERYFESYKLEKVKNT

SEQ ID NO: 5789 - protein, 294 aa, Enterococcus faecium
  misc_feature (B) LOCATION 1...294
  hypothetical: YES
KDKCVQYGGLTMKKFHSSARFQKRLSHFFTYFFLLILSVIIIYPLLITASTAFKSGNIAAFSLDLSSDWTLGNFTRLFSETLYGTWYKNTLIISVLTMIVQVTVVTLAGYTYSRYRFIGRKSSLMFFLVIQMVPTMAALTAFYVMAFLLEALDKYWFLTMIYIGGGIPMNTWLMKGYFDTVPIDLDESAKLDGAGHFRIFFQIVLPLVKPMLAVQALWAFMGPFGDFMLAKFLLRTPENQTVAVGLQTFISDVTNQRVSLFAAGAILIALPICLLFFFLQKNFVTGLTSGGTKG

SEQ ID NO: 5790 - protein, 312 aa, Enterococcus faecium
  misc_feature (B) LOCATION 1...312
  hypothetical: YES
TEKCKFFLKYVLKMVQLVCDCTERSTLVKITITLPMNHPETTIRDLLEKEWLVPRKVRHFLRIRKNVWINQQPALFHHEVKGNDQITLLFEETDYNYQEVQLGDAKHIRVLYEDEHLIIVDKPAGMKTHPNEPTENSTLLNHLAAYLDTKQQRPYVVHRLDKETSGAVLFAKNPFVLPILGRMLEQKMIYRRYQAIVWGEIAKDMTITNKIGRDRHDRRKRVVDDKNGQSALTHVTVNKVLCEQTQVYCVLETGRTHQIRVHLAHKGHPIVGDPLYQNRTAERLMLHALELHMIHPFTQEKIVGKALPGLWE

SEQ ID NO: 5791 - protein, 262 aa, Enterococcus faecium
  misc_feature (B) LOCATION 1...262
  hypothetical: YES
DRKWGKSMKSNEKTPLTTSLILLLSITCGVVVANMYYIQPIGTKVAASLSVSTSAVGILTMLTQLGYALGLLFLVPLGDVVDRPKLIIRMVALSAVSLLAAFFAPSFTLFACASFLIGLLSIVPQIIIPYGAVLAGPKARGKVMGTLLSGLLVGILLSRTVSGIVASLFSWRMIYLFALCAVGILTLLLYWKMPRSVQQSSTAVSYLDSLKSLPHLVASQRLLREAAVSGFFMFGTFSIFWSTLIFYISSPAYNWGTFEAGY

SEQ ID NO: 5792 - protein, 101 aa, Enterococcus faecium
  misc_feature (B) LOCATION 1...101
  hypothetical: YES
FFEWHYHNQIVVQHVQSSVSRHLQHQNNETTDFENCQKQHVQRLEKKHRRTFSYLGRLPYSPYLEYSAMHFEQDEQYSAEQLPMERSLLRLLRGQKHRPSK

SEQ ID NO: 5793 - protein, 504 aa, Enterococcus faecium
  misc_feature (B) LOCATION 1...504
  hypothetical: YES
KERWSMLETLQPTMKLNRRDSVVVALTPIPKQTQLTIDQQTITTLEDIPQGHKIALGDLKAGDNVIKYGYPIGHVTTDVTAGQWLHTHNVKTNLSGELDYRYEKDVHPSHYLFENRTFQGYLRKNGKVGIRNDLFLVPTVGCVNGIAELIVKQFKEKHPDLGQFDHITILKHPYGCSQLGKDHQNTREILADAVNHPNAGGVLVFGLGCENNTVPEFKKILGEYDEERVKFLVAQDVYDEIEQGVALLEELLTAAENDQRISVPLSKLNVGLKCGGSDGLSGITANPLLGAFSDYLIAQGGSTILTEVPEMFGAEQVLMARAENEEVFDSIVDLINDFKQYFLSYGEPVYENPSPGNKAGGITTLEDKSLGCTQKSGSSPVVDVLQYGEKIRKPGLSLLQAPGNDLVAASALASSDCQLVLFTTGRGTPFGSYVPTVKVSTNTTLFERKGHWMDFNAGVLLEQPMEVILESFVQKIIAVASGEETKNEQNDVREIAIFKNGVTL

SEQ ID NO: 5794 - protein, 195 aa, Enterococcus faecium
  misc_feature (B) LOCATION 1...195
  hypothetical: YES
KGRCSMAXKMKQGSKSVVKSLINHHVDYVFGIPGAKIDGVFNELEDQCPELILTRHEQNAAFMAQAIGRITGEPGVVIATSGPGASNLATGLVTATAEGDPVLAIAGQVKRSDLLKLTHQSMDNAALFQPITKYSAEIQDPETISEVIANAYRMAKSSKKGASFISIPQDVVDAPVQGNIIKPLSDPKLGAASAR

SEQ ID NO: 5795 - protein, 255 aa, Enterococcus faecium
  misc_feature (B) LOCATION 1...255
  hypothetical: YES
KERCRVVRIKGLNIGSGRPKICAPLIGAVREEVLREAVLAREAGADLVEWRVDHYRKVFSFDEVAETLVLIHEMLDGLPLLFTFRTLAEGGEQDISIRQYRDLYEHVIHTGLVDMVDIELFKVESLGKGLIEEIKSLNIPLIISSHDFKETPADPVLLYRLNVMEHFGADIGKLAVTPNNERDVLRLMELTRRANAFVSMPIITMSMGDLGKISRLAGGTTGSVMTFGSLSNASAPGQLPVKALKQIIQLLNEPL

SEQ ID NO: 5796 - protein, 431 aa, Enterococcus faecium
  misc_feature (B) LOCATION 1...431
  hypothetical: YES
SMRWQKLLSKNAQNLFSLINLMKDLIWRKTDLAEELKIDVKTVDRHLKRLAESDCPIQLILHKKTVQLVYDQGYSEPYLLFVFLIQSPPFCLLKNLLLNEPYEQEYDRSTQERLRKWFGEYHLSFSYKKAQIFGSERKIRYLLFCFLKDFPHFFADDGEQSFSETFIQLLKQRKDPAEIEILGDSRTLFFELFPELLFREEQILPIKEKNYLAILRLSCNQITEKRWERIEETQDYRKLTIVTEKLDSLFWLNSEFESGNKSKLTKVLYQEWLRYVIGIHDRLVEEEVRYYQETLEKFPNSKDKLYQFRLAIQQALAHPAVEWGMLLLKTLQERGYLDVHPPEVKIVFFFRYEHQEARRLVGVLNKTLRHRKRISIHVCTRNKPPRYADLVITDHFFPLDHNEDQKTYLYHPSFGIERLLTDINYWLGKNR

SEQ ID NO: 5797 - protein, 268 aa, Enterococcus faecium
  misc_feature (B) LOCATION 1...268
  hypothetical: YES
LFGWQRRLDRKNPDQEIEAEMLKIREKHKDYGCLRMTNELRNRGFSINKKKVQRLIKKLGIKVTAYTRKSRRYNSYRGKVGAVAKNRIHRRFYTSICHQKITTDTTEFKYHEVDAKGIIRQKKLYLDPFMDMFNSEILSYRISEKPNALAVMEGLEEAIQTTNDCPYRRTFHSDQGWAYQMKAYRNKLKEYKIFQSMSRKGNCLDNSLMENFFGLLKQEIFHGKVYNCFEELKSAIDSYIYYYNNERIKQKLNWQSLVQFRKTTVTVV

SEQ ID NO: 5798 - protein, 470 aa, Enterococcus faecium
  misc_feature (B) LOCATION 1...470
  hypothetical: YES
KPLWCKNWSSCAHAGTQVPGQDPLWLAWATDLVNLKGAGDMSQYEFVLHNWTPARFKVGQMIGSSGILMGMAFAMYRNVDPDKKARYKSMYFSAALAVFLTGVTEPLEFMFMFAAVPLYVIYSVIQGAAFAMADILPLRVHSFGNIELLTRTPLAIKAGLGGDLINFVLCVIAFGVVTYFLANFLIKKFNFATPGRNGNYDNDSEETVVSNSGTGTADQQVVQIIHLLGGKENIKDVDACMTRLRVSVNDREKVGTEEAWKRAGAMGLIVKDNGVQAVYGPKADVLKSDIEDLLQSGAEIPEPEMVSTGNGQAGSKQYLGIEQELVSAASGEVIPLSEVKDPVFSQKMMGDGFAVIPTSREVVAPIAGKVTSIFPSKHAIGLETKDGIEVLIHMGIDTVQMNQPAFEIAVKEGQEVGTGTKLAEMDLDVIQNEEKDPTIMIVFTNDKVEEVVIKQLGTVTAGKVIGSIKM

SEQ ID NO: 5799 - protein, 497 aa, Enterococcus faecium
  misc_feature (B) LOCATION 1...497
  hypothetical: YES
TNLWENNRGKKEDNMNDATELAKELKEKEFSFQELVTDIQKKIKKQNHELNAFVALEPFESNSHELLIPQSEKGPLAGIPFPLKMLGQEKKGWLATSGSRLFETHRASHTSNYVRQAEAIGLVPFGQTNAPEFGFKNITDPVIYGPARNPWNLECTPGGSSGGAAAAVSSGIVPLAGASDGGGSIRIPASFCGLIGLKPSRGTMPVGPYAWRGWQGAAIDFGLTVSMRDTEALFYGMRSIHSGAPYQVSPVEWQTHPRKKRLKIAFCVDSPIHSQISEEAVLAVKKAVDFLGKEGHDLTEIPYPLDGRKLITSYYQMNGAETAAMIRSIETGIQRAVRKEELEPISWTLFQYGQKLSAATYIDSLHVWDEAAIVMENLHQEYDLFLSPTTAFTAPKISEDLQSDAIRAQMEHISDCSEVEGLDVVSSMFEESLKITPYTQLANLTGQPAISLPTHLTKENMPLGIQFMAARGREDLLFQIGYLFEANHQFHLPNPWK

SEQ ID NO: 5800 - protein, 178 aa, Enterococcus faecium
  misc_feature (B) LOCATION 1...178
  hypothetical: YES
QNLCQEEKLMASILLIGFMGAGKTTIGKGLAQCLQKEYVDLDTKIEEHIQLSIAEYFHYYGEKSFRKVESDILRKLSNEDKIIATGGGIVQSAENRRFLKTQPIVLYLEAEADCLVDRIQQDETSIRPLALGKTREEIKALLAQRLSWYEESATHRINTTNQTPEKIIDTIIERIKSI

SEQ ID NO: 5801 - protein, 446 aa, Enterococcus faecium
  misc_feature (B) LOCATION 1...446
  hypothetical: YES
ARLWLYSEFLGNPTVSKHFPKFISKGGPSSMKLFVGIDVSSEKLDVCFLTDDNQLSILSEISVANDIEGASFIRETILEFNNSYHFDQIVIGMESTSMYSFHPSMFFHEDEKLKKLNTLVTIENPFRVKQFSRMFDENKTDRNDALRIADFLRIQRFTTSPIKEEKYMALQRLTRTRYQLIKQLIRTKQHFLENLTYKCNTLAREMRDESTSLFSATLISLMTEDFTLDELAELPLEAFCDLLQEKGKGRFKQPEKIAKAIQRAITMSYRLGALAQESINVVLSVLVREIRALEKNIKELDKAIEQVIVVIPEYQCLTSIPGVGKVYAAGLIAEIGQIERFEDQTKLAKYAGLSWKVNQSGNYQSQNTPLTKQGNRYFRYYLVEAANSVKNYLPEYKAFYQSKYKEVPKHQHKRALVLTARKFTRLVDTLLRKHQLYTPPRSVIEK

SEQ ID NO: 5802 - protein, 99 aa, Enterococcus faecium
  misc_feature (B) LOCATION 1...99
  hypothetical: YES
ARLWLYSEFLGNPTVSKHFPKFISKGGPSSMKLFVGIDVSSEKLDVCFLTDDNQLSILSEISVANDIEGASFIRETILEFNNSSHSDQIVKAQDSSQRD

SEQ ID NO: 5803 - protein, 65 aa, Enterococcus faecium
  misc_feature (B) LOCATION 1...65
  hypothetical: YES
LSVWLNHNYDFTIPPASALHKLERNPNSYFVNVLIYFYTFPLETITKSLIPRSDSRISSVSPCIG

SEQ ID NO: 5804 - protein, 173 aa, Enterococcus faecium
  misc_feature (B) LOCATION 1...173
  hypothetical: YES
RVSWIKSKQYLMSTVYAGRMDRRTDMRAVVQRVSKAAVSVDQQEIGKIGYGLLVLLGIHETDTQKDVDYLVKKIAQMRIFEDEQGKMNISVEDVGGQILSISQFTLFADTKKGNRPSFVEAARPETAIPLYESFNEGIRSRGITVATGQFGADMSVSLVNDGPVTIIIDSKNK

SEQ ID NO: 5805 - protein, 107 aa, Enterococcus faecium
  misc_feature (B) LOCATION 1...107
  hypothetical: YES
TKSWRKRSPDCLSLVFRRWETMYWLILFFVFIFLLTASHLILNMLATYHIQINRWIWALASFLIVILPKIIVPHMNVLFSWGTYVLCGIFAINFMIEQHRWFVTSKL

SEQ ID NO: 5806 - protein, 676 aa, Enterococcus faecium
  misc_feature (B) LOCATION 1...676
  hypothetical: YES
WRSCKMTNEKHKDRWLWYPGDFEIRHGLLQNFQREERGFDWPAYWYMDDCHRNVKFKRYYFLDQPSMFKVTIQGVGYVEINGQKHPCGKWLTCPAGKAKIRIFVGHTSGLPAMFIEGDEVKSDIGWTASNFIEEYPAGWSPLYVDIAKDPNQIYYQKECVHPVTETEIGGGILFDFGRAVNGCVELISLDDHIESITLCYGESDVEAMDIDYCYYKQIGMTRKMKARKRAFRYLFIPEVSTGMVQLQVFHEFLSLSKQAAFSSDSSLLNQIWSVSEEAFKLCSDLFFIDGIKRDRWIWSGDAYQSFMINQYLFFDEEINKRTILALRGQNEIKQHMNTIVDYSILWLIGIENHYMMTKDYEFLRIVYPKMQSLMRYLMEQTNELGFIYGRAKDWIFIDWSEMDKEGTLAAEQVLLLKAYHSMITCGDILAETYGENENYHTHLYQEKYQLLKQNLFDYFWDEELGAFIDCYESGRRNVTRHANIFAVLFDFANKDQQQSILKNVLLNDTITQITTPYFKFYEQDALCKLGQTNIVYQTILDYWGGMLSHDAVTFWEEYDPTQTGNEKYSMYGDPYGKSLCHAWGASPIYLLGRYFIGLYPTKPGYEEFMIQPNLDSFETLNCTLPIKDGKISLEKTKDKIVITSDRTGGTVKMNGKSYPLLAKQPLVLTSYSKINA

SEQ ID NO: 5807 - protein, 181 aa, Enterococcus faecium
  misc_feature (B) LOCATION 1...181
  hypothetical: YES
KSPCCNTGSFLIYELLQKKSYHRNEEEKMEKEILIKSPGKTLIKVTDDSISIIRKGFINLVNQGIKGEKTIPFKNISAVQLKKPGMSNGYIQFTLLGGNESRGGILAATKDENTVMFTKKYWNEMENLKKYIEKQQSILDNNSKETQISSADEIKKYKELLDEGIINQEEFDFKKKELLGL

SEQ ID NO: 5808 - protein, 96 aa, Enterococcus faecium
  misc_feature (B) LOCATION 1...96
  hypothetical: YES
PSTWGGVQFIYDEVKVKQITHLSIKVDFCYLLWHQFQFMHVVIDYHFICCMDQKMDILMNNSQVIEFVVSTKTFWQIVMTVNGFCWQKLFCNLTLA

SEQ ID NO: 5809 - protein, 196 aa, Enterococcus faecium
  misc_feature (B) LOCATION 1...196
  hypothetical: YES
KGACFALYQMIEGGKYYLDMAPANDLKNQWIKPADNDPLNDKNVSKFISDKEGLVTTGQRFLPSGTYYFEELKGVEGYEMDEASKRIEVIIPEFWVDAKGQPQYVVVNGQEMAELESGKVPVSAYESATPRVYNETVKETTDKPKEPSGPSNPGQSGKWSVFPQTNEARTLISLLRILLLLGAVLLIKKERGEKNE

SEQ ID NO: 5810 - protein, 117 aa, Enterococcus faecium
  misc_feature (B) LOCATION 1...117
  hypothetical: YES
SKQCSTSIILNSEASPKAISERTSYLQVRLEFLRYPHLIPALFNVRGFGPPVRFTAPSTWTWVDHMVSGLQLHTQTPYSYSLSLRLGLFNLTSHAIVTRRFILQKARHHPLTGFDLL

SEQ ID NO: 5811 - protein, 117 aa, Enterococcus faecium
  misc_feature (B) LOCATION 1...117
  hypothetical: YES
SKQCSTSIILNSEASPKAISERTSYLQVRLEFLRYPHLIPALFNVRGFGPPVRFTAPSTWTWVDHMVSGLRLHTQTPYSDSLSLRLRLFNLTSHAIVTRRFILQKARHHPLTGFDLL

SEQ ID NO: 5812 - protein, 693 aa, Enterococcus faecium
  misc_feature (B) LOCATION 1...693
  hypothetical: YES
GGQCMIELGKKLNGRYQITGNIGSGGMANVFLAHDLILDRDVAVKVLRFDFQNDQTAIRRFQREALAATELVHPNIVSVYDVGEEDNMQYLVMEYVKGMDLKRYIQTHYPVPYETAVNIMQQILSAISLAHNHQIIHRDLKPQNVLIDNEGVVKITDFGIAIALSETSITQTNTMLGSVHYLSPEQARGSMATKQSDIYALGIILYEMLTGSVPFDGESAVTIALKHFQDDLPSIKALDPNVPQALENVILRATAKEPADRYKSAEEMSDDLSTVLSPARANEEKWQPHVMDNETKVITPLTEDAPMPDSFKSMPLPKDKPENETLPEEEEVLPDPKKKGQKKWWLILLAILAVLGIGTAVFFASGGRGEVVVPDVSDLSEASARETLAKAKLEVATKTEEIADDKIEEGNVVKTDPAAGTTVKQKREVTLYISSGTKKIKLDDYSGKSYEDAEASLKELGFSADLIQKEEEFSSEVESGMIISQSPSEDTEVDPKTDTITFTVSKGPETVTLSSHVGENYETVRNWLVTQGFNINNISATYDYSDTVPSGSIISQDPASGEVVAEETYINFVVSQGTEPKLNDISGYTKSEAQSYLASVGAEYIGHETSEYSNTVDKDKVIRTVPGAGTTITKGMVVNVIYSKGPDPASSSSEKDSSDSSSSSSSSSSTSNSSKEESSSSTSSSASTSESSK

SEQ ID NO: 5813 - protein, 305 aa, Enterococcus faecium
  misc_feature (B) LOCATION 1...305
  hypothetical: YES
FRQCVGSRFKCPAGNGNVDYSKERQGGADVKKLIKPILFCFVLYYLLPIIGTILYASSTKWSKSLLPSDFTLQWFQQLLTDREFIAAVGRSLLLAGVVLVTILLLMIPTIIWIHLYFPRLNRWLEKLLLLPYALPGVILVTALLRTYAETGIPMFVVLVGALFITALPIVYLSLNNQMRLINLKELVDAAETLGAPMSTIIIQVLFPNIRIGVTLVSLMIFSSVFGEYMLTNLLIGGRFQTVRIYMLRRMNENGHLASAVMVLYLLFMVGIALTTFMLTYRQKQQLSLKQTREEKQSKKKPLKEL

SEQ ID NO: 5814 - protein, 61 aa, Enterococcus faecium
  misc_feature (B) LOCATION 1...61
  hypothetical: YES
IFKCSYLLKTIEISFFRMERGKSGCDFSLPQPLKGSCIYNCTVSFPSNRKAEKARHIPRST

SEQ ID NO: 5815 - protein, 155 aa, Enterococcus faecium
  misc_feature (B) LOCATION 1...155
  hypothetical: YES
SKKCLSIWRKKRSVLKKQVIPAFTLIECLIGLMILSSLLLTFNLLIQQTIQVSEFLQRKDQKEWLIFLAQLEEELKSSHNVSVKNQQLHYTIEDKQYIIERYQAMIRKRRTSGGHQPMLTSITELQLLEKEHTISFYVHFENGEDGYAIWTKNDQ

SEQ ID NO: 5816 - protein, 197 aa, Enterococcus faecium
  misc_feature (B) LOCATION 1...197
  hypothetical: YES
VRECFFMKLTVFCGSRFGNKESYKFIAQTLGKYMAQEEIELVYGGSYSGIMGVISKTVLENNGKVTGIYPNGLFETELPGKDVTTFIPTETIDERKVLLFEKGDAVLVFPGGLGTLEEFSQLLSWIAIGLTPDKPIGILNIGGYYSGLQQLLETFAKEDFMDKKWLDQVIFSNNPLELVNELRAVSIKNQLLLKEAK

SEQ ID NO: 5817 - protein, 345 aa, Enterococcus faecium
  misc_feature (B) LOCATION 1...345
  hypothetical: YES
SGWWINRGDLMFRLLKDAFKVKDIRSKILFTVFVLFVFRLGAHITVPGVNAASLQNLSSLPFFNMLNLVSGSAMQNFSIFSMGVSPYITASIVIQLLQMDIVPRFVEWSKQGEVGRKKLNQATRYLTLVLAFIQSVGITAGFNQYAQLGFVNNPNVATYVTIGLILTAGTMFVTWLGEQITEKGIGNGVSMIIFAGIISRLPESIREIYEDYFINIDPSDIWKSAIFVAILLVAVLLIVTFVTFFQQAERKIPIQYTKRVAGAPTSSYLPLKVNAAGVIPVIFASSFIATPNAVLQALSGRFGSENWYKVMMEIFNYNNRHLVLTIYTIPDRCLHFLLRLCSSKP

SEQ ID NO: 5818 - protein, 318 aa, Enterococcus faecium
  misc_feature (B) LOCATION 1...318
  hypothetical: YES
MEWWGIKMKKKRFVTGFAVLAFSALVLGACGADDNGSSNSSSESSTAQSSTAKSTTASSAKVVAGGDLQDGTYKLEEKNYSNGYRAVFEMVVKDGKITESKYDNVNENGESKTKDAEYNKNMEAKSGTNPEKYIPELNDQFLKAQSASGVEVVTGATHSSESFQNYAQQLIQAAQAGNTDTIEIDNGADLKDGTYKLEEKNYSNGYRVQFEMTVAGGKVTESNFDYIDKDGKSKQDDTEYNENMKAKSGTEPKTYIPTLNDEFVKAMGEEDGSPANVQVVTGATHSSHSFIMYAQQLVNAAEKGDTQTIEVDNIVTEK

SEQ ID NO: 5819 - protein, 338 aa, Enterococcus faecium
  misc_feature (B) LOCATION 1...338
  hypothetical: YES
NSWWAHSNNEKERPYVRRKEMNLKTKVFTLSSMWLLAGVLSACSPSSDEETATTTNSTTSSTSTHTVTDTLGHKVDIPNAPKRIIGSYLENYLISLGEKPIAQWTVGSGSIQDYLQDDLKDVPTISYDLPYEKVLSFEPDLLLISSSATVEGGKYEQYSKIAPTYVVKNGTDVTWEEQLKDVGKALAKEKEAEKVISDYQKSVESTREELADKIENKTAAVLWVTNNSAFMVSKNRSSGIIVYDDLKFGVPDLVEEVSKEATSDWSAVSSEKLAELDADYIILVNSDKDAAMFNEPSWKNLKAVKDNHVLQFGPESSWLYNGPIASQEMVNDIKEKLN

SEQ ID NO: 5820 - protein, 138 aa, Enterococcus faecium
  misc_feature (B) LOCATION 1...138
  hypothetical: YES
CPWWRTLANIYFFVQSYLHNDFLVELILLPILVIIVIVVSDGINNNSGIISAIATLLLIALSIPQGESALYAIQRVLDTFIGTFIAIGINFFLRPPETEKKEELSEDLVELQKKERLLRTNLQEIEAKIQKQKKNSED

SEQ ID NO: 5821 - protein, 332 aa, Enterococcus faecium
  misc_feature (B) LOCATION 1...332
  hypothetical: YES
YMRCNFSLHTKSQGGKVMTDRISLEKEAVAFSDANAPHPRIYELAPEEGRVLLEEVQESPVNKYSVDIEDLMVDTGEWGKLNIRLVRPEGNMDKLPVIFYIHGAGWVFGSAQTHDKLIRELAVRTNSVVVFPEYSRSPEAKYPTAIEQNYAVLQQLNKLAKSKNLDLENLIVAGDSVGGNMATVMTILTKERKGLPISKQLLYYPVTNADFDTDSYHEFGENYFLTREGMMWFWDQYTTNEEERAEITASPLRANINELNDLPSAMILTGEADVLRDEGEAYARKLRDAGVPVTQVRFQGIIHDFVMVNAMDQTKATRAAMALSTSWIKKKE

SEQ ID NO: 5822 - protein, 433 aa, Enterococcus faecium
  misc_feature (B) LOCATION 1...433
  hypothetical: YES
NKRWKKMKKIIVTTCLLATGFLLTACGESQSSNESQQTTIQFMHSSVEQERLSVINELVADFEKENPDIKIKQVPVEESAFNTKIVTLARSGKLPEVMEVSQDFAKVMDKDELIDQTAVQNVIEEAGEDNYYDGAKNLVRSEDGKSYIAAPISGWVQGIWYDKEKLSEAGFSEPENWDDILKIAQHFTDKENKQYGIAMPTAEGTMSEQAFSQFALSNGANVLDDEGEVTIDTEKMREALSFYQNLSQYTMPGSNDVTEIKDAFMNGTAPMAIYSTYILPSVYEAGNSENIGFAIPTQKDQAVYGTVSGLTISSGLDEKQKEAAEAFTAFLSQPKNMEKWVLMSPGGAQPVNKQVVELDGYKENEVIKSFGELPSEIASAFDEVQVFGLVGEKNFTKMGDITSSGVIGKAVNQVTVGNEDVDQALADAQKNTK

SEQ ID NO: 5823 - protein, 78 aa, Enterococcus faecium
  misc_feature (B) LOCATION 1...78
  hypothetical: YES
TWRCCMTTAEMIKELCEQMNISVSELARRIGQTPQNFNKKLQRETVTLDELKAIADVLGVKFVQAFILPDGNEIKIGN

SEQ ID NO: 5824 - protein, 318 aa, Enterococcus faecium
  misc_feature (B) LOCATION 1...318
  hypothetical: YES
EVFRVYFCLAAINWSSKRENQIFKKGARMKIKKIFNQNAVLVDDGGQEKVAIGKGIGFDRKRNDLIFDRDVERIFVMEPEGQIKLQNLLNQIDERFLFAAETIIDHAETVLMEKLNEHVLIALTDHIAFSAENINNGIVIRNKLLREIEVLYSDEFSIAQWAVEYLTKELGIPYTYDEAGYIAIHIHSGRSGRNNNHRSIREVTIVSDIIHLVESELETDIHSEPFSLNYSRLVNHLRLLLQRTHAQQYAVLDTEIVEMVKRKYPESYKISKKIRVLLTKEYQLAITKEELGYLAIHIERLRSAIVQTNVNNHEEEKN

SEQ ID NO: 5825 - protein, 61 aa, Enterococcus faecium
  misc_feature (B) LOCATION 1...61
  hypothetical: YES
GILLGKVVKREKTGILFIDFQENPNILFSFIFIRDITYVKRKNIFRSASWAVDFILRFMFS

SEQ ID NO: 5826 - protein, 128 aa, Enterococcus faecium
  misc_feature (B) LOCATION 1...128
  hypothetical: YES
VYFRTHAKNNIKHRIKDLSYWLRSFISLNNPTVFLYGTLKRKVVSINPSAITKNNKKSSPVHSHWLYVKLQVIPLELRTIYLSLDRTGISQSKSFNSNLLKYENQLHRRPSKFFFSNQFFPIFSSTVY

SEQ ID NO: 5827 - protein, 65 aa, Enterococcus faecium
  misc_feature (B) LOCATION 1...65
  hypothetical: YES
NLFRRLIGRWSCSIKLLRYFTVRCSVLVYKPTLCNFLKAEPREGALSVTIAFGSPNCLWSRFKKA

SEQ ID NO: 5828 - protein, 65 aa, Enterococcus faecium
  misc_feature (B) LOCATION 1...65
  hypothetical: YES
PFIFSFPKKVFWFDTWHQFDQFSHQLATQQFNLSAHVFNQRSEYLYAAAFQFKCGTYGCHARRFS

SEQ ID NO: 5829 - protein, 107 aa, Enterococcus faecium
  misc_feature (B) LOCATION 1...107
  hypothetical: YES
KALLTSMQVKGGKCMIINDNGREYDTEKIEEYSSYTQGLIKRLIYVRYVGIRDLLSDNCCSKYKVNQVREALNKDNNVERIKNVFGYSIEEINYYIDFAEAFIPMVR

SEQ ID NO: 5830 - protein, 336 aa, Enterococcus faecium
  misc_feature (B) LOCATION 1...336
  hypothetical: YES
IYLLGGIYMEEKNLTVIGSYSTREEALSVIERLRNEGYERDDIVIYTTDEAASRLGFDGLSGIDVETDENRMDGEEDRSLWEKIKDTFSFDTYDSETATPENDPLYQYRGDISDGKFVITVKGYRQPETTEDTMDTQDTVSPASTMGTGLETGTGTDPMDVGGTTGFQNTTDPLNMTPGTDPMDVPGETDTMGTSKTEDIDRKPNLDDDTIQLKEEKLDVNTHDVTTGEVDIHKHVVNDTETVEVPVKREEIVIERKPVTDQSSQGTDEKLEDDTITIPIKEEQVDVSKHTVIREEVGIHKEEHEDVEKVTEDVSREELDIDTSGDVHIEDRNKKS

SEQ ID NO: 5831 - protein, 114 aa, Enterococcus faecium
  misc_feature (B) LOCATION 1...114
  hypothetical: YES
SNLLLANCFFYLLLILEDLFMIRILMIIATLVLLFVSYYLFNKQDIFFVLINKNDKNQGFLQFYGAAYAVLGVMGILTAFFNQRFIALVFLLIVIIVSATFSIRFAKKIAEPKQ

SEQ ID NO: 5832 - protein, 649 aa, Enterococcus faecium
  misc_feature (B) LOCATION 1...649
  hypothetical: YES
KNLLDKEMEYMTASHPFYERESLVILGDHVTLDAGTGLVHTAPGHGEDDYIAGSKYKLSVVSPVDSKGLFTEEAPGFEGIFYDKANPMITDLLKEKGALLKLDFFTHSYPHDWRTKKPVIYRATPQWFASIDKFRQNILDEVEKVEWVIPWGKTRLYNMIRDRGDWVISRQRAWGVPLPIFYAENGEAIITPETIEHVAKLFAEHGSIIWFEKEAKELLPEGFTHPGSPNGEFTKEKDIMDVWFDSGSSHEAVLRQRPELSFPADMYLEGSDQYRGWFNSSITTSVAINGVAPYKSVISQGFALDGEGRKMSKSLGNIIAPEKVIKQFGADILRLWVSSVDYEADVRVSMDILSQVAEVYRKIRNTMRFLLANTEDFDPKKDTVSYNDLRSVDKYMTVRLNQVIKEIREEGYDKYNFMHIYRTVMNFLTVDLSSFYLDFAKDVVYIEAEDDYQRRCMQTVFYQTAVALTKLLTPIIPHTAEEIWSFLKEEEEYVQLSEFPGYEEFANQEELMDTWTAFMDFRDNVLKALEEARNSKLIGKSLEAKLTVYPKQQVREMLKALDADIAQLLIVSPDYFEVMAADEQVPDNAMVFDDVAITVEKADGETCDRCRQVRKDVGVDEKLPHLCGRCAKIVEDFYPEAVAEGFEEK

SEQ ID NO: 5833 - protein, 270 aa, Enterococcus faecium
  misc_feature (B) LOCATION 1...270
  hypothetical: YES
YCLLFLLTALFIFPMLWMVVSSMKPEADVYQNLASFKAFLPSLNPANWFKTYQEVISRFSVGTYLLNSIFYGLTFACGSIIVNSLAGFAFAKVNFSGKRIIFGALLALLIVPMETVLIPQFTIVNSLGLVNTRLAVILPAMASAFNIYLFRNFFIAIPEEIIESAKLDGANIVKIFFHIMLPMSKPAIATVGVLSFISSWNDYIWPLMVLTDSSKFSMQVAITTINTTQPVYINQVMAVLTIATIPLIIVYIVAQKYILQGLGGSGTGIK

SEQ ID NO: 5834 - protein, 113 aa, Enterococcus faecium
  misc_feature (B) LOCATION 1...113
  hypothetical: YES
QLLRLLHFQFLLLLHSISYLSLLNNLGTVNKYLLHFAVLLLLILLVADYPSEARIQLRHRLHPKNQANRFALELILHLDIPLKNQLLILPTLFFLHKGLLLDNCVHQKQISED

SEQ ID NO: 5835 - protein, 227 aa, Enterococcus faecium
  misc_feature (B) LOCATION 1...227
  hypothetical: YES
YDIRKKKSQREVTFMGLNEFILGLNNLETITRAPGFFKYTEHTVAAHSYRVASIAQVLGDIEEANGQPIDWKLLYEKSLNHDYTERFIGDIKTPVKYASKELRGMLQTVEEKMTDEFINQEIPAEFQEVYRRRLFEGKDETVEGELLAISDKVDLLYESFDEIIKNNPEKVYKEMFIEAVTTIKSFEHRPSVQYFFKEIFPELLNQEFYGKEAFLETVSTIVKKEEK

SEQ ID NO: 5836 - protein, 85 aa, Enterococcus faecium
  misc_feature (B) LOCATION 1...85
  hypothetical: YES
CIIRGEDDIVNLRIKAGKGITELSNEYGVPKGTISTWVKLLSPIQVSETETISMKEYKALQKKMKELEIENEILKKATAIFAKNQ

SEQ ID NO: 5837 - protein, 93 aa, Enterococcus faecium
  misc_feature (B) LOCATION 1...93
  hypothetical: YES
PQIRRLRLEKPGQPHFRVGLSVGKKVGNAVNRNEVKRKIRAAVYSIKEEIDPELDFIVIARPSVKGLTYDEVRSNLVHVLKLAKIIDREEKSK

SEQ ID NO: 5838 - protein, 349 aa, Enterococcus faecium
  misc_feature (B) LOCATION 1...349
  hypothetical: YES
GGIRMSEKELMKVVGFYEGLPIDDPKSFIDEKEQIPVPSSRDLLVKVNAVSVNPVDTKLRQDNGIRNALRILGFDGVGKVVAVGDEVQKFSVGDRVFYAGTTTRAGSNQEYQLVDERIVALAPKNLSDEEAAALPLTSLTAYELLFEKFGLTPEENANRGKKILVINGSGGVGSILNQLAHWAGLEVYATASPKNFEWLKKTGVDYPIDYHHDLSKSFRELGIDQVEYVAVLFDITRYFDQIKHLVRPFGHVGTIVGIKEPLDIGVWKNQSISFDWEYMFAKTDYNYEIETQGEALAHIAALANEGIIRSTLSKVYSDGMNAKNLKQATKDVETGHMLGKVVVSGPFNG

SEQ ID NO: 5839 - protein, 107 aa, Enterococcus faecium
  misc_feature (B) LOCATION 1...107
  hypothetical: YES
KMVRPQEVRAPKEKIEILAIIEDGTQTKKGYSIALVKWKGKKGVALRWDGDNQQDKGFPVTANGYHPAWFVLPDKFMELYSYDYARAAASIKALDKLTEEQNEMEEK

SEQ ID NO: 5840 - protein, 75 aa, Enterococcus faecium
  misc_feature (B) LOCATION 1...75
  hypothetical: YES
ILLLQIKAKEEITMAKVCYFTGRKTKSGNNRSHAMNSTKRTVKPNLQKVRVMVDGKPKKVWVSTRALKSGKVERV

SEQ ID NO: 5841 - protein, 269 aa, Enterococcus faecium
  misc_feature (B) LOCATION 1...269
  hypothetical: YES
FILLVEKKYAIICIEVIVKMLTEERRQKILDLLEQQKIVKSQDLVNLLNASESTIRRDLQELENSGFLERVHGGAKKEQLLNFEQNMSEKSLKNVHEKQQIAKSAAETINDEDVIYLDAGSTTLEMIPFLQGKQITVVTNSVQHAANLVDLELATIILGGTIKLATNAVLGSNAIEQLKNFHFNKAFMGMNGAHLEQGFTTPDPEEAAVKRLAMKNSEETFVLIDHTKFNQLSFTSVAPLEAATIITERCPLEFVNEFREKTTIKEAIQ

SEQ ID NO: 5842 - protein, 91 aa, Enterococcus faecium
  misc_feature (B) LOCATION 1...91
  hypothetical: YES
RTSRLKRSGSFLANSCPCSFTSTKEAFGIVLAIYKECFSLITSFFPTMIKVGELIFFKSFSVSPMSCSKSLITKRFLRRLGRNKESNHTHA

SEQ ID NO: 5843 - protein, 327 aa, Enterococcus faecium
  misc_feature (B) LOCATION 1...327
  hypothetical: YES
MNSRYKINLVLLSKHRDGAAAYKFPPEEVETLIENIEWTVGRTGVVTPTAIMTPVRVAGTTVSRASLHNGDYIKLKDIRLKDTVLIYKAGDIIPEVSQVVLDKRPKDSEEYQLPTHCPVCGSELVHLDEEVALRCINPKCPAQMKEGLNHFVSRNAMNIDGLGPRVLEQMYDKKLVADVADLYKLTEEELLTLDKIKEKSANNILTAIDNSKDNSVERLIFGLGIRHVGAKAAKILAEHFGDLETLSKSDYESIIALDTIGDIIADSVVTYFSNEEVHELMNELKQAGVNFEYKGLRNAQLQEVESPFKEKTVVLTGKLTSFDRAEI

SEQ ID NO: 5844 - protein, 208 aa, Enterococcus faecium
  misc_feature (B) LOCATION 1...208
  hypothetical: YES
RIYRRRRQTISRNGDRICQTSRIRRTKMNALISIDYTYDFVAEDGKLTTGTAGQVIEKKLTAHTKKFIDQKDFVVFAIDAHDPKDSFHPENRLFPPHNVIGTGGRELYGSLKSLYQDYEQEENVYWIDKRHYSAFSGTDLDIRLRERQITDIYLTGVCTDICVLHTAVDAYNLGYKLHIFKDSVASFDPVGHEWALRHFESTLGAEIL

SEQ ID NO: 5845 - protein, 417 aa, Enterococcus faecium
  misc_feature (B) LOCATION 1...417
  hypothetical: YES
RSYRLDYFLRSYHQLYLKKEEKCMKIIRQIEVFAPDYLGKMDVLIAGGKILAVEEQLEGGYEGVEVEELSGEGKVLTPGFIDCHFHILGGGGEGGYQNRTPEVTLSQLTTAGVTTVVGCLGTDGEGRDMTALISKAKGLEAEGISTYVYEGSYRLPVKTVTDSIIKDFLTIDKIIGIGEIAVSDHRSSQPSFEEFARAVADARVGGMLSGKAGIINVHLGGGKRKLELLTRIVEETEIPITQFLPTHANRTPELFEACVAFAKRGGTIDFTASEDPDFWEKTDGEVRFSKALKRLIEEDVSLDNFTMTSDGQGSLPYFDENNHFLGLGVGSAKALLVGIKEAVQKESIPLEIALRAITSNPARILKLDKKGKIEIGADADLCILDKETLDIDTVIAKGEIMVQEKEVKVWGTFEKSF

SEQ ID NO: 5846 - protein, 74 aa, Enterococcus faecium
  misc_feature (B) LOCATION 1...74
  hypothetical: YES
PPYRQYAADYFGRAQAGAGSAAAKSAPARRPGQQGQRLREKYRAGMAGQHGDFRNTISVLRPQHTQGGRLIQCL

SEQ ID NO: 5847 - protein, 172 aa, Enterococcus faecium
  misc_feature (B) LOCATION 1...172
  hypothetical: YES
KHHRFQSNRCLSSNGTFLESRSEMTVQQEIVDTIKKYDKIIIHRHLRPDPDALGSQVGLAELLRESFPEKEIRQVGETIEGLRFLAEMQEVEDVFYQGALVIVTDTANSPRISDQRYQLAEKLIKIDHHPNDDPYGDLVWVNTKASSCSEMIAEFALMFPESLKMNVKGPRV

SEQ ID NO: 5848 - protein, 201 aa, Enterococcus faecium
  misc_feature (B) LOCATION 1...201
  hypothetical: YES
ERHRLARELHDSVSQQLFAAMMMMSALTEQAEKSETPEMFRKQLKMVAEIINASQSEMRALLLHLRPVNLEEKSLKQGIEQLLKELQNKIQISLKWEVEDVKLTSSIEDHLFRIVQELLSNTLRHAKANELEVYLHKIDNNLLLRIIDDGTGFNMNETKTGSYGLNNIKERVAGIGGTVKIISFKGQGTSVETKVPLMKEA

SEQ ID NO: 5849 - protein, 69 aa, Enterococcus faecium
  misc_feature (B) LOCATION 1...69
  hypothetical: YES
RINRIRRTTIMAELKVTLKRSIIGRPQNQRDTVKALGLTKINSSVVKPSNEAIKGMINTVSHLVDVEEI

SEQ ID NO: 5850 - protein, 226 aa, Enterococcus faecium
  misc_feature (B) LOCATION 1...226
  hypothetical: YES
VFLLETILIIEDDEAVHSLLEEVLEQRYKLLDAYSGTEGKLLLSTYPVDLILLDLMLPGLSGEALLAEIRQTSNVPIIVLSAKSDQRDKVSLLAAGADDYVTKPFDIEELLLRIGIQLRHQTSVQVKDLSQRIYYKEILLDKESRDVNVNGVAVHLTGREFDLLKLFLEHPKKVFSRANLYETVWQEPYFDSEKTVNMHISNLRGKLAKAHAVYIHTVWGVGFRFD

SEQ ID NO: 5851 - protein, 122 aa, Enterococcus faecium
  misc_feature (B) LOCATION 1...122
  hypothetical: YES
KGNRFAHRELKKGNSEIGGMSVDKKAAMKRIIELTHSENWQEDKEIVAEVQKLGKSMWTEKPKRKTPRKIAIWHGDRILVTGTAEQLSEITGLSKNIIWDRARSLWIDSKGRQFRYVEEKKC

SEQ ID NO: 5852 - protein, 112 aa, Enterococcus faecium
  misc_feature (B) LOCATION 1...112
  hypothetical: YES
SKNREGPDENGVSRFVLFREKGTPETRTEEEDRLVQMIEDIVLKVERVHFLTIVNTLPDNAHLFASVLDEIKPPSIVSTIAGFDTIMVISENEEDAKRVEEFLHHPTEVSLF

SEQ ID NO: 5853 - protein, 182 aa, Enterococcus faecium
  misc_feature (B) LOCATION 1...182
  hypothetical: YES
LMNRIWNKSHRNNCSLLMILLLGFILWQTPVHASEFNFAVDFELPANQIDKNKTYINVRMEPGKTQEIPYTVFNRTDKSVTVETLIHSATTNSNGVIEYGESKSKFDETLSYDMKNLAKTVGEITVPPQSAVTETLSLKAPEKELAGVVAGGITFQEKKENVSNKSTVGVVNQFSQVKAILI

SEQ ID NO: 5854 - protein, 196 aa, Enterococcus faecium
  misc_feature (B) LOCATION 1...196
  hypothetical: YES
FTDRSQRKFSGKSTDGCTSIHSFISQQHGQSAKIRIDCTIFETDSLREENSMQSLPFDMIELNRSFKTKEEAIRYCGQMLVEAGCVDEEYIDAMVDRDKMLSVYMGNFIAIPHGTDEAKKYVKKSGICVVQVPDGVDFGTEEEEKIATVLFGIAGVGDEHLQLVQQIALYCSDMDNVVQLADALSKEEVTENLAIA

SEQ ID NO: 5855 - protein, 258 aa, Enterococcus faecium
  misc_feature (B) LOCATION 1...258
  hypothetical: YES
LGDRRMKNQYPDLAKQVVFITGAASGIGAAQARAFLEQDAFVFGLDQKFGKMEEISLRFPETFAYALGDVRQMKELQQAVSKCQNHFGEVTILLNTAGILDAYKPLMETDESLWDLIYETNVKSMYQLTKIILPDMIRQKSGTIINMASIAGLIAGGGGIAYTSAKHAIVGFTKQLALDYAGQGIRVKGIAPGAIQTPMNAADFEGKGEMAEWVANETPVKRWAQPEEVAELTLFLASPQASYIQGTIIPIDGGWLLK

SEQ ID NO: 5856 - protein, 103 aa, Enterococcus faecium
  misc_feature (B) LOCATION 1...103
  hypothetical: YES
FQDRGTVSCGKGIHRSKRIRLSPTIDLNDFNTKLRNARKFLEKGDKVKASIRFKGRAITHKEIGQKVLNRLAEETADIATVEQKAKMDGRSMFLTLAPKNDSK

SEQ ID NO: 5857 - protein, 175 aa, Enterococcus faecium
  misc_feature (B) LOCATION 1...175
  hypothetical: YES
KRDRLMISLRVDAKDRIWGSLADEKIFKSLSKYGTEEMKNKDVIGTAYRLKLTGTYVLTEDFYFGFIHPSERYNEPCLGEQIKGRVIGVRPDGVLNLSLKPRAYEAISDDAQMILTILERSADQQINFTDKSDPEEIMKAFGISKGAFKRALGNLLKQGLITQENGVTKLVKKSN

SEQ ID NO: 5858 - protein, 197 aa, Enterococcus faecium
  misc_feature (B) LOCATION 1...197
  hypothetical: YES
GLILFKKGAKSMIKAIFFDIDGTLVTNRSKALESTKQAIEYARKNGILCGVATGRSPVKIKEIIDELELDMYVVYNGQLVFTANRTIIDHPFEQKVLEHIVEFADENHRQIVFGARNRLDGSTTMLLGQSIFIKRLVSFLPRKFPVRLMKKILQVFSPHRQKDRYETLEILKEPIYQCILLSPESEQKKLEHRFPGV

SEQ ID NO: 5859 - protein, 462 aa, Enterococcus faecium
  misc_feature (B) LOCATION 1...462
  hypothetical: YES
CQSRDNLKRRGARMNNFDIFRFKPFINEALTAKGFKQPTEVQERLIPLIAKGKNIIGQSQTGTGKTHTFLLPLFEKINAEKEEVQVVITAPSRELAAQIYEAATQIAKFSTPEIRVSNFVGGTDKQRQLNRLHHQQPQVVVGTPGRILDMMNEQALKIHTAFAFVVDEADMTLDMGFLNEVDQIASRLPEKLQFLVFSATIPEKLRPFLRKYMENPIIEEIKPKAVISEDIENWLISTKGKDENQMIYQLLTIGHPYLAIVFANTKQHVDEIADYLKNQGLKVAKIHGDITPRERKRVMRQVQNLEYQYVVATDLAARGIDIEGVSHVINAEIPEDLDFFIHRVGRTGRNGLKGTAITLYSPNDEQAIDAIEKLGVSFEPKEIKNGEIVKTYDRNRRAKREKSKDVLDPTLIGLVKKTQKKIKPGYKKKIDWAIAEKNKKERKIERRQQSRTARTNKKNSHK

SEQ ID NO: 5860 - protein, 60 aa, Enterococcus faecium
  misc_feature (B) LOCATION 1...60
  hypothetical: YES
PSGRRFESYKVHCGVVSFIWRITQVRLKGTVLKTVRRVKPCKGSNPLSSFFILSRDGAVW

SEQ ID NO: 5861 - protein, 347 aa, Enterococcus faecium
  misc_feature (B) LOCATION 1...347
  hypothetical: YES
LEGRVKERMEAGAFGYIRGGSEDEWTMKENTTSFNTKKIMPRILRGIDSADLHTSVFGIELDTPIIQAPSAAQGLAHEKGEADTAKGVAAAGSIFSISTYANTTIKDAADAAPGAPQFFQLYMSKDDRFNEFILNKAVEAGAKAIILTADSTLGGYREEDVINQFQFPLPMPNLAAYSEQSASGNGEGKGIAEIYAAAKQGLTPDDIKTIKEITHLPVIVKGIQSPEDAVIAISAGADGIWVSNHGGRQLDGGPASFEVLPKIAEVVNKRVPVIFDSGVRRGEHVFKALASGADLVAIGRPVIYGLNLGGAEGVTSVFEHLNKELSITMQLAGTKTIDEVKNTKLMD

SEQ ID NO: 5862 - protein, 102 aa, Enterococcus faecium
  misc_feature (B) LOCATION 1...102
  hypothetical: YES
TFMLMEGKTQLWFKFDPSNRFIKDFYKVWNSEVFFLAIEDSLLINLYYSNKNYFKIPAAKTRMKKGVYFLFDIVTDVPDARSDHRRYDYIKYTFVDPERYKD

SEQ ID NO: 5863 - protein, 102 aa, Enterococcus faecium
  misc_feature (B) LOCATION 1...102
  hypothetical: YES
TFMLMEGKTQLWFKFDPSNRFVKDFYKVWDSEVFFLAIEDSLLINLYYSNKNYFKIPAAKTRMKKDVYFLFDVVTDVPDAHSDHRRYDYIKYTFVDPERYKD

SEQ ID NO: 5864 - protein, 90 aa, Enterococcus faecium
  misc_feature (B) LOCATION 1...90
  hypothetical: YES
IVFRQFNEWCDLRLHYIKRKRREEEEMAYSTIGVVVEKSRDNLVFVTEIQTGRAFVVTDKAAKAYQNGDILTLNLTTKTCVDAAEDYPFV

SEQ ID NO: 5865 - protein, 225 aa, Enterococcus faecium
  misc_feature (B) LOCATION 1...225
  hypothetical: YES
WYFRYNFSYKEIGEYYMENKKPYGTVLIKASKILDYLAENQDVSLQTIAKGVGMTSSTVLKILDTLLMIGYVNKNSEKNYRLGAKLIRYANKNIEQIDLVELTLPFLEQLQQKIDETIHLGVLDNNEILYVNKLDPKHQTIRMSSKIGITRPLYNSAMGKAVLAEFSEEQYTDYLEKHPLIPYTEYTITNALRLKKEIQTVKETHIAFDDEDIERDIFCLGSPNP

SEQ ID NO: 5866 - protein, 60 aa, Enterococcus faecium
  misc_feature (B) LOCATION 1...60
  hypothetical: YES
SRMLQVWGKAGRQERLQTRSQNDSEEPSDKFKNFLFHKAPSVVSIKHSDYTIVLFPIKLS

SEQ ID NO: 5867 - protein, 120 aa, Enterococcus faecium
  misc_feature (B) LOCATION 1...120
  hypothetical: YES
KLFRKVKKLKQPAWNKIDLQAHTYIGWNDPGTQKKFMVYYEDGKLKGISGTLSPTINKGICAICQKTSNVSLFLSTTKAGSDGTYTKKGNYICHDSDQCNQQLTKLAPFYEFAERVKKER

SEQ ID NO: 5868 - protein, 750 aa, Enterococcus faecium
  misc_feature (B) LOCATION 1...750
  hypothetical: YES
VKFRDQARWTPTNQMKAAQKTAFGSFHLFSSVLLSREGKGEVMSEKQVFKTTWGGRPLQIEVGQLAKQANGAVLVRYGDTVVLSAAVASKEAKDTDFFPLTINYEEKMYAAGKIPGGFIKRESRPSTEATLTARLIDRPIRPMFAEGFRNEVQVTNIVMSVKTDCSPAMAAMLGSSLALSISDIPFDGPIAGVEVGRVNGEYVLNPTVEQAEQTDIELTVAGTKQAINMVESGAKEVSEEDMLGALLFGFDAIKELVAFQEEIVQAVGKEKMEVTLLQVDEVLKKEIFDASYATMKAAVMTEEKLAREDNIEQVKIDIREAYAEKFAGHEDEDHLLKEVKQITEDLEKDVVRELITIDKIRPDGRKLDEIRPLSSEVSLLPRVHGSGLFTRGQTQALSACTLAPLGEHQIIDGLGVEVSKRFIHHYNFPQFSVGSTGRAGSPGRREIGHGALGERALAQVIPSEEEFPYTIRLVAEVLESNGSSSQASICAGTLALMDAGVPIKAPVAGIAMGLVSDGENYTILTDIQGLEDHLGDMDFKVAGTKDGITALQMDIKIQGITEQILTEALTQAKQARMEILEELTSTIAAPREELSQYAPKIEMIQIEPAKIKDVIGKGGDTINGIIDETGVKIDIDQDGKVSIASADAEMIKKAIKIIEDLTKEVKVGEVYLGKVVRIEKFGAFVNLIKGKDGLVHISQLANDRVNKVEDVVKLGDEILVKVTEIDKQGRVNLSRKAMLNEDGSTKNEEK

SEQ ID NO: 5869 - protein, 86 aa, Enterococcus faecium
  misc_feature (B) LOCATION 1...86
  hypothetical: YES
RLLRGEKHHHLQHFRPGRFQETAGHLPTIREAGYQADHSELQRTQRRHRPRRRRNGILEGDFLDPDHFLLGYRRRCTNIESVGRAG

SEQ ID NO: 5870 - protein, 75 aa, Enterococcus faecium
  misc_feature (B) LOCATION 1...75
  hypothetical: YES
ITIRPIERKSQAWALLISQLDSKKNEIRSFLKSWKCSKPMIKDVQALVQGLQQRETGALEHSNCSSLSKKKCTAI

SEQ ID NO: 5871 - protein, 385 aa, Enterococcus faecium
  misc_feature (B) LOCATION 1...385
  hypothetical: YES
IRMLKEYRMALHQIPEIGFHEFKTKKYLYEQVKNSEAVIHEIGETGLLLYFDNQQEETIAFRTDIDALPVKEETNLSFASKHEGYMHACGHDGHMAMLLGLTDFITKHIEDLIYNVVLIYQPSEEISGGAQSVIQSGLLDKYEVQAIFGFHLWPGLAKGEVFSRPGPLMAQSSETDIIIKGQSAHIASSEKGIDSLEAAVRFLKNVYDFDRQLPAEWNHLMKFGQIQGGTIRNVLAGEVIVSGSIRSYSSDMQNYLKRGLDHLAEQFHSTATISFRYNDGYPAVINHRGLYAALLDSNKLHELDAPVLQAEDFGIYTQQYPCVFFFLGVGDTPALHDPTFDFDMDVLENGVEWYKTILFTENLLVKIDSSSKEERVNNDEFIQSI

SEQ ID NO: 5872 - protein, 256 aa, Enterococcus faecium
  misc_feature (B) LOCATION 1...256
  hypothetical: YES
ALIRGDRRIMQKMGVNIDELLLSQPDTGEQGLEIADALVSSGAVDIVVVDSVAALVPRAEIDGEMGDSHVGLQARLMSQALRKLSGSINKTKTIAIFINQIREKVGVMFGNPEITPGGRALKFYATIRLEVRRAEQLKQGTDIVGNRTKIKVVKNKVAPPFKIAEVDVMYGLGISQEGELLDMAVEKDIVDKSGAWYSYKEDRIGQGRENAKIYMANHPEMMAEVSALVRAAYGIGEEVAVPEDEKGQEELPLVEE

SEQ ID NO: 5873 - protein, 158 aa, Enterococcus faecium
  misc_feature (B) LOCATION 1...158
  hypothetical: YES
SNVLKAFEQVRQMEERMRELEIFISEGTPDTPAYSSYLKEYDRLQHDFSDRNGYGYENEIRSVLHGFKFDSSFYDQKIDTLSGGQRTRLALARMLLQHPDILILDEPTNHLDIETLSWLENYLQSYTGALLIVSHDRYFLDNVVNEVYELPSSPRNSI

SEQ ID NO: 5874 - protein, 70 aa, Enterococcus faecium
  misc_feature (B) LOCATION 1...70
  hypothetical: YES
ACVLGQCFGNHARFDSLPATLNAYDGYDYRKKIVKKLYGATYGNVVSVLSVHHQASVTVAEVEDAAVNGE

SEQ ID NO: 5875 - protein, 206 aa, Enterococcus faecium
  misc_feature (B) LOCATION 1...206
  hypothetical: YES
KQYRTYGRMLVRRTSVMTEFDQNQENNQSMEDAMKSVQEVKVGDVVKGEVLVIEDKQVIVGIEGAGVEGVVPAKELSTLPVEDISEVVKVGDVLDLVVISTIGKDKENGSYLLSKRRLDAKKVWEDIERDFQEGKVIEAPVTNVVKGGLVVDVGVRGFVPASMVEDHFVADFSDYKGKTLSFKIIEIEPSENRLILSHKAVVENER

SEQ ID NO: 5876 - protein, 241 aa, Enterococcus faecium
  misc_feature (B) LOCATION 1...241
  hypothetical: YES
IRHRFSVVKNKGEEEHMIADNLQKIKQEIQDSCALVHRDPKEVTLVAVTKSVESAQAEELVRAGVMNCAENRVDKLLEKKQDLFDFPEIKWHLIGNLQRRKVKLIVNEIDYFHALDSLRLAEEIQKRLEKELSCFIEVNVSGEESKHGISPDELLPFVESLAACTKIKVVGLMTMAPKEASDEQIHKVFGTLKELRDLVQAKGYAHAPCSELSMGMSQDFQIAIEEGATFIRVGTALFKDE

SEQ ID NO: 5877 - protein, 221 aa, Enterococcus faecium
  misc_feature (B) LOCATION 1...221
  hypothetical: YES
RRNRGGLIMKKRLFMPMSLQFFSEPGDGGSGDEGQQGNLPAGSQETPPEAKEENTTGKTFSRDEVAKMIAAETKKAVTAAEEKWRAEKDEAAKLAEMDDKEKADYEKQQLEAKLAEFERKEVLSKMSEQASEMLSEKGATPTKEMLRLIVSEDAETTSNNVKTYLASVEAEREAIKAEYEKRLGGKVPLDGNGATISRGAQLAKNANNQTKKPENDPWAIK

SEQ ID NO: 5878 - protein, 134 aa, Enterococcus faecium
  misc_feature (B) LOCATION 1...134
  hypothetical: YES
LIDRWATSKIKIRFYSEDSEGSYYLQMTGRDIFDFAVRDVANNIQEVMKDKPVDYLLLHQANLRIIEKIARKVKMPQEKFLTNMDKYGNTSAASIPILLDEAVSSGKITLGKQQKVIFTGYGGGLTWGSILMEL

SEQ ID NO: 5879 - protein, 91 aa, Enterococcus faecium
  misc_feature (B) LOCATION 1...91
  hypothetical: YES
RYCRNLFYCMGIKKDYHHQGLGTKLFKEAEGYAAKHYKYLQVKTVDEGHYSIYDQTICFYESLGFSRLEVFPNLWDEWNPCLVLVKKLEQK

SEQ ID NO: 5880 - protein, 93 aa, Enterococcus faecium
  misc_feature (B) LOCATION 1...93
  hypothetical: YES
LCCRQFFGQHPEKVPDAHRRLQNRPRRKVHLFHRIVDCLDNGGAGVVGVENRALCRLVLPRGEQFFQFGVFLCPFWVVWLKGVGNAAPAHITG

SEQ ID NO: 5881 - protein, 78 aa, Enterococcus faecium
  misc_feature (B) LOCATION 1...78
  hypothetical: YES
IERRPTWRVTPSPVERGREKKKKFXSSPPPPKFSQKKKKGGEFKKTPTPNPKVWGPPTVVVFSEILGVAQKGRECEIF

SEQ ID NO: 5882 - protein, 64 aa, Enterococcus faecium
  misc_feature (B) LOCATION 1...64
  hypothetical: YES
QGSRIGRCGWITSFLRNITETTQFVFTLFSFERFTLNLKRGLSSAGRAPALHAGGQRFDPARLH

SEQ ID NO: 5883 - protein, 578 aa, Enterococcus faecium
  misc_feature (B) LOCATION 1...578
  hypothetical: YES
VESRFFVYLKLTLRGTNIRIKLCMFFVHIYAKMHIDEFRIIYHRSCIDDKNEKDSMEVDFMVFNILLAIIGLIVGLGLGFMVAKSRHEKEIAGAQSSAAGIIDSAKKEAETLKKEALLEAKEENQKYRSEVESELRESKLELKSQENRLIQREQTLNRKDDSLEKRENSLESKEEALSSKQQLIEEREKDVEKMIEDQQKELEKIAGLSKEDARDVIMKSTEEELNHELTLMVKESEQRAKEEADRKAKNLLSLAIQRCAADQVSETTVSVVTLPNDEMKGRIIGREGRNIRTLETLTGIDLIIDDTPEAVVLSGFDPIRREIARMTLEKLIQDGRIHPARIEEMVEKSRKEMDERIREYGEEAAFEVGAHTLHPDLIKIIGRLRFRTSYGQNVLKHSVEVAKLAGILAAELGEDIQLAKRAGLLHDIGKALDHEIEGSHVEIGAELAAKYKENPVVINAIASHHGDVEATSVISVLVAAADALSAARPGARSESLENYIRRLRSLENISNSFAGVESSYAVQAGREVRVMVKPEEISDLDAVRLVRDIRKRIEEELDYPGHIKVIVIRETRATDYAK

SEQ ID NO: 5884 - protein, 125 aa, Enterococcus faecium
  misc_feature (B) LOCATION 1...125
  hypothetical: YES
LRSRGSQPDVKKFQLHVQHACKLLSGFEPIFEDGRLELTNNRAERNIKELVIGRKNWLHSTSLEGARTSGIILSVYKTAELNGLNPVKYLEFLFDKIPNLPVLSAETLDQLLPWNKDVQQHFSRN

SEQ ID NO: 5885 - protein, 135 aa, Enterococcus faecium
  misc_feature (B) LOCATION 1...135
  hypothetical: YES
NLLRRRETNVSYRKLGRTSSQRKAMLRDLTTDLLINERIVTTEARAKEVRSTAEKMITLGKRGDLHARRQAAAFVRNEVASVREENEDIVIESALQKLFNDIAPRYAERQGGYTRILKTEPRRGDGAPMVVLELV

SEQ ID NO: 5886 - protein, 244 aa, Enterococcus faecium
  misc_feature (B) LOCATION 1...244
  hypothetical: YES
TYLRLQQSLYVVGNEQSYHFKQLKAVLKEMGFDWSDDMHHIPFGLITQGGKKLSTRKGKIVLLEEVLNEAIQSAKEQISEKNPDLENKDAVAKQVGVGAVIFHDLKNDRLNTFDFNLEEVVRFEGETGPYVQYTHARAVSLLEKAGFVPSETADYALNDDTSWEVVKLVQKYPETVLSAGEKYEPSVIAKHAIKLAQAFNKYYAHTKILADDEQKEARLALVYAVTVLLKEDLRLLGLHAPDKM

SEQ ID NO: 5887 - protein, 271 aa, Enterococcus faecium
  misc_feature (B) LOCATION 1...271
  hypothetical: YES
ENLRISGTKPQGERTTPVDLDKQESFSVLLMGIDTGDLGRVDQGRSDTMMVATVSPEDKQTTIVSIPRDTYVDIVGHDTKDKINHAYAFGGAAMAMDTVQKYVDIPIDHYVSINMKGLKELVDAVGGIEVNNDLTFSQDGYDFTIGKITLNGDQALSYSRMRYEDPNGDYGRQERQRKIVEGVAKKVLSLNGVSNYQSVLNALESNMKTDMSFDEMKKIALDYRDAFGTIKQDQLQGEGFMQDNISYQKVSDQELDRVKKELKDQMNLENK

SEQ ID NO: 5888 - protein, 100 aa, Enterococcus faecium
  misc_feature (B) LOCATION 1...100
  hypothetical: YES
NHSLVKTGTRHATELNRGMALISRMSKAKIVPAVYQGPLTLGDLFKRQRVTVRFGEPIDLSDIKKTDKEGMAEIERRTQAAFDKLDKEVNPDFKYEVKKK

SEQ ID NO: 5889 - protein, 193 aa, Enterococcus faecium
  misc_feature (B) LOCATION 1...193
  hypothetical: YES
LPLRHSNATLEEAQKAVEAGASVFVHAFNGMRGLNHREPGMVGALLSLEHVFSELICDGHHVHPNAAGILMEKAGHDHVALITDCMMAGGMPDGNYNLREFPVVVKEGTARLESGNLAGSILKLKEAIKNVVDWGLATPEQAVMMASLIPAISCKIDDTCGKIAQGRDADFIVLNPDMTLEATYLDGVERFHA

SEQ ID NO: 5890 - protein, 104 aa, Enterococcus faecium
  misc_feature (B) LOCATION 1...104
  hypothetical: YES
IGIRMIFQRIPRFIMSCKVNDRRFFISFFILTFIFFIWCWMTFKNQRSLHVPFWMKLFPIFIKYSIQSILVVIDDSIAIFTEVMDSFFCNFFFIPLINVNHHHS

SEQ ID NO: 5891 - protein, 74 aa, Enterococcus faecium
  misc_feature (B) LOCATION 1...74
  hypothetical: YES
LQIRQLAKIAIHLQALKFERIILVVESTTTKGLNQLIDRITNGKIEKVVILYKSCLIRFGYELSETLCNIWYRI

SEQ ID NO: 5892 - protein, 79 aa, Enterococcus faecium
  misc_feature (B) LOCATION 1...79
  hypothetical: YES
GRIRVEIGDFAKADTLVVKARSCIAEAHNSQTAMLAREASGEELPYSVTMMHGQDHLMTTVLLKDVIHHLIELYKRGAK

SEQ ID NO: 5893 - protein, 63 aa, Enterococcus faecium
  misc_feature (B) LOCATION 1...63
  hypothetical: YES
FKIRKLMPSTTLGVTVKNDEWYKIERTIQSDYYQPFKREIPSVVVTNAEKVSAPKNQYVYRSF

SEQ ID NO: 5894 - protein, 77 aa, Enterococcus faecium
  misc_feature (B) LOCATION 1...77
  hypothetical: YES
KEIRITDFFEEKKWSELNVRDIGSFRNCLLNDNGYLQPYCSLLHEIFHEIFRKTFDYVVTFPFLTKNVSKTNKGVKR

SEQ ID NO: 5895 - protein, 79 aa, Enterococcus faecium
  misc_feature (B) LOCATION 1...79
  hypothetical: YES
QFVRRFSCVIFLSIHWIYFSMISTTALPQVSSFSSSFFIFMAHGLEKGAASFHEPSKGYSLLIPFTYCLFLTPFVFTST

SEQ ID NO: 5896 - protein, 483 aa, Enterococcus faecium
  misc_feature (B) LOCATION 1...483
  hypothetical: YES
NTVRYAPSPTGHLHIGNARTALFNYLFARHNDGDFIIRIEDTDQKRNIEDGEKSQLENLAWLGMNWDESPENPGEYGPYRQSERKEIYQPLIDQLLASNRAYKCYCTEEELEAEREAQRARGEMPHYAGTCANLTPEEQAEKEAQGLESVVRFRVPRNTEYAFTDMVKGAISFESDNIGGDFVIQKRDGMPTYNFAVAVDDHLMKITHVLRGDDHIANTPKQLMIYEAFGWTPPTFGHMTLIINSETGKKLSKRDESILQFIEQYRELGYLPDAMFNFIALLGWSPVGEDEIFEHQELIKMFDPKRLSKSPAAFDAKKLQWVNNHYIKAMDLDAFTDMCLPYLIADGRVAENPDEKTIEWVKKIVSLYQPQMSYAAEIVDLSTLFFNEHPVLNEAAKEVLAGETVPTVLHAFKAQLEQMEVVDAPTVKAAIKAVQKETGVKGKNLFMPIRVAVSGQMHGPELPETIELLGREKSLAHLNQVLN

SEQ ID NO: 5897 - protein, 130 aa, Enterococcus faecium
  misc_feature (B) LOCATION 1...130
  hypothetical: YES
KDVRERKHLAVPSDKAQWLRALTLFFVTLTLCVVAIMILSVTETIPKTSGIEYIAFEVFSAFGTGRSYHGIDARLDCNREIDHYSAYVHWTSWCIDCGLLSDDKSTKNTIKIQISTRKCHDWIISSSDKT

SEQ ID NO: 5898 - protein, 272 aa, Enterococcus faecium
  misc_feature (B) LOCATION 1...272
  hypothetical: YES
VKVRRSERLVDMTQYLLNHPHELISLTSFAERYESAKSSISEDLGIIKKTFKERGYGTLETIPGAAGGVLFIPEISYEEAKKYIESLAERLSEQDRLLPGGYVYLSDLLGEPELLRQVGRIIASKYLGEKIDAVMTVATKGVPIAQAVSYYLNAPFVIVRRDSKITEGSTVSVNYVSGSSERIEKMELSKRSLKRGSRVLVVDDFMKGGGTVNGMKSLIEEFESELVGITVFAESKFNGHRAIDDYTSLLYVKDVDTQTKNITVVPGNYFSE

SEQ ID NO: 5899 - protein, 269 aa, Enterococcus faecium
  misc_feature (B) LOCATION 1...269
  hypothetical: YES
RVSLVVDDVSVLSLEVDESELSLVVEDVSVLSLEADVSVLSLVVVDESELSLVVEVVSVLSLEADVSVLSLVVVDVSVLSLEADVSVLSLVVEVVSVLSLEADVSVLSLVVEVVSVLSLEADVSVLSLVVEVVSVLSLEADVSVLSLVVEVVSVLSLEADVSVLSLVVEVVSVLSLEADVSVLSLVVEVVSVLSLEADVSVLSLVVEVVSVLSLEVDESELSLVVDVSVLSLVSVVSVPLSLINISLGSQRLVAASKITFVPIIVPSWF

SEQ ID NO: 5900 - protein, 146 aa, Enterococcus faecium
  misc_feature (B) LOCATION 1...146
  hypothetical: YES
SIPRETKSGCFSTLFRLLPAFLFCSLVGMIGTKSSSLFTFPVLLSLLVLPVLLSLLMLPVLLSLLVLSVLLSLLVLPVLLSLLVLSVLLSLLVFSVLLSLLVLSVLLSPLVFSVLLSLLVLSVLLGGPTTVQLLGFKFSVIVICPS

SEQ ID NO: 5901 - protein, 180 aa, Enterococcus faecium
  misc_feature (B) LOCATION 1...180
  hypothetical: YES
LAPRVGLIYKIIEDDKQTELNMCYFDREQDFFYYGGMGGGSIVPKINLVELDVNNYRELYVFNSLDFEIPMKQMKNIDIHILPSESCQIEYSIEYFYKGKKIKKCDKCFESAVVKFPQFKLNPAASIQFQGHVFDVLAKDNIKKYKKGNIFHIDIQISSNLEDIKKAFKIKTIGTAPNFK

SEQ ID NO: 5902 - protein, 204 aa, Enterococcus faecium
  misc_feature (B) LOCATION 1...204
  hypothetical: YES
SLPRPIMEKSRNSPEIMKILCRLLWLSIGKHFVLNISCGLEETGESQALWIAHKMDMSMKLIHQAERYLAEKAYRTQKKEFLPKTAVTNRKENKKERQLFAKGDRIFVNEYQKEALVYEDIGEDTIDVYLDKKIIHVPRQRVRLVRSAEDLYPTGYDLDSLFIDYKTRKRQRDLERGSKKAHKVLVKEMRKRQEERRVNDENSK

SEQ ID NO: 5903 - protein, 189 aa, Enterococcus faecium
  misc_feature (B) LOCATION 1...189
  hypothetical: YES
RRTRLETKAMLKKFKAYARSLFQDKMIYTEKTIEQIDRRYILRELTIEDIKELLDVEREVYNGELPWTKSAFMSELKSPLPHLYLGIFDNGRMIGFVGSRAFGLDCHITNIAVRPAYQRKRIGSLLIDEIENFAIMNRCETMSLEVRMSNQDAQRLYRKLGFQATTIKKRYYTETKEDALDMIKILENE

SEQ ID NO: 5904 - protein, 73 aa, Enterococcus faecium
  misc_feature (B) LOCATION 1...73
  hypothetical: YES
VDARSKGIDSRFSEDVKIVNKDLNKITFDNLKKKQDFLDGQNSIRYNIYRTVLFFEIYFNNNYGYFLSSEGGN

SEQ ID NO: 5905 - protein, 547 aa, Enterococcus faecium
  misc_feature (B) LOCATION 1...547
  hypothetical: YES
YDQRRKGDVFMKVVVIGGVAGGPSFATRFRRLNEAHEIIIYERGENISYASCALPYYLGGVITDRDSLIERTPEILKTKNNIDVFTKHEVTAIDPSTKRLTVKDLSTNEEIKTDYDKLIISSGARPDYPDIPGVFEAENGFVLRSVTDADRIKSFLEEKNPQHVVILGAGVMGLELAENFKHRGLDVTLIDQLPQVAFPYDPEIANLVYDKLLKEGLAVHLETRVTEIRDKGREIVLSDGSVLSADMLIFAVGVSPKNEVVKATGIQLSDTGQIIVDDQLQTNLPDIYAIGDIIETTSVVTGQPIQSMLSSAANRQGHMLADILNGTPMRYRGYIGAGVAKIFDHTASYAGMTEHELKASGITNYKTVFITPFDHAYFYPEATRLNLKLIFDADSGRILGGQAFGEKGVDKRMGELSVAITGNLTVFDLPDLELPYSPPYSTTRDPLNIAGYVAINQMTNIVETIKASDIPENDLKEAFFLDIREPNKAPSGSISATKNIPMNELRDRINEIPKDKKVYITFRRGLNTYTSARILAGLGIKAILIEE

SEQ ID NO: 5906 - protein, 356 aa, Enterococcus faecium
  misc_feature (B) LOCATION 1...356
  hypothetical: YES
IKQRESRGSTMTDFNFFKADRVYNELFYQFPKVFIVSDEYKKMKDSTKIAYMLLKARLEIAISKRQIDEEGNVYFTYTTNELCSVLNCQKQKAIAIKKELESFGLLLQKQMGFNKQLGKNNPNRLYLAELKVSENDIYLLEKFDRENRENVDKSEGMKIIPTLDEKSDAESLGAQEGMKIIPCQNVDKSEGMKIIPELNNNILDTNRHNIDTEKDRLQDQLLLDNFETIMTNDSIATFVPERVLNLIKTFSSSYSEAQKTVQTIHNAKKKAEIESGISIVFEELDSYYVNAEQELYTTLLKAYQKLKTEKVENIQNLIFVYVKNWFIEKPIAAKVSSEKRLNSESSPSTITKDWLE

SEQ ID NO: 5907 - protein, 88 aa, Enterococcus faecium
  misc_feature (B) LOCATION 1...88
  hypothetical: YES
LLQRNHICNIGGKNVGKPIISFDQVVKRYDDETVLKKVSFEIEQGKFYTLLGPSGCGKTTILRIIAGFTEATEWDIYFEGKRLNDLPS

SEQ ID NO: 5908 - protein, 61 aa, Enterococcus faecium
  misc_feature (B) LOCATION 1...61
  hypothetical: YES
VPQRAQPLLLVAIIQLGTLARLPVTNRRKVGMTSNHHAPYDLGYTRATMGSTTSCEVARLS

SEQ ID NO: 5909 - protein, 61 aa, Enterococcus faecium
  misc_feature (B) LOCATION 1...61
  hypothetical: YES
VPQRAQPLLLVAIIQLGTLARLPVTNRRKVGMTSNHHAPYDLGYTRATMGSTTSREVARLS

SEQ ID NO: 5910 - protein, 60 aa, Enterococcus faecium
  misc_feature (B) LOCATION 1...60
  hypothetical: YES
HFKRMIEVISSSHSFFCVTKLVFSRHILTYTKSRDNTLTERRKRTTDSFSPKKSKLFRYE

SEQ ID NO: 5911 - protein, 60 aa, Enterococcus faecium; identical to SEQ ID NO: 5910
  misc_feature (B) LOCATION 1...60
  hypothetical: YES

SEQ ID NO: 5912 - protein, 68 aa, Enterococcus faecium
  misc_feature (B) LOCATION 1...68
  hypothetical: YES
LNKRQNMRNYFSVFFSNTQVRTLISQPLDKRCSKASFSVVSQIYAKMWKAIFTKFFLLLETKQLFHNL

SEQ ID NO: 5913 - protein, 89 aa, Enterococcus faecium
  misc_feature (B) LOCATION 1...89
  hypothetical: YES
LSKRQNMRNYFDVCFSNTQVKTLILRPLFLKRCSPANSSVTSHNIIKHEKQFFEIAPCDSELNGRLTTSFLNGVQKLASAVIRPIKRKI

SEQ ID NO: 5914 - protein, 79 aa, Enterococcus faecium
  misc_feature (B) LOCATION 1...79
  hypothetical: YES
CSKRTTQSIDKRKCSHLDSNSCCICAGNRLLSKSACRNTCFNWSWSTSIVAFDCDFYHSSHHYSVCLRYFRRKTKYFYR

SEQ ID NO: 5915 - protein, 60 aa, Enterococcus faecium
  misc_feature (B) LOCATION 1...60
  hypothetical: YES
LKKRQNMRNYFDVCFSNTQVKTLISQPLFRSSSTTVFTRRSLALCPNELGSSRYVFLWLF

SEQ ID NO: 5916 - protein, 63 aa, Enterococcus faecium
  misc_feature (B) LOCATION 1...63
  hypothetical: YES
LKKRQNIRNYFFVFFSNTQARTLISQPLYFTFNIHMNPTNTKNRPYMIGDTSFPLLAANMVIG

SEQ ID NO: 5917 - protein, 315 aa, Enterococcus faecium
  misc_feature (B) LOCATION 1...315
  hypothetical: YES
MKKRKGFNHFFMNLWRYKALVLMAVPGMLWMIFFFYIPVMANVVAFKNFHISADGFLASLRESPWVGWENFKFLFSSDQAFLITKNTILYNVAFILLNLLISVVFAIIMSELRNKRLVKVYQTMSLLPYFLSWVIISYFVYAFLSPDKGIFNQWITGHGGEAVNWYNEPKYWPFILVFIGTWKGIGYNSIIYFASVMGIDPTYYEAAMVDGASKWQQIKHVTIPQLIPLMTILTILAVGNIFRADFGLFYNIPRNSGALYDVTQVLDTYIYNGLTSTGDFGMTAAAGLYQSVVGFVLLMITNTIARRFDSDSALF

SEQ ID NO: 5918 - protein, 306 aa, Enterococcus faecium
  misc_feature (B) LOCATION 1...306
  hypothetical: YES
RMKRILKMTMVLFSLLILASCSFPGLASNTDEDTISITGGITSEAQILASLVAGMVEHYTDKNTAIINNLATTTINHQAMMNGDASISAARYTGTDLTTTLNLPPEKDPKKAFATVKDEFEKRYGQTWFPSYGFENTYVFLVRKDTAQKYHLSKVSDLKNVADELVAGVDTSWINRKGDGYDGFQETYGFSFNSILPMQIGLVYDAVEAGKMDIVLGYSTDGRIASYDLVMLEDDRQFFPPYDAAPVVDNKILADTPHLKEALNKLGHTISTEKMQELNYEADNNLVEPSVVAQRFLQENHYFEGK

SEQ ID NO: 5919 - protein, 218 aa, Enterococcus faecium
  misc_feature (B) LOCATION 1...218
  hypothetical: YES
QQKRKRLIIMEQKNDFSTIMTGRRSVRVYDETYKIPHEEMLEMIKEATTAPSSVNMQPWRFVVAESEEAKEILRPLIRFNTRQNDTSSAMVMIFGDMQCYEYGEEIYNQAYESGKMPKEVRDQQLAAIIPYYKSFSREEMNDVVKVDSSLAAMQFMLVARDHGYETNPIGGFEADQLAEAFGLDKDRYVPVIILSIGKAVEEGYESVRLAPEKITTFE

SEQ ID NO: 5920 - protein, 370 aa, Enterococcus faecium
  misc_feature (B) LOCATION 1...370
  hypothetical: YES
ITERFRIQEDNLLKITLLYGGRSAEHEVSILSAFSVLNAIYYNYYQVQLVFITKEGQWVKGPLLTEKPASKDVLHLSWDPSGQTEEGFTGKVINPGEIKEEGAIVFPVLHGPNGEDGTIQGFLETLNMPYVGAGVLTSACAMDKIMTKYILQAAGVPQVPYVPVLKNQWKENPKKVFDQCEGSLLYPMFVKPANMGSSVGITKAENREELQNALATAYQYDSRAIVEQGIEAREIEVAVLGNEDVRTTLPGEVVKDVAFYDYEAKYINNKIEMQIPAEVPEEVYQKAQEYAKLAYTMLGGSGLSRCDFFLTNKNELFLNELNSMPGFTEFSMYPLLWENMGLKYGDLIEELIQLGMNRYHQRQSFFEKNE

SEQ ID NO: 5921 - protein, 108 aa, Enterococcus faecium
  misc_feature (B) LOCATION 1...108
  hypothetical: YES
KCEREIIIVGMQIGVLKWLQFTKQKGVHFPMQFLEPKNKNAKSVDWEISEQVRVIVKQYAEYAERTESEAVDEFLLNILDDKKFIEWIANKRSNKRIVEKMGIKDRVG

SEQ ID NO: 5922 - protein, 68 aa, Enterococcus faecium
  misc_feature (B) LOCATION 1...68
  hypothetical: YES
WTERFNIIGFNCYSPIFIKFPDRHSNHAPTVVWNRFSVPNNINAGLNGSGNKHREQSPTTPNASERSG

SEQ ID NO: 5923 - protein, 249 aa, Enterococcus faecium
  misc_feature (B) LOCATION 1...249
  hypothetical: YES
DEERTAIVIQDLSAAYQGKTVLKTINLTINPQKITGIIGPNGAGKSTFMKSLLELIPATTGKVTFSGQSVNSVRKKIAYVEQRSELDLSFPIDVLGVVLLGTYPSLRIGQRPGKKEKERARQALKKVGMEEYAKRQISELSGGQLQRVFIARALAQGAEWIFLDEPFVGIDALSERKIFDILQELKNSGKTILIVHHDLHKVEEYFDEVILLNKQLIASGPVQEVFTSKNLQLAYGEIIRHLVKGGEKK

SEQ ID NO: 5924 - protein, 62 aa, Enterococcus faecium
  misc_feature (B) LOCATION 1...62
  hypothetical: YES
KRERMFAYSFFLSYNNTRREIISLFKQTKNLDITSFQAIRILFAYIFLYKFSCFKFNCLLCL

SEQ ID NO: 5925 - protein, 200 aa, Enterococcus faecium
  misc_feature (B) LOCATION 1...200
  hypothetical: YES
IWPLNKESLQMKVTDTKLTDVKIVEMDVFGDHRGFFTESYSKAKFAEHGLKYDFVQDNHSLSAEAGVLRGLHFQKGEAAQTKLIRVVTGAVLDVVVDIRKGSPTYGQWDGFILSEHNHRQLLVPKGYAHGFVTLTPNVNFLYKCDNYYNAEADGGIAFDDPDLAIDWPIDPSRAIMSEKDHRHPTLKEFEAENPFVYGEI

SEQ ID NO: 5926 - protein, 155 aa, Enterococcus faecium
  misc_feature (B) LOCATION 1...155
  hypothetical: YES
KQRRLGYSLFLLSCFALALGFEAVSEDILSGILFEPFVHSFLSHLFIILTSAFIIWYYWSRMFYYKKWYGIFCTFQLLIFIGVLLYATFTPAELPELMPIANIASVISTLVTSLACIGEAYKNNRFYVACTPWIVLVAIIHCLIYIQTALGIYQT

SEQ ID NO: 5927 - protein, 74 aa, Enterococcus faecium
  misc_feature (B) LOCATION 1...74
  hypothetical: YES
EAIFVWLFLLLDAGQLFHNLFFYLCFIINMVRMQLRMVDRLRIFNHFPNLRRRFPYPFDADLCVCFQNSLFFFC

SEQ ID NO: 5928 - protein, 83 aa, Enterococcus faecium
  misc_feature (B) LOCATION 1...83
  hypothetical: YES
PAGRSDPVPAGNGRTGTEAGKPAEVSECRPGNRPAPDHEAENRLLPDRLKLCAGCHEGGRNVRRPGKTELCPDFPAERRGVLK

SEQ ID NO: 5929 - protein, 63 aa, Enterococcus faecium
  misc_feature (B) LOCATION 1...63
  hypothetical: YES
QYLRLDLPQRLTRSRKKSVLKSDYVPLSIAASSIVYFSHFPIPNLYTFVSYPNVILFILIFPL

SEQ ID NO: 5930 - protein, 312 aa, Enterococcus faecium
  misc_feature (B) LOCATION 1...312
  hypothetical: YES
SRTLAALMKCFSHIRREEPMMIYGAIEAGGTKFVCAVGTEELTILERVSFPTTTPVETMKQVIDFFKPFKEQLAGIGVGCFGPIDIQCKSTSFGHITSTPKLAWQNFNFVGTLKQYFNIPIEWTTDVNAACYGEYVAGSGKGLAGVAYFTVGTGIGGGALFNGTFVEGFSHPEMGHMLIKRHPKDNFSGNCPFHQDCLEGMAAGPAIEKRLGVKGQNLLADDSFWQIEAFYLAQCAYNTTLMFSPDRIIFGGGVMKQEHMKKKVQDKFVELINGYVEIPPIDSYIITPELGDNAGIIGGLALARKAVRNKQP

SEQ ID NO: 5931 - protein, 199 aa, Enterococcus faecium
  misc_feature (B) LOCATION 1...199
  hypothetical: YES
KRMRKMEQLAQRKKKIVIGVSGASGTIYAINLVKKLKEYPMIETHGIISPWAKQNLKLESDLSLTEFESLFDYHYSNKDLGAAVASGSFLTDGMIIVPASMKTVAGISVGLGDNLIARAADVTMKEQRKLVIVPRETPLNAIHLENLTKLARLGVQIIPPIPAFYNQPQTIQDLVNHHTMKLLDQFEIVNEHSKRWQGD

SEQ ID NO: 5932 - protein, 387 aa, Enterococcus faecium
  misc_feature (B) LOCATION 1...387
  hypothetical: YES
RRMRMKSCGIIVEYNPFHNGHRYHVEMARKITGAEVVIAVMSGNFLQRGEPAIIDKWHRANEALQNGVDLVVELPVEWAVQSADYFAKGAVKILQTLDCDSLCFGTEEETSFDYSSFGRFVQENQDRIEEAFQELSDQTYSYPQKMTEVFRSLYPDITLDFSSPNHILGLSYAKENAKYVHPMELHPIRRKSAGYHEKIITDQRIASATAIRHALEEGKRIAGLVPPQTEEDLSTCSLQTWESYWPYLRYRLLSSTLLELTDIYQMTEGIESRMKTAAATADSFEDFVSKVKTKRYTWTRIQRLSCYVLLNIKKQEIPVQQNKNYLRLLGFTDAGRRFLKEKKEISIYSRIGKKEAQEAELLVRSDQIYQLGGNIPEQNFGQIPIRV

SEQ ID NO: 5933 - protein, 126 aa, Enterococcus faecium
  misc_feature (B) LOCATION 1...126
  hypothetical: YES
HFVRNGASSFVDLSGKICIDFEIRGETCYNQSERRSGIFMDHVVLEIDLHLINNIRVIYYVVSNSVEQRVLTNKINGILAKKDVHRFNNGEGSYYSIPVEKIIYTTVKVREDLDTKKAYEPIFTTY

SEQ ID NO: 5934 - protein, 145 aa, Enterococcus faecium
  misc_feature (B) LOCATION 1...145
  hypothetical: YES
SLVRIIHQLIKENHILLFCPSITMMHRLKATLQEALPRYEITDVSSRDNQRAEKVQKMREAKYDILLTTMILERGVTFERISVIVLGADHPVFTKSSLVQIAGRADRKGPYTNSQVYFFYEEKTAAIRKACQEIKEMNEEGKKML

SEQ ID NO: 5935 - protein, 183 aa, Enterococcus faecium
  misc_feature (B) LOCATION 1...183
  hypothetical: YES
SCSRKWTRILEEGGIPFMVYIDPKHLELEDRVVAINRVTKVVKGGRRLRFAALVVVGDKNGHVGFGTGKAQEVPEAIRKAIEDAKKNLVEVPMVGSTIPHEVIGAFSGGRILMKPAVEGSGVAAGGPVRAVLELAGVADITSKSLGSNTPINVVRATVEGLKQLKRAEEVAELRGKSVEELIG

SEQ ID NO: 5936 - protein, 469 aa, Enterococcus faecium
  misc_feature (B) LOCATION 1...469
  hypothetical: YES
RETRLRIAFLRFSSIIASFSSIGSITVFFTEATKPATAAAVAKLPTNIPDTNFFIESTSFIICYIYYGTKEKKRLVLRLFVNLCKKSLKMFTKCFIINLPDKFTKFYFLLFHHKSRLRFFNYFNYIESTNTISLIKGVFFMTILVLGGAGYIGSHAVDQLVQKGYQVAVVDNLLTGHKQAVHPDAHFYEGDIRDKEFLRSVFEKEPIEGVIHFAASSLVGESVEKPLMYFNNNVYGMQILLEVMHEFNVNKIVFSSTAATYGEPKESPITENTPTNPKNPYGESKLMMEKMMKWCDQAYGMRYVALRYFNVAGAKADASIGEDHTPETHLVPIILQVALGQRKALAVYGDDYDTPDGTCIRDYVQVEDLIAAHILALEYLKEGNESNFFNLGSNKGYSVKEMLEAAREVTGKEIPAEIAPRRAGDPSRLVASSEKAREILGWKPEYTDIKAIIKTAWDWHVSHPNGYEE

SEQ ID NO: 5937 - protein, 97 aa, Enterococcus faecium
  misc_feature (B) LOCATION 1...97
  hypothetical: YES
VSARMHQNDGQAGQNHFRNTGACQPERWENRTHSRTAGHRAHGCRAATRFSNLGRGKQPAVRHRYSSRTNCPVRSEADPKGAIQCHIECGSEHAPGR

SEQ ID NO: 5938 - protein, 127 aa, Enterococcus faecium
  misc_feature (B) LOCATION 1...127
  hypothetical: YES
MVALSKLYTFERRKYVSPFRSAALEEESDPRINDVVLSTGNINQKYIVRDIVFVVECLEADLFDPSFPKDDLFLTTKRKLKTKVLEYGANAVINCHFEYQQKKRDGKYFLELFAYGTVIQFIQTTIG

SEQ ID NO: 5939 - protein, 436 aa, Enterococcus faecium
  misc_feature (B) LOCATION 1...436
  hypothetical: YES
KSKRAINCEKEHINMVYQLAEGVNLHVLPTKQYKTIRIFIRFTARLQQEVITKRSLLSSMLETNSLNYPDQTKLSAQLAELYGASFGLSVRKKGNLHWLNAGISFVNGEYVNDPNLFSQAVDFLKEVLFYPNIKNHQFDQLTFDLEKNNLRLYLESLKEDKQTFASYALQELYFENSPEQKIPGLGVVEDLDKITASSLASYYQEMMANDQIDIFVVGDVDPDKAAEAVGQLPFESRETVYPDLFYTQPQVNIVKERQVREPIVQAKLNLAYQTNVYYDEPERFALMVFNGLFGGFPHSKLFMNVREKESLAYYASSSVDTFRGFMSVQTGIDEKNRNQVLHLIHEQLESLRNGEITELELSQTKAMLRNQYLLSLDSPQAAIEASFLDSWLPETKLSDEEWLKRMESVTIKEIQQVAEQIELQAIFFLAGGNANE

SEQ ID NO: 5940 - protein, 63 aa, Enterococcus faecium
  misc_feature (B) LOCATION 1...63
  hypothetical: YES
GGKRMGKFNRALVFSAPLIIYALGLWGSRQALIGTIVYMVWIFMGLDEAEAEYRAKKPTEGAD

SEQ ID NO: 5941 - protein, 473 aa, Enterococcus faecium
  misc_feature (B) LOCATION 1...473
  hypothetical: YES
ERKRYRMLINELKKYFGFDSFRPGQEEIIQALLDGEDTLAILPTGTGKSLCYQLTGYLMEGLVIIVSPLLSLMEDQVTQLQKRGEKRVAAFNSLLSQSERRYVLRHLSQYKFLFLSPEMLTNPSLLEHLKKQNIALYVVDEAHCVSQWGVDFRPEYQQLGKIRKLLGNPVTLALTATATDLVARDIRHVLFDRPPKEIRQSVNRQNISLFVRKTQQKEQELEHFMERAQGAAIIYCATKKEVERLYHLFRERFTVGYYHGGLDAAQRRQLQQQFVKNQLQFLIATNAFGMGIDKSDIRYVVHYDLPDSLENYVQEIGRAGRDQEESAAILFYQSGDERIHYFFNQLSREQRQSFELYLEYATEQAPFDELQKKWMELIQQSEKPENWVERLKRQEKEKEFRLQQMLRYINEENCRRKFILAYFGEKLSEKPQNCCDIDGAKAELLPKRKLFSKTEQLHWETILLNLFKKNMEH

SEQ ID NO: 5942 - protein, 86 aa, Enterococcus faecium
  misc_feature (B) LOCATION 1...86
  hypothetical: YES
RHIFHIEYTDTAKRMMKKANKVSTTDGMEIKNGLVRSISIIRTKIIEKSLEKIIPSNIPEIQANNPIIMISNTYIPDICSLFIPKS

SEQ ID NO: 5943 - protein, 315 aa, Enterococcus faecium
  misc_feature (B) LOCATION 1...315
  hypothetical: YES
KRRRCRRRNWFGEKGGCKMKKILITGANSYIGTSFKKWMTQFQDEYQIDTLSVRGDAWREHDFSGYDTVFHVAGIAHADVSKVSEETKQLYYAVNRDLAIETAKKYKQDLSGKNGQFIYMSSIIIYGEETNINKKRVITPDTKPNPSNFYGDSKLQAEIGLQPLDDDTFHVAILRPPMIYGPGSKGNFPELVKLADKLPVFPAIKNQRSMLFIENLCMYLKEIIDEEKNGIFFPQNNEYVRTSDIIQTIAKYKKKKTVILPYFNYFVKLLGYFPGKISRLTNKAFGNLVYVPNERDDRLVDFEETIKKSIGYKNE

SEQ ID NO: 5944 - protein, 90 aa, Enterococcus faecium
  misc_feature (B) LOCATION 1...90
  hypothetical: YES
YERRLFGRSDFFRRIWLFDHGSAAAGMGTKWKNQYLAILCQKNEETLSGTCFYACDSFGLYHFVSARAVKQSSRSCGQQLTVCQQLVANQ

SEQ ID NO: 5945 - protein, 527 aa, Enterococcus faecium
  misc_feature (B) LOCATION 1...527
  hypothetical: YES
KRRRHSVRITQTEMTFHSQFLSNYIQKQNKKEVFMLIEARKKELLVLQMVIQKNNCSLQELSNDLHIPKRTIKELIRKINVSLKQFLLIDEFIYSNHKGEIQTKETDQTKKLAVFSKLKLCYLKESNRFNYLMLLINYPQTAVPKKYLLEQLYISPSYLEKLTKQLNHSLKKFHLRILSVKNCCTLEGNELSIRLYLYFFLSDTFGGNDWPFSSLELNALKMNSTDEQIEKISKQEKNIYLLLTLFILRNKQQAYFPKTSSEITELMDLLQHTHDYSEYFTSFSVSRPCEETETERAYFNYFFYCFFPNQISFRQKQEIGFLFSTSKNLICRQVGQLMTYLTQQFPLNHLENKIPIYFYFLVLAVVFFELLGESSSSFSTLCFPEATSNHSSSFIQEKKLREKIDTIFSKNGERNQISQYLSQLIQHLLQTETKEQLLIHLQITKQFTGNYHLQSHLQQLFRKDAVKITAYSEHADLIITDQHEKISDETETFYLDTTHNTVLFGKLIKAVHELYMKKGYENKTKRM

SEQ ID NO: 5946 - protein, 420 aa, Enterococcus faecium
  misc_feature (B) LOCATION 1...420
  hypothetical: YES
DNILENVKQRCIMKRWQKVLLTLLGVFVLLIAGLSAYGIRFMGEASQTVNKISKNSNRISSKRSERVSIDDKEPFSVLLLGLDTGGLGRTEQGRSDTMMVVTVNPKQKKSTIISLDRDIYTNIVGYGTVDKLNHAYAFGGVEMAMDSIEQLLDIRIDHYVTINLDGMEDLINAVGGIKVNNKIDFTLDGVHVPVGEQTLNGEKGLAYSRMRHEDPEGDIGRQRRQREVVTKIVNKVLSLDGVSNYRKILKAVENNVTTDLDWDDMLDVATNYTPAFETIKQDQLQGEGQMINDIYYQILGKNDLLSIQNELKKQLNIKTSDTLPNLKNENASMMFFDDSEDGDSTNGDGSNSEGYTDYSSYSENTYDQYQDPNTYYQQTEDTSQYYTPSQDTQSYDPYAGQEQNGYGYDQNNEYGTTSGY

SEQ ID NO: 5947 - protein, 128 aa, Enterococcus faecium
  misc_feature (B) LOCATION 1...128
  hypothetical: YES
NHQLVSPLEDVQVSQLLLQGIFFLLGLFFSPLLSVVTSQVTAPALIMVGVLMAQSLRQIEWGNLEIAIPSFLILIGMPLTYSISDGIALGFIFYPITMLAAKRGKEVSPIMYGLFFVFVGFMWILNVK

SEQ ID NO: 5948 - protein, 87 aa, Enterococcus faecium
  misc_feature (B) LOCATION 1...87
  hypothetical: YES
YAKLKSKGGRYFMAKETEDKLAKLAKESGNDFKKLDEMEKEFKLNESPDVERDDREESKLEKTLDKAPIFPPNTPNNPTNPGSPANP

SEQ ID NO: 5949 - protein, 79 aa, Enterococcus faecium
  misc_feature (B) LOCATION 1...79
  hypothetical: YES
WHKLCDLLSKIVNLKKDDKMCRLFIYHGKNVVLFFQYSLIETSFMDNREKVIVLFQRIFLVVDLLIEHDCLKNHLGFQE

SEQ ID NO: 5950 - protein, 75 aa, Enterococcus faecium
  misc_feature (B) LOCATION 1...75
  hypothetical: YES
NIFRNVILYRIFNNALNLFAFQCKMYLGHVKVLLGMFLSLKTLYRKRTVIWPFYFYTIIRTLSEFLVYCSNLNFI

SEQ ID NO: 5951 - protein, 78 aa, Enterococcus faecium
  misc_feature (B) LOCATION 1...78
  hypothetical: YES
NIFRNVILYRIFNNALNLFAFQCKMYLGHVKVLLGMFLSLKTLYRKRTVIWPFYFYTIIRTLSMSFIIAFHILYNQSL

SEQ ID NO: 5952 - protein, 65 aa, Enterococcus faecium
  misc_feature (B) LOCATION 1...65
  hypothetical: YES
NIFRNVILYRIFNNALNLFAFQCKMYLGHVKVLLGMFLSLKTLYRKRTVIWPFYFYTIIRTLSLD

SEQ ID NO: 5953 - protein, 75 aa, Enterococcus faecium
  misc_feature (B) LOCATION 1...75
  hypothetical: YES
NIFRNVILYRIFNNALNLFAFQCKMYLGHVKVLLGMFLSLKTLYRKRTVIWPFYFYTIIRTLSNSTNITIFILMN

SEQ ID NO: 5954 - protein, 63 aa, Enterococcus faecium
  misc_feature (B) LOCATION 1...63
  hypothetical: YES
NIFRNVILYRIFNNALNLFAFQCKMYLGHVKVLLGMFLSLKTLYRKRTVIWPFYFYTIIRTLS

SEQ ID NO: 5955 - protein, 86 aa, Enterococcus faecium
  misc_feature (B) LOCATION 1...86
  hypothetical: YES
SDFRKVVSALTTGIVKWFDNKKGYGFISYDDTEEIFVHFTAIEEEGFKTLEENQVVEFEIIEGNRGTQAAHVKKGNVQTTDTSMHE

SEQ ID NO: 5956 - protein, 61 aa, Enterococcus faecium
  misc_feature (B) LOCATION 1...61
  hypothetical: YES
FLFRQHITVIKEAIDYDGIDWMDTSWDSFINLSVACFSFIDKFVIHFFDNPIYIFTSWFLK

SEQ ID NO: 5957 - protein, 495 aa, Enterococcus faecium
  misc_feature (B) LOCATION 1...495
  hypothetical: YES
GGKLMAHKHKLDSILDFPEASEREDNIIELKTWMSRLRCNKDDQIKSNSVVNAELILTNDSNLAGTIAYNEFSGYIHLLKDSPWINRTAGEWEDSFEDALTAYIEENYNVVFDDNKIHKAVVNVARKNVFNPVKERIEKVKWDQQPRLETLFIDLLGVDDNLYTREVTKRWIVGSVARIYKPGIKFEIVPVLDGPQGIGKSTVPALLYTDDFFTDSLDSLGEKKDDYMQLQGNVIIELGELSSMNKTKIEQIKNFISAKIDKIRPPYGRNVIAWARQCVFIGTSNDGQYLKDDTGNRRFYPLPCKNKPKMNPFKTKDEYFLQVLAEAKVLFDKGQRIYFSPDEDKEVLEIAKDYQEDAKMENPIKEAITKYLEMEIPYKWEEAPAWARRSYYQNYPDSKCNEKNLQHFYNGATMQQEFYLVDSVLTADILEAVFDKQAKDLLNGRSDAETKKIALIISSIPGWERKQLPKRNKRRGFYNKSNAYENKNRAGKYKK

SEQ ID NO: 5958 - protein, 104 aa, Enterococcus faecium
  misc_feature (B) LOCATION 1...104
  hypothetical: YES
RFLRLKRKDKYYRLLLLTAEAGWMDFPEVVKEVQEIGATISDSRSSPMNYQDAHGIKIIDQERNVRKYTTINECVINENLCRAPITKHIKNRSKAKDGRTFTTF

SEQ ID NO: 5959 - protein, 234 aa, Enterococcus faecium
  misc_feature (B) LOCATION 1...234
  hypothetical: YES
KLKLRSNFTEKWVLNHLKHFSERSQIEVNEDHISVQIPNKRVRADLVFYLPKRVYDHAAIKLLNGNIMIETLEAKDIYTKSTNGNIIVDQLTATMLEVEGVNGNIDIRNGNILDSIIETVNGTVTFGATAENLSVSLVNGDVRLTIKEDNLKKVEASSVNGNVKVALPDGIGLEGHAKTSLGSINSRLSNYEVVREKKERTNQMLQFRRVSDGEIAQVQLSTTTGSIYLKDTDK

SEQ ID NO: 5960 - protein, 183 aa, Enterococcus faecium
  misc_feature (B) LOCATION 1...183
  hypothetical: YES
IVKLFGLLQAETDTEDEQIKMTYLKMISLAKREILIQTPYYIPDGSIHEALKLALLSGVKVHIQIPNKPDHLLVYWATYSFAAELIEYGARIETYENGFIHAKTMIIDGGIVSVGSANIDVRSFRLDFEVNTLVYDERMASRVRKAFFEDSKISTHLTKEMYENRGIIIQMKEGLPRLISPLL

SEQ ID NO: 5961 - protein, 181 aa, Enterococcus faecium
  misc_feature (B) LOCATION 1...181
  hypothetical: YES
AKLRNNIKMISIIWFLFFFIFFSYLKVIKIDSFLVYHTSAMKNLTQNLLKKDNSSILKIELKKENNKSMKISKKAFLLVVLILLSTLYSVNFMRNAQEIYTTGDLSFHLSRIKGLSSIFEGPINYTTFNNYGDGLNYFYPFLTIIPAVVFYGISNNLILSYVLYIWLLNICTILISFWERQ

SEQ ID NO: 5962 - protein, 396 aa, Enterococcus faecium
  misc_feature (B) LOCATION 1...396
  hypothetical: YES
RTISNKRNLSRNRSFTTKRGGLSMSKTNTRPSHGPAGGPGHGGPGRNLGVKGEKPKNFWGTVRRLFGYMSKRMVAIIAVFVLAIAAVIFQIQTPKVLGKATTEIFKGVMAGAQQMQQGQQVTKFPIDFDKIAQIIATVIVMYLISAVFNFLQQFIMTRVSQRTVYELRHDLEAKMNRVPISYYDTHTNGDIMSRAINDMDNIASTLQQNLTQFVTSAVTLIGVIVMMLSISWQLTLVALLMIPLSLIIVMIVAPKSQVFFADQQKSLGLLNNQVEETYGGHTIVKTFNHTEKDQEVFEKENQNLYAAGWKAQFISAIIMPLMNFVKNLGYVFVAVLRGVKVANGNMTLGDVQAFLQYTTQFSQPITQLASLMNTIQSTVASAERVFEVLDEGKDVQ

SEQ ID NO: 5963 - protein, 73 aa, Enterococcus faecium
  misc_feature (B) LOCATION 1...73
  hypothetical: YES
SFISLKTLWRWTSEKPSRVRALFVRGKRNLSKLGGTVYEFHSPLFMMNKGDFFIYIAKKGRENYEFPKTKRNK

SEQ ID NO: 5964 - protein, 461 aa, Enterococcus faecium
  misc_feature (B) LOCATION 1...461
  hypothetical: YES
NNIRAKIVVSNGKERKKKMEQTKKKKFQMPSAYTVLFIIIAVIAVLTWFIPAGHYSVDDAGNIVAGSYERVQQNPQGLWDIFMAPINGMLGVPAGELTKETPAAIPISFFILVVGGFLGIINKTGALDAGIASVVKKFKGKEKMLIPVLMLLFALGGSTYGMAEETIPFYALLIPVMMAVGFDTVVAVAIVLVGSQVGCLASTVNPFATGVASQAVGISMGEGIGLRFLMFVILLAISIVYVYRYASKIEKDPTKSLVYNQRKEDMKHFDIEAIGRQEVITKKQKHVNVLFFITFGIMIISLIPWTTLNANFTIFESLTNWLTNLPVLGTVLGKSMLPLGDWYFPEITMLFLVMSIVVAITYGMKESEFVSEFLAGASDLIGVAIVVAVARGIQVVMNNGLITDTILHWGEQGLSSLSSSVFIIITFIFYIPMSFLIPSTSGLAAATMGIIGRLYSPQVAP

SEQ ID NO: 5965 - protein, 257 aa, Enterococcus faecium
  misc_feature (B) LOCATION 1...257
  hypothetical: YES
QKIRGNQMNEKEWDEFAEEYYEIQQESQVTIAEDVKNYLKTEKVLPAETAADVAGGSGRFLSLAKEINRYDLIDFSSGMLENAKKEAEKNELPNVSFIKQSLEEFIQSNETYEMVFTAANPALVHLIQLEKLMKKSSKWCVIIRVVESIDDVFYPIEKQLGMIEEDPNTSPVVMDQFETYLIDEGFKVKKKDFTYFTQESITEELMKLYYDAYAKDPVVTRYIRKLFSEKREILSTTKLTYRLLLWSADKKRTFHDS

SEQ ID NO: 5966 - protein, 1049 aa, Enterococcus faecium
  misc_feature (B) LOCATION 1...1049
  hypothetical: YES
MKISHREEAEVEEQLIRVLGEGHNQWTYRPDLKSEEDLWVNLRQKIISNNQAELNDFPLTDKEFETIKTELLLRTKTPFDAAKWLKGENGMARITIEREDPQLGSVSLILYSNQDIGGGISTYEVVHQIAKRGSNIEARDRRFDVTLLINGLPIVQIELKQVTAKDSFYQAFNQIKKYAEEGMFRNNIFSTLQLFVVSNEQTTRYFANALPKDLHPKFLFSWRTKDNKKVENLYEFCKQVLNIPDAHRLIADYTIVSEDQDNKILMVLHPYQVHAIQALFIAANKHQSGYVWHATGSGKTLTSFVSTKLLARKSGIDRTIMLVDRKDLDNQTTTEFTKFASEFNTGISSGNAKANSLIVGTGSAKELSETLLADANANVVIITTRQKLDAALKYAKKQEEKKGTNRFQKLMGQHIVFVVDECHRALSAENMEEIKKMFPKSTWFGFTGTPIFPENRKQAKGQLARTTHDQYGEVLHTYTIKNALEDGSVLGFQVEHENTVEPTSLENKIYRKLKEVETYAEYSPEQINRMIDQMEPVKKESYLDPTVFEADEHIQKVIHKMFRPDNAYTKFDFRNGRPTKSAILTTSSIDMAKKYYRAIKEMTKEPDWLTKEFPNQPIREGRTMEDPDFPRIAITYSLEENSRDSSVQQEEMQKIIEEYNQYYDTSWSLADIERYNGDINNRLARKRAEFKQFGKQIDLVIVVDRLLTGFDAPTIQTLFVDRNLEYAGLIQAFSRTNRTYPEKTKGLIVTFRKPATMEKNVEDATKLYSEAKEESGLIYPSYQESKKRFKQAYGKLKEVSSMESIDEHTPLEIRIEYVKAFQELNRAYESLVTYDDYNDDMVKSSTLNNQIQLLEEQIGVYETVKGSLIEEEPEKEGEDFSTIEFYSENTTKLYDIDSTYIDQLLGTYAANSSDAREEIEKALAKLNKTEGVKEVYRQILNAFDVGTLDSNEDIFVIKRRYFTQASDDLIHVFSNEWFVSEKELHASNLQYMPGEDPIPNMKAIINSKDYEGYKANHPEAKPFKYPQEMKRAWRKMLDDELIPLENELR

SEQ ID NO: 5967 - protein, 206 aa, Enterococcus faecium
  misc_feature (B) LOCATION 1...206
  hypothetical: YES
LEISVFEGANKSELSMIEVAHAILEQRGDVMDFSDLANQIQNYLGKSDSEIRDSLAQFYTDLNIDGSFISLGDNRWGLRSWYAIDSIDEEVNHGMDEEDEDTPRRRKRKKVNAFINDDEDAIDYYDDDPEDTDLTEEDDDDLFDDDDDEDEEIAAYNSDLQEIGADDPTDDEEDLPGNIEEDLSIIDEDDDDEDYEEEEFSDSEKE

SEQ ID NO: 5968 - protein, 200 aa, Enterococcus faecium
  misc_feature (B) LOCATION 1...200
  hypothetical: YES
KAISKGGNPLELKKLEVPTSSITEVKRSPMDVFAQARDAGTGVYIFNREKVAGVMLTQEQYETLLQELDVLRQTVKEELKEPKEKEIHEESVNKTASVVSNAEGMEELAQTLQHSLITGVTITAKNLDERMVALGFITKKTGFGGVVDMLSELMKTGKINYQLRRKPQNRTIIAEIIGEQNSQSQLMDKIIIKKIFLHEL

SEQ ID NO: 5969 - protein, 323 aa, Enterococcus faecium
  misc_feature (B) LOCATION 1...323
  hypothetical: YES
QHVRKEESMPTLADVAKRANVSKMTVSRVINHPEQVTDELKELVFSAMAELDYRPNIAAKALVTNRSQIIKLFILEEIDTTEPYYMNLLMGIAKRIGKAHYSLQLVTNDAFDVGSCDGYIITGVRKKDFDWIDRLEKPVVLFGENSEGYDYVDSDNEYGTAKATQYALERDYQTIIYIGIEVDEPFEISRETGYLSVMKEVDLPSKILRFPNHSTEVERYMTENWADFTDKTCFVCSSDRLALGAVRGIINAGGHLPEEFGVIGFDGVFLDQISSPKLTTIKQDIIRMGEVCGEMLLKKIEEKGASQGYRRFFPELVIRETTN

SEQ ID NO: 5970 - protein, 968 aa, Enterococcus faecium
  misc_feature (B) LOCATION 1...968
  hypothetical: YES
IMVSKNNKRVFLEKTKKRVLKYSIKKLSVGVASVLIGVGLVLGTTELVKAQDEISPSSPLETAISSVQVGDKVASGNTFQENPGYTKNYNFSDLQFSPQELTGDTLKGNTIGFEVYGKHNIAASTKNWEIRLQLDERLAKYVEKIQVDPKKGIGSSRRTFVRINDSLGRPTNIWKVNYIRASDGLFAGAETTDTQTAPNGVITFEKSLDEIFKEIGIDNLKTDRLMYRIYLVSHQDDDKIVPGIDSTGYFLTDSDDFYNSLDVSENNPDQFKHGSVSAKYEKPNTQTKDGSGSTGANGAIILDHKLTKNYNFSYSSSAKGTPWYANYKIDERLVPYVAGIQMHMVQADKVTYDVSFESGTKVADLAIERREGHENYGIGSITNNDLTKLIDFANASPRPVVIRYVLQLTKPLDEILEDMKATAQVEENKPFGEDFIFDSWLSDTNKKLIQNTYGTGYYYLQDIDGDGNPDDKEESGDTNPYIGKPELEEVYDVDTTVKGKVFIHELAGTGHKAQLVDKEGTVLAEKTIAPNEKDGAPISDTVEFEFTGVDSSKLIAKDELKIQIVSPGFDKPEEGSTVIKESPKAVDKQTVVVGFKPDAKESIRNNKNLPEDAEYSWKTEPDTSNVTDSTKGIVTVKIGNRTFDVDVEFAVKASQAMENDATYVPITTTPETTVQSGKPTFDKPDVPLAKDAFSISDVYNKDFGNASVDANTGIVTFTPAKGVGESEPITGTIPIKIVYQDGSVGTTDLAVTVSKDIYENPGENIPAGYHKVTFTAGEGTSIESGTTVFAVKDGVSLPEDKLPVLKAKDGYTDAKWPEEATQPITADDTEFVSSATKLDDIIENPGDNIPAGYHKVTFTAGEGTSIESGTTVFAVKDGVSLPEDKLPVLKAKDGYTDAKWPEEATQPITADDTEFVSSATKLDDIIENPGDNIPAGYHKVTFTAGEGTSIESGTTVLCSERRRKLTRR

SEQ ID NO: 5971 - protein, 138 aa, Enterococcus faecium
  misc_feature (B) LOCATION 1...138
  hypothetical: YES
TFSSYISKCIFYHYSTSKFILFTFFNFLPLSSKMISAESATSLLCVTTITHLFLSLANVFNILIISPAVTLSRLPVGSSASIIGASDTNALAIATLCCCPPDNFITFLFICFLSKPSSNKILSSADLFTNLIFSIGDK

SEQ ID NO: 5972 - protein, 60 aa, Enterococcus faecium
  misc_feature (B) LOCATION 1...60
  hypothetical: YES
FPSSQIGSECRHTDGKKSLTIREWTCPICRIHHNRNVNDSINILTKGYEYKHCLRKHQEP

SEQ ID NO: 5973 - protein, 68 aa, Enterococcus faecium
  misc_feature (B) LOCATION 1...68
  hypothetical: YES
RESSVSTAYLASNKCILTYIILMKETKIIPLKKNNINKSTAKILGVVREVIKKVIGTIKMQTMPKNSH

SEQ ID NO: 5974 - protein, 175 aa, Enterococcus faecium
  misc_feature (B) LOCATION 1...175
  hypothetical: YES
NVPSNNLEGMNEVKTIYLDHAATTPMHPQVIEAMTAIMQDTFGNPSSIHGFGRHAHEKLETARQIIADSLQAKPHEIIFNSGGTEGDNTAILETAFSRQKEGRHLITTAIEHPAVLNTMKYLETKGFDVTYLPVDEKGNLSIEEVKKALREDTILVSVMYGNNEIGNLMPYQRNR

SEQ ID NO: 5975 - protein, 257 aa, Enterococcus faecium
  misc_feature (B) LOCATION 1...257
  hypothetical: YES
NSTRIEVYSQKNKGGKIMSGHSKWHNIQGRKNAQDAKRGKVFQKLSREIYMAAKAGGPDPSMNPALRLVVDKAKAANMPNDNVERAIKKATSAVDETNYDEITYEGYGPGGVGILVHALTDNRNRTATNVRVAFTRNGGSLGETGSVSYLFDRKGYIAIERDGLTVDEETMFEDVLEAGAEDLQTSPEVFEIYTAPEDFAAVRDELEKEFTLAQAELTMIPQTTIDLNEEQKEQLERLVDKLEDDDDVSEVFTAAEM

SEQ ID NO: 5976 - protein, 257 aa, Enterococcus faecium
  misc_feature (B) LOCATION 1...257
  hypothetical: YES
KRTRIMTYKNIVFDLDDTLYDHQLPFKRSVEKCFPTIDIQQIDNIYKRFRCWSDVAFPKYTKKLISIEQLRIFRCQKTMEEFGIDSISRTEALDFQADYEYELDQITMIPEIHQLLLALHKNRIPIGILTNGPVDLQSRKLQNIGAYQYFEKQNIIISQSTHGGAAENSYEGNVKNLQSYQNVQLSKRAIEILKEEIELNHQHIRFNPDYKDNGWIFTSKSRHKPGMATVFLTNFIRCRTSFRMLFPIVLDNEPPRM

SEQ ID NO: 5977 - protein, 336 aa, Enterococcus faecium
  misc_feature (B) LOCATION 1...336
  hypothetical: YES
VEARVVTKKVEVPMSKHYFDPRLKIFALNSNRPLAEKIAAAVGVELGKSSVTQFSDGEIQVNIEESIRGSHVYVIQSTSSPVNDNLMELLIMIDALKRASAKTINVVMPYYGYARQDRKARAREPITAKLVANMIQKAGATRMLTLDLHAVQIQGFFDIPVDHLMGAPLIANYFLEKGIKGDDVVVVSPDHGGVTRARKLAEFLKSPIAIIDKRRPKANVAEVMNIIGQVKGKTCVLIDDMIDTAGTITLAANALKEAGATSVYASCTHPVLSGPALQRIEDSAIERLVVTDSIYLPEDRKIDKIDEVSVGGLMGDAIKRIHENKPVSPLFETKNK

SEQ ID NO: 5978 - protein, 204 aa, Enterococcus faecium
  misc_feature (B) LOCATION 1...204
  hypothetical: YES
MQELKTRSARHHRPKRKMVINKKAIAPLIGTSLLVGPMMVTAVPQHVHADEQGSQTVADPQAFIDQIGWSASEVAASNDLYASVMIAQALLESAYGTSGLASAPNYNLFGVKGSYNGQVVYMATKEYVNGQWVTMNEPFRKYSSYWESFQDHANVLRSTSFSTGDYHYAGVWKSNTTSFYDATAYLTGRYATDPNYGPNGCFTR

SEQ ID NO: 5979 - protein, 174 aa, Enterococcus faecium
  misc_feature (B) LOCATION 1...174
  hypothetical: YES
KYYRINTQRTGWFLIDLISTDNEISPGWENEVGYPVEEFFQDYFAEYADRIMRDYVTDKTQEVINQSQSLNELSDKAKEEAVAIISSGISDYIDMSGEINYGDKDKIVRMIKAFIKTFDVKADLKFNDTYLVGKLINILGTEKDTETFISSLSMLFTDKHFSTQLGGEELVEIF

SEQ ID NO: 5980 - protein, 227 aa, Enterococcus faecium
  misc_feature (B) LOCATION 1...227
  hypothetical: YES
LDYSLAESGGCTMVIFYFILILIIIGISYHFLSYFYAKKLVRAGVQRGYDWYEDTGHRLMDPAAVTSVEKKRQKLEEECESFWEQGTPKTIKSYDGLKLAGQMFIHPNKQNKWVICVHDYRSTGKRDMSHIGKRYAEKGFNVLVPDLRAHGESEGEIIGMGWLDRLDLITWIHLILDEQPIAFIILHGGSMEAPPIMMAIGEKLPSPVKGFILNTGFFPVYPKSQFC

SEQ ID NO: 5981 - protein, 299 aa, Enterococcus faecium
  misc_feature (B) LOCATION 1...299
  hypothetical: YES
LIYRRESSVMIYGSIEAGGTKFVCAIGDEEMTIKERVSFPTTTPEETIPLVIDFFKQYQADLAGIGIGSFGPIDIHRDSATYGYITSTPKVAWQNFDFIGTMKKEFPIPISWTTDVNAAAYGEYVFGSGKGLSSVVYYTIGTGVGGGALQEGRFIEGFSHPEMGHMLVVPHPKDDFAGSCPFHGNCLEGMAAGPAIEKRLGKKGQEVAEDDPYWEIEASYIAQCAYNTTLMFSPDVIIFGGGVMKQRHMLQNVHDAFAKLVNGYVETPELSKYIVTPALEDNAGTLGCLALAREAVLHS

SEQ ID NO: 5982 - protein, 510 aa, Enterococcus faecium
  misc_feature (B) LOCATION 1...510
  hypothetical: YES
QPYRRIHLKFKELELSPELLKSVERAGFEEATPIQAETIPLALAGKDVIGQAQTGTGKTAAFGLPMLEKIDPDRHELQGLVIAPTRELAIQTQEELYRLGRDKKVRVQAVYGGADIGRQIRGLKDRPHIVVGTPGRMLDHINRHTLKLGTVQTLVLDEADEMLNMGFLEDIEKIISQVPDQRQTLLFSATMPPAIKNIGVKFMKNPHHVKIKAKEMTADLIDQYYVRAKEYEKFDIMTRLFDVQTPELTIVFGRTKRRVDELARGLEARGYRAEGIHGDLSQQKRMSVLRSFKSGHLDILVATDVAARGLDISGVTHVYNYDIPQDPESYVHRIGRTGRAGKGGMSVTFVTPNEMDYLHVIENLTKKRMTTLRPPTEKEAFKGQLGAAVEQIETKLAENGLDKYLQTADKLLEEYSAQDLVALLLKTTAKDPADAVPVKITPERPLPMQKKGYNKNGKRGGGNNRNRRDGGNYRGNKSKGGYSKNNNSQKDGGKRHNDKKRGFVIRSNND

SEQ ID NO: 5983 - protein, 86 aa, Enterococcus faecium
  misc_feature (B) LOCATION 1...86
  hypothetical: YES
EWYRGWRNMKKMKKYKIRKSGNSDVTTIPPEVKEFMGVQTGDAISYVFQSDGSVRMIKAQEEPDIDSLVDSIMNQYEDALKDLVDL

SEQ ID NO: 5984 - protein, 221 aa, Enterococcus faecium
  misc_feature (B) LOCATION 1...221
  hypothetical: YES
LFHRKRSDLSMFTGIIEEIGKVERIQKDTCNCKLSIKASKILEDIHLGDSIAVNGICLTVTCFTRQSFTVDVMNETWNRTALSLLRHGSLVNLERAMPMNGRLGGHIVTGHIDGTGRISSVRRDKNAVWYQINTQREILNLIVEKGSIAIDGISLTVAKVSKADFSVSVIPHTLEQTILKNKQVGDMVNLENDILGKYVQKLIDNSNETELSKELLCRYGF

SEQ ID NO: 5985 - protein, 861 aa, Enterococcus faecium
  misc_feature (B) LOCATION 1...861
  hypothetical: YES
SLHSLDNTQKEKEITQRMANLIRSLIENDKKELKRLDSIAKKVEAYADQMAALTDEQLQAKTAEFNGRYQKRETLNQLLPEAFAVVRESTKRVLGLYPHHVTMKGGIGLHDGNIPEMGTGEGKTLTGTMPVYLNALTGEGVHVVTVNEYLATRDSTEMGELYNFLGLTVGLNINSKSSDEKREAYNCDITYSTNNELGFDYLRDNMVVYRHQMVQRPLNYAIVDEVDSILIDEARTPLIISGQAEKSTALYTRADNFVKRLKEEEDYKIDVQSKTISLTEAGIEKAEETFGLDNLYDIENTALTHHLDQALRANYIMLLDIDYVVQDGKVLIVDQFTGRIMDGRRYSDGLHQAIEAKEGVEIEDETKTMATITFQNYFRMYKKLAGMTGTAKTEEEEFREIYNIQVYQIPTNRPVIRDDRPDLLYPTLQSKFHAVVQDIKDRYRKGQPVLVGTVAVETSELLSDMLNQERIPHEVLNAKNHFKEAEIIMNAGQKGAVTIATNMAGRGTDIKLGLGVRELGGLAVIGTERHESRRIDNQLRGRAGRQGDPGMSQFYLSLEDDLMKRFGSERIKSFLDRMKIGEEDAVIQSKMLTKQVESAQKRVEGNNYDTRKNVLQYDDVMREQREVIYKQRQEVIMEEKSLSKPLMNMVKRTISRVVDAHTQLEKENWNLESIIDFAGSTLVHEDSITLADIEGKTAQEIKEYLNERAQEVFNTKAAQLNGPEQLLEFEKVVILRVVDSKWTDHIDAMDQLRQSIGLRAYGQNNPLVEYQTEGYKMFEDMVGAIEYEVTRIFMKAEIRQNVQREQVSQGTASHSEDGDAKENSNTSAKKQPIHVNKVGRNDPCPCGSGKKYKNCHGKNAN

SEQ ID NO: 5986 - protein, 199 aa, Enterococcus faecium
  misc_feature (B) LOCATION 1...199
  hypothetical: YES
YPHRPGKVTFDRQGVLRPKLMLVGEAPGKTEIDTHVPFSGQAGKELMQALSSTGLTREEVYITSAVRSRPYRVTHRINKRTQQSETVYPNRTPTRSEVFAHAPILDYELMKVQPKLIATLGNIGLQRLLGKEYTVTKNHGQLYTGPVLQLTEQKDAYEWSEKNYRILPLFHPAAIFYNRSLVPVIHQDWQVLASLLQQD

SEQ ID NO: 5987 - protein, 81 aa, Enterococcus faecium
  misc_feature (B) LOCATION 1...81
  hypothetical: YES
HLNRRYMMRKWLIEKREQQNLTQEKVAKRSGIQRSYYSMIESGKRSPSPFVAMKIATVLSFDWTIFFNQQSNKVTHGEVIK

SEQ ID NO: 5988 - protein, 192 aa, Enterococcus faecium
  misc_feature (B) LOCATION 1...192
  hypothetical: YES
TKNSIGEKEMIEKELVTTQTEVWRDPHHTHRYVFKRQWAIKGKEAEDKLAVVITIRPTDTEPFTNDLSMLLIEKNIRQLGFTGFIAVNLFSYTKAKSPRVFLRGNDEQSLEILTTVFTEKKINTIIFACGSITATSQVAYEQAKTIYDQLSAKQKKMTKVLINAEGKLSHPLSIHVRNEWQLADSQLLFQEK

SEQ ID NO: 5989 - protein, 662 aa, Enterococcus faecium
  misc_feature (B) LOCATION 1...662
  hypothetical: YES
LKNSFLFEENSQSRKEDSMILLQANQIARHFGAEVLFENIHLEISTGARVALVGRNGAGKSTLLKIIAGIEAPDEGKIAKNKTATLGYLAQDTGLDSNETVWNEMLKAFEQVRQMEERMRELEIFISEGTPDTPAYSSYLKEYDRLQHDFSDRNGYGYENEIRSVLHGFKFDSSFYDQKIDTLSGGQRTRLALARMLLQHPDILILDEPTNHLDIETLSWLENYLQSYTGALLIVSHDRYFLDKVVNEVYELSRRKMRHYKGNYSKYLDLKAEQLASEWKAYEKQQTEIHKLEDFVARNLVRASTTKRAQSRRKTLEKMDRLDRPQGDEKQANFLFSIEKPSGNVVLQIEDAAIGYDNVTLSEPINLDIRRQEAIALVGPNGIGKSTLLKSIIHQIPFIRGKETLGTNVTIGYYDQGQADLHTNKTILAELWDEHPTTPEKEIRSALGAFLFSGEDVEKPIPLLSGGEKARVALAKLAMNKENFLILDEPTNHLDIDNKEVLENALIDYDGTLLFVSHDRYFINRIATKVVELSENGSKVYLGDYDYYLEKKQEEEEIAELLAQDEPESAPAPTNKSDYYQSKEQQKLIRSLQRKITQVEEEMARIDEWIDQLEQEMVAPENLEDHVKLNELNQDLEAARQDQETKLTEWEELSLELEEYEN

SEQ ID NO: 5990 - protein, 93 aa, Enterococcus faecium
  misc_feature (B) LOCATION 1...93
  hypothetical: YES
LTNSDILIYITKEKRKMEEQILSILEEITGTDEVRKNRDIDLFDEGLLDSLASVQLLVELDGELDIQVPVSEFEREDWSTPNKIIQQATALKG

SEQ ID NO: 5991 - protein, 133 aa, Enterococcus faecium
  misc_feature (B) LOCATION 1...133
  hypothetical: YES
TKNRSAHMNLTTIHHIAIIVSDYQKSRDFYVNKLGFEVIRENYRKERDDYKLDLKLGSAELEIFGIANAPQRPNYPEACGLRHLAFKVDDIEETIAELQSLGIESEPIREDTFTGKKMTFFFDPDGLPLELHE

SEQ ID NO: 5992 - protein, 719 aa, Enterococcus faecium
  misc_feature (B) LOCATION 1...719
  hypothetical: YES
RRNRMEEYKQTIEEVKKVTEADPDTGLSSQEVDERRKKQGLNKFDEAPKESMIKKFFRSLSDFTTIILLVAAVISFYTAFATEHGDLFEGLLIIAIVVINSVLAIVQEGNAEKALESLQDMNKQTATVIRDGKVTTVESEQLVVGDILVLESGDAISADARLIEASQLRVEESALTGESEAVEKDAAFIAEEDESLGDQLNMVFKGCTVAAGRGKAIVTAIGMATEMGKIADLLNENTMQKTPLQVRLNQLGKRISMIALAAAALVFVIGELQGEPLLEMFMTSISLAVAAVPETLTVIVTLTLAYGVQKMARKHAIIRQLPAVETLGTANVICSDKTGTLTQNEMRVRRVWSKEDEVTNIEDSMTNSAMEILKMAALCTDVTVEQEDDDLVIKGNPTEVAIVRAVEENYHTKAELEEKYPRVNELPFDSERKMMTTVHQMGEKYISITKGAFDVLAPRFSSGDVEQAAIVNDRFGKRALRVIAVGYATYDEEPQDISSEALEKDLRLIGLIGMIDPPRPESKGAIKRAKKAGIKTVMITGDHVVTASAIAKELGILNDPSEALSGSELHQLSDEELDARVKALSVYARVTPEDKIRIVKSWQRTGAVVAMTGDGVNDAPALKASNVGCAMGITGTDVAQSAADMILTDDNFATIVNAVSQGRSVYQNIRKAINFLLSCNISEIFIVLIAMLLGWGAPFTAVQLLFVNVVADGLPGFAL

SEQ ID NO: 5993 - protein, 78 aa, Enterococcus faecium
  misc_feature (B) LOCATION 1...78
  hypothetical: YES
RYDSVNEINKIITKAAMGSEYQMAAADKATKTTTICSVPYAIDDNASDDNNAKAANRVNLCSSFSADFKGLPTNNLFK

SEQ ID NO: 5994 - protein, 506 aa, Enterococcus faecium
  misc_feature (B) LOCATION 1...506
  hypothetical: YES
NDDRYIGHAGFSRYVNCLRGKWESRGNSKEKLSVMTTFYPMYDFTKAIVGDEGEVELLIPAGTDSHDYEPSAKDMAKIQDTDIFVYNDENMETWVPAIQKTLQEGNVHTIKATEGMLLLPGSEEGHDHDHEHGEEGHTHELDPHVWLAPSLAIKQVANIRDQLIEAYPEKQEVWTKNAAAYTEKLQALHQLYQETFKQAKQRSFVTQHAAFNYLALEYGLNQVSIAGLSSSEEPSAARIAELKHFVKEHGINYIYFEENAKDSIARTLANEAGVSLEVLNPLEGLTNEQIENGENYLSIMEANLEALKKTTETENPLEDTLTPKKEKSVYNGYFEDEDVQDRSLSDWAGTWQTVDTYVEDGTFDPVFEYKEKLNQDKTAQEYKEYYTKGYQTDIASIKISEKEMAFTFKNGTTKRSNYRYVGKEILTYEAGNRGVRYLFEAEDKESGAFRYIQFSDHTIAPADSEHFHLYAGNESQEVLLKEMENWPTFYPDTMDGREIAQEMLLH

SEQ ID NO: 5995 - protein, 306 aa, Enterococcus faecium
  misc_feature (B) LOCATION 1...306
  hypothetical: YES
VADSGRGMPVGMHASGIPTVEVIFTVLHAGGKFGQGGYKTYGGLHGVGASVVNALSKWLIVTIVRDGVEYQQKFKNGGKPDGTLKKIGKTKKANGTTVHFLPDDTIFSTTKFSYEILAERLRESAFLLKGVKISLSDLRGEEPVKEIFHYEEGIKEFVDYLNEEKDTLTPVVYFSGEKEGIEVEVAYQYNDGYSENVLSFVNNVRTKDGGTHEAGMKAAMTKSYNEYARKVGLLKERDKNLEGSDFRERLAAVLSIRVPENLLQFEGQTKEKLGTPVARTVVNNVISEQMGFYLHENSEMSQMLVR

SEQ ID NO: 5996 - protein, 106 aa, Enterococcus faecium
  misc_feature (B) LOCATION 1...106
  hypothetical: YES
RRCSLMMLKPSIDSLLDRVNSKYSLVILASKRAHELDASAQPTLDSFDSVKSVGQALEEIDAGNVVNDPHPELKRERLKMEEEERQAQKEREQHELESRIREEQKM

SEQ ID NO: 5997 - protein, 184 aa, Enterococcus faecium
  misc_feature (B) LOCATION 1...184
  hypothetical: YES
KVCRMLLKVAIKCYCVKNKGGIIYEKIVPRGACLLLALCLSLSAVGCQKSNENNKIKEGQSISSEEEGMSINANGKNETFKPSDYTLEAKKEYVYEYLGLKFKLSDKFRNYIADKKIAMLDDQSPIDKELKYAILTFEKMTEEQKNAVIEKMGDGYKNWQNELERIGTIGIFEKNTSEEKNLKL

SEQ ID NO: 5998 - protein, 337 aa, Enterococcus faecium
  misc_feature (B) LOCATION 1...337
  hypothetical: YES
ESILGGIKMNNKDLVAKAVYDVVKDDLTLEQVEQLLENPKSAEHGDVAFPAFSLAKVYRKAPQQIAADLAEKIDSANFEKIEVVGPYLNFFMNKELISKKVLQTVVKEKEHYGDSNIGNQGTVPIDMSSPNIAKPISMGHLRSTVIGNSIGFIMEKIGYQPIRINHLGDWGTQFGKLIVAYKKWGTEEAVKAEPINELLRLYVQFHEVAETEPELNEEARAWFKRLEEGDKEAIQLWQWFRDESMKEFNKIYDLLEVRFDSLNGEAFYNDKMDEIVKLLEEKHLLNEDKGAEIVDLSAYDLNPALIKKSDGATLYITRDLAAALYRKRTYDFNNLYM

SEQ ID NO: 5999 - protein, 248 aa, Enterococcus faecium
  misc_feature (B) LOCATION 1...248
  hypothetical: YES
LISSNKKGNSMRLDKLIEEKLETTRKEMKRLFALKQVMIDGTVEFRQNRNVDSLLHQIEVAGEHLETNESYYLLNKPEKAVTAVSDPEKTTVIDLIASADRFQPLYPVGRLDRDTTGLLLITSNGQLGYEMLLPEKKVSKTYQVVVNERVTPADVTAFENGIVFADGYQCKPADLKILKADKHQSTVLLTIQEGKFHQVKKMFLAQGKKVTALKRLSMGPLELDEQLGVGEYRSLTLAEMKKLSIYFK

SEQ ID NO: 6000 - protein, 154 aa, Enterococcus faecium
  misc_feature (B) LOCATION 1...154
  hypothetical: YES
KYSRKRGAVMERTLVIIKPDGVRRHLVGSIIQRFEAKGLAIAEMKFETMTPELAKEHYQHLTERSFFDELIDYMTSGPVVYLVLVGEEVIDIVRKMVGATKAADAVPGTIRGDYALPGTENIIHASDSRDAAVKEIARFFPPFDINKPSEKAAK

SEQ ID NO: 6001 - protein, 138 aa, Enterococcus faecium
  misc_feature (B) LOCATION 1...138
  hypothetical: YES
KRSRMMAELKKMQDYEYDLPELVDQPEQQMPDSSSNQEIILPQSPAKRLKQISALEKIAVASVAIAIVALCVLTVMLRTNISGAEKEITSIQTEINDKKQEKTSLEQEKNELSRTERIKQIAEEKGLSINDDNLRKVK

SEQ ID NO: 6002 - protein, 387 aa, Enterococcus faecium
  misc_feature (B) LOCATION 1...387
  hypothetical: YES
KGGRKMKKIIAITSCPVGIAHTYMAAENLEKAGKAVGAEVKVETHGSIGIENELTARDIEEAAGVIIAADTKIDKSRFGGKPLITVGVQEGIHHADELVRDILAGKAPVYKSTEAIISSENKSESENLGKKIYKSLMNGVSYMVPFVVTGGLLIAISLTLGGTATPEGIKIPEGTIWATMNSIGSIAMGLMVPILSAFIAQSIADRPGLVPGFVGGMLAANGALYGSDANAGFLGGIITGFLAGFIALGIKKVRVPKALQSIMPIIVIPILGSLAVGFVFIYVIGEPVALLFSSLTHFLAGMQGGSEIVLAMILGAMIAFDMGGPFNKVAFLFGSGLIAEGNYSIMGPIAVAICIPPLALGLASLILKTKFTKTEREAGKASLAMGL

SEQ ID NO: 6003 - protein, 101 aa, Enterococcus faecium
  misc_feature (B) LOCATION 1...101
  hypothetical: YES
QGGRKMKVIKYLIGLAAISGILLFGLKYYTEGSYGEIPGILDQLNPLVEKGEVYVKTQKPEEVNEYGTARYVQKAADANGKERTVEFNGLCCVKRKSLFEN

SEQ ID NO: 6004 - protein, 590 aa, Enterococcus faecium
  misc_feature (B) LOCATION 1...590
  hypothetical: YES
NKGSDIQLAKPSTNKLEGIEMGKYQELARKIVENVGGKENINGLTHCITRLRFKLKNEEKANDEILKNMDGIVTVMRAGGQYQVVIGNHVPVVFEEVIKAGNLTFDEAVSTEKMRPFDMLIDGISGCFQPFLAILAAGGMIRGLTAFLVFLGAFDRGSGTFVMFDNIGDSVFQFMPVIIGLTAARKFKVNEFVGMLLGAALMNPSLSLEALSGAAEAPLTTIFSGTIFEAPIYQTVFGIPWIARNYASSVIPIIFIVLLASQIQKPIKKLVPEMIANFFVPFFTVLITMPLGFLLVGPVFTFATDILMAGFETLLALSPVIYGAIVGFFWQILVMFGLHWAIVPMGLMQFSVNGWQNIMTPVAVVSFGQTAALTALYFKLRNPKDKAIAIPAIVSGIVGITEPAIYGFTLPRKKIFIFTCVGGALGGAYSGLMNLTSWNQGGLGIFTIPNYIRPDGDLTDVINVLIGIAIAMVVSFTLTFFFWKDEAGETDDIQKKSGKEIVKTPIQGQIAPLNAAKDAAFAQGTLGRGILIYPEKGEVRAPFDGTVMTLFPTKQAIGMVSETGLELLIHVGLDTVQLEGKYFESLVQQG

SEQ ID NO: 6005 - protein, 82 aa, Enterococcus faecium
  misc_feature (B) LOCATION 1...82
  hypothetical: YES
DNFRKNGIAFPFYTRDGTDEICQKLSAKYFIEARNQSIEKETKSMDTRIQRTIDSSRLILSFGSTCLFTKSQTSRTADEKIQ

SEQ ID NO: 6006 - protein, 533 aa, Enterococcus faecium
  misc_feature (B) LOCATION 1...533
  hypothetical: YES
VIFSWNDRQVVVVPAFFMAVNLLKKIVIIYLFLDPVIMKGRNKMKKETNVTLVTVSIFIATFMTAIEGTIVTTAMPTIVGSLHGMEIMNWVFSIYLLTNAMLTPIYGKLADKVGRKPIFIFGTLLFIIGSLFCGLSQTMIGLIAARAIQGMGAGAMMPVALTIIGDLYSIEKRAKVLGLNSSAWGIASVFGPLAGGFIVETISWHWIFFINVPIGILLIILIWLYLNEPKIIHESKPMDIFGSFSLMAMLVSLLLGFQLLGDEGMSPLVSALLLGSIVMLGIFVFAEKRAKDPVIMMHLFKNPLFVVVNLAAALASGFLMGIDVYIPMWMQGVLGLNAAIGGLVLAPLSLVWMVGSFLASKWMTQMKTHWVLRIGLLIAAIGGAWLYLMPFRSNYLWFFAISTVIGIGLGVTMTTSTVSAQNSVSRDQLGVATSFNTLVRTIGQTVMVSIFGLLINGVTKRELAAANLTNDADIMNKLVNPQTAKYIDADILLPLRKILYDGLHSVYLVGLLLVIIALVLTLFVHEKSGKIKQ

SEQ ID NO: 6007 - protein, 736 aa, Enterococcus faecium
  misc_feature (B) LOCATION 1...736
  hypothetical: YES
AWFRYIQSLKNSSMPLIPVHLFKREWSEGMKKKLFRIVGIVFISILTLIVLLSLVGTVAEATGLVDDTVEAGNLYSKYSLNNYQLDFFVDSSWDWLPWNWGDGLGKSVMYGLYAITNFIWTVSLYLSNATGYVVQEAYKLDFISDTAESIGKNIQTLAGITENGLQTSGFYFGFLLLMILALGVYVAYTGLLKRETTKAVRAVINFVMIFLLSGSFIAYAPTYITKINDFSSDVSEAALTLGTEIVVPNSESQGKDSVDLIRDSLFSIQVQQPWLLLQFDDSNIEEIGEDRVNKILSVSPDENKGKDREEAVKAEIEDNDNANLSITKTMNRLGTVVFLVLFNIGISFFVFLLTGIMLFSQILFIIFAMFLPISFLLSMLPTYESLGKKAIIRLFNTIMMRAGVTLVITTAFSISTMFFNISATYPFFMVAFLQIVTFAGIYFKLGDIMSMFNLQSNDSQSMGRRVMRKPQMLMNRKLRQLNRNVGRALAFGGGAAVGNKLAKEQSKSKFKPSGSSLRKNSRLPNDHEILSDLTKENPVSNNKKQSRMNLAGRKIGKVLDTQALVKDKTKQVKDQVRNTPTNLKYNLHKGIEKSKKAPEEFKRGLFQEKADRVDLREKQRQRRNAKMDEKRKILSEATNRQGKRRANIPIDKAAQPQKDMMLKKEAPKRIVRANLNPEIKRKLTSQEIISKGKSQSASKKNSFQQVKQRSTLPKQTNQKVQKRMNHRPKSRSGEKK

SEQ ID NO: 6008 - protein, 97 aa, Enterococcus faecium
  misc_feature (B) LOCATION 1...97
  hypothetical: YES
KHWLYTDWDYMYFKGKIFPTPPRIDTKKLNMLETILEAFNEQMGKDMTQTLIEYVNEQTDKLGLLADNVETIEQLSYEQCALMERAIAAKRKELDKK

SEQ ID NO: 6009 - protein, 288 aa, Enterococcus faecium
  misc_feature (B) LOCATION 1...288
  hypothetical: YES
RKLRQRLARSDNMLAQINRVAFELVGIPIYWYALIIVSGIIIAMWLSSREAVRVGLKADDVTDFMLWGLPISIIGARLYYVLFDLPQYIADPIQIFNIRSGGLAIYGGLIAGAITLYFFTKYHFISLWTFLDIAAPSVLLAQAIGRWGNFMNHEAYGPDTTRSFLESLHLPQFIIDNMYIEGIYRQPTFLYESLWSLIGFILLLFLRKKPHLLKKGEVLLCYLMWYSFGRFFIEGLRTDSLYFLGVIRISQLLSAVLFVGTLILFIWRRKKGNLPDYDRSLGKNQQII

SEQ ID NO: 6010 - protein, 393 aa, Enterococcus faecium
  misc_feature (B) LOCATION 1...393
  hypothetical: YES
TEISQLYLGVTQLDARYAIILAAGKGTRMKSKLYKVLHPVSGKPMVEHIINRVSETKPDEVITIVGHGAEQVKAQLGERSKYALQAEQLGTGHAVLQAASFLEGKKGTTLVISGDTPLLTTETLNNLFEYHQGKNASATILTAQAENPTGYGRIIRDHIGIVEKIVEQKDATPEEALVQEINTGTYCFDNEALFDALSKVGTNNAQGEYYLTDIIEILKEEGHTVAAYQTDDFEESMGVNDRIALAKANEIMRKRINQMHMVNGVSFVDSATTYIDAGVEIGPDTLIEAGVQIQGNTVIGSDCVIGSHSKIVDSRIEDHVVIENSVIESSHVKKHADVGPYAHLRPKAEIGENVHIGNFVEVKNAQIGKGTKVGHLTYVGDATLGEEINLGSV

SEQ ID NO: 6011 - protein, 89 aa, Enterococcus faecium
  misc_feature (B) LOCATION 1...89
  hypothetical: YES
SQWLETVLCSSREQGTYKTNVLVRPLKNSVGAGDSMIAGFIGAYSRTKDPIEAFKWGVACGSATAFSDDLAARELIDELLPEVEITKID

SEQ ID NO: 6012 - protein, 261 aa, Enterococcus faecium
  misc_feature (B) LOCATION 1...261
  hypothetical: YES
RHSSNQKLYKTKEERSAALKRHLEFFNTHPYIASPILGVTLALEEERANGAPVDDVAIQGVKVGMMGPLAGVGDPVFWFTVRPMLGALGASLAMGGNILGPIIFFLGWNIIRWAFMWYTQEFGYKAGSKITDDLSGGLLQDVTKGASILGMFVLAALVQRWVSIKFLPVVSTVKLDKGAYIEWDKLPSGGEGIKSAFEQVNNGLALSPEKVTTLQDNLDQLIPGLAALGLTLLCMWLLKKKVSPIVIILGLFVVGVVGHVI

SEQ ID NO: 6013 - protein, 181 aa, Enterococcus faecium
  misc_feature (B) LOCATION 1...181
  hypothetical: YES
TVSSPIWIKTSAPSAVCMPIACLVGKTLKILPESGAATSPVAGMTAKPSPIIFCEKTGSFTSVKAITSPVATVNNSFSIPKTCFSSFFSFLFVASTVGSGISAPDCSKSSISDFNTSAFGPYTACTPLSLTIKPIAPARFHSSSEPTFPGSSTLTRKRVIQASTSLMFSFPPNKWMILMIC

SEQ ID NO: 6014 - protein, 124 aa, Enterococcus faecium
  misc_feature (B) LOCATION 1...124
  hypothetical: YES
YVSSQALHPSKMSFKKTTRSIVTIIFQILFLGNNRHFLRLLGKKKPKIEHSLETLLRELLLLFPYIKAETDNISFLPFLHQIVFATSYTTLIFYKSQHFLAFLLLFRNIFLMFSILCFQLSDNS

SEQ ID NO: 6015 - protein, 328 aa, Enterococcus faecium
  misc_feature (B) LOCATION 1...328
  hypothetical: YES
MRSSCGRLFTRKSFCIGGEAAVANIRDIAKLTGYSVSTISRVINGHPYVDEEKRKEILAVMKEVDYIPNANARQLSYGKTKSIGVILPYTNHPYFDQLISGIIEAAFDYDYKVTLLPTGYHKEKERRYLEEFAAKAFDGLIITSRANTLDDLLAYQKYGPLVFCEEIKGKQASCVFIDREQSITEGLTYLKQQGIKQLGITLGRSGRLSYNSKITLQLCHQLFPSFDESLVFWDCIDAEKGKQAGFFFKELGVDGVFTNSDMVAAGILQSYLQDKTPVVIGRDNLLISELLGFPTIDHHLEACGEMAFQLFLTEKKDKVKIPYTFIQR

SEQ ID NO: 6016 - protein, 321 aa, Enterococcus faecium
  misc_feature (B) LOCATION 1...321
  hypothetical: YES
KLWLNRHQVFAGADLENVLNEAALVAARRNKKKIDASDIDEAEDRVIAGPAKKDRVISKKEREMVAYHEAGHTIVGLVLSRARVVHKVTIIPRGRAGGYMIALPKEDQFLMTKEDMFEQIVGLLGGRTAEEIIFNVQSTGASNDFEQATALARSMVTEYGMSDRLGPVQYEGNHQVFVGRDYGQTKAYSEQVAFEIDQEVRKILMEAHDKAREIIEAHRAQHKLIAEKLLEFETLDAKAIKSLFEHGVMPEGTESNDYPSEKEAKTFEEAKRALEEKDAEKQAEEKRDFEEAKHELNEENKAEHDSDSQQSEDNHSDDQYK

SEQ ID NO: 6017 - protein, 479 aa, Enterococcus faecium
  misc_feature (B) LOCATION 1...479
  hypothetical: YES
KEWLIMLNIGEKEFWFVVGSQHLYGEEALREVKKHAQEMVDELNENGQLPYPIRLQELAVTADTITKIMKEVNYREEVAGVITWMHTFSPAKMWIRGTKLLQKPLLHLATQYNESIPWKTIDMDFMNLNQSAHGDREYGFINARLNKQNKIVVGYWKRPEIQKEIADWMDVAVAYNESFGIKVARFGDNMRNVGVTEGDKVEAQIQFGWTVDYFGIGDLVQVIDRVSDEEVDQLFEEYKELYTFDYGDYEEKTWEEHVKVQAQQEIGIRRFLEEGGYNAFTTNFEDLYGMKQLPGLAVQRLMAEGYGFAGEGDWKTAAIDRLLKIMARGKDTGFMEDYTYELASGQEAILESHMMEVDPTLAATKPRIVVSPLSMGDREDPARLVFDGKAGEGVVVSMADFGTHYKLLINEVEAFEPTTEAPNLPVARVLWKTKPNFHEGVHSWIQAGGGHHTVVSLNLTTDQIETWAKLVELETVVIR

SEQ ID NO: 6018 - protein, 487 aa, Enterococcus faecium
  misc_feature (B) LOCATION 1...487
  hypothetical: YES
TTTSYFRRERRMNFETVIGLEVHVELKTNSKIFSPAPAHFGAEPNSNTNVIDWGYPGVLPVMNKAALEFGMKAALALNCEISKDTHFDRKNYFYPDNPKAYQISQFDQPIGHDGWIEIEVEGKKKKIRIERVHLEEDAGKNMHGIGGYSYVDLNRQGTPLIEIVSEADMRSPEEAYAYLEALRSIIQFTEVSDVKMEEGSMRCDANISLRPYGQEEFGTKAELKNLNSLSFVKKGLAFEEKRQAKVLLSGGEIQQETRRFDETTNKTVLMRVKEGSSDYRYFPEPDIPKFVIDDEWIQKVKASLPEMPASRRERYIREFGLPEYDAMVLTLTKEMSDFFEAVLENGADAKQASNWLMGEVSAYLNSEKLELAETKLTPENLAGMIRLIADGTISSKIAKKVFRELITNGGEAQEVVEKNGWVQLSDPNKLLPIINEILDNNQQSVDDFKNGKDRAVGFLVGQIMKATKGQANPGVVNKLLKDELAKR

SEQ ID NO: 6019 - protein, 347 aa, Enterococcus faecium
  misc_feature (B) LOCATION 1...347
  hypothetical: YES
ATTRNNSETVMAFRKASGSRCDWLDDQYPFVRLYQWVSSIASFIFRKSMVVQRNDRTAFIIGIFTRHCWQLRNSIIDPYLGPLFSDCKEAETMNVLIILVGILAISVLLIGGTQGMYILLGLFINLGIFFLLLFGYHQKWPILALSVIGFLLIAVVILFFINGYNLKMRAAFVSILIFLFCFLLLLPITDFLAIQGFTSVELEELSGLDKTLAIDFRLLTRSLLLISLSGAVLDASVAISSGTFEVYQANPQLSFYQLRHSSFAIAKKILASTVMTLLFAFMGSSLALILWFIDLDIPFQQVINEKSFVLEYTMAILTTLSALLVLPLTCVTTAYLFTKKKEQLKME

SEQ ID NO: 6020 - protein, 1219 aa, Enterococcus faecium
  misc_feature (B) LOCATION 1...1219
  hypothetical: YES
STYSLAGADDPEIQSEQAKLNRLYDAFSAKYGLLNSSGNKLAFEQDSSYPLLCSLEIINEEGKLERKADMFTRRTIQTHRAVTSVDTAVEALAVSIGEKACVDLGYMASLMGGPEKIPQIVEDLKGIIFKNPATGPFDLEDGGAHWHQGWQTADEYLSGNVRAKLAIARAAAEENPQFAINAEKLEQVQPKDLTASEISVRIGASWIDPEYYQQFMFELLHTPVYLQDRKIKLQYSPTTGEWNVQGKSTDNRDNVRVYATYGTKRINAYEIFEQTLNQRDVRIFDKTEVDGKEVRVLNEKQTAIAQQKQEAMCETFKDWIFKDPERRETLCRRYNEKFNCIRPREYDGSHIRFAGMNPEISLRTHQENAVARMLYGKNSLLAHCVGAGKTFEMIAAAMEGKRLGLNQKSLFVVPNHLTEQWGGDFLRLYPGAKVLVATKRDFEPARRKKFCARIATGDYDAIIIGHSQFEKIPLSPERQKAVIKGQIDEIVTAIAEAKAEDGERYTIKQMEKTKKNLEAKLQKLADGKKKDSVVTFEELGVDRLFVDEAHGFKNLFLHTKMRNVAGIAQTDAQKSSDMFAKCRYMDEITGGRGIVFATGTPVSNSMVELYTMMRYLQFDTLEQNGHRHFDAWAADFGEKVTAMELKPEGSGFRSKTRFAKFYNLPELISIWKEAADIQTADMLNLPVPKAEYITVTTEPSGFQKEMVEELGERAESVRGGQVDPHIDNMLRITSDGRKLALDQRLQNPLLPDDPDSKVNACVKNIVQEWQASTEILGTQLVFCDLSTPKGDGSFNVYDDIKEKLIAKGIPEAGIAFIHDANTETQKAELFAKVRRGQVRVLIGSTAKMGAGTNVQNRIVASHDLDCPWRPADLEQRAGRSLRQGNMNASVKMFKYVTKGTFDAYNWGLVENKQKFIGQIMTSKSPARSAEDVDATALSYAEVKALATGDDRIREKMDLDVQVSKLKMLKANHTSQQYEMQDKALKYYPQKIAETKLLIEALTADLPTVQAHPVKDDAFSMTVMGQTYTERKAAGEAVIKACMLMDDPEKTVDLGEFRGFPMQLRCDGSKFRVTMKQNLTYSAELSDDAVGNVTRINNALESLTERLDAQKARLATLESELENAKEEADRPFPKEEELREKSARLNQLNRELSRPDKKEDEQEVEESPDLEDAGKPAPVVPMPAVAAGYKPSIRQAIRKYEPPTPVHSGMERTPRKEAVL

SEQ ID NO: 6021 - protein, 138 aa, Enterococcus faecium
  misc_feature (B) LOCATION 1...138
  hypothetical: YES
SIYSILEATIKKEFTFMGTFTPLILFWYIYPVIVLFGCQFLVKLFSLNRRFKIKAPDLAIPFLWGGMHALSRNTGTISILPFFFISVLLMGICIAVFQAYYYEEIIYPRYFKMTWRLVFLLTIVLYAVLIIVNILSYL

SEQ ID NO: 6022 - protein, 98 aa, Enterococcus faecium
  misc_feature (B) LOCATION 1...98
  hypothetical: YES
RDRLMAKGPLITRSELRKRQQAQASESLKKQRKAETAYQQEEKKIASFYRKESKKNKPITKTRISEREKTTKWNSFLMKSLIIVILMLCVVFLAIAFI

SEQ ID NO: 6023 - protein, 308 aa, Enterococcus faecium
  misc_feature (B) LOCATION 1...308
  hypothetical: YES
IKHRRILMTNLLSLFLSSASQGVLWALLAIGVYVTFRILDIADLTAEGSFPLGAGIAAVSITNGYHPLTACLLGFLGGAAAGLVSGLLHTKLKIPALLAGIITMTGLYSVTSRVMGAPNISLLGQPTIFHWVESFGITKDNAVLIVGLLFALIVVCLLVLFLRTETGLAIRATGDNLAMSEANGINTDNMKIIGYMISNGCIALSGSLLAQNNGFADLNSGIGTIVIGLASIIIAEVLLRNQPLFLRLLTVVLGAVIYRFILALVFELNVEPSDSKLASAFVLVICLSFPQIQQKFHLPQKKKGGSVK

SEQ ID NO: 6024 - protein, 77 aa, Enterococcus faecium
  misc_feature (B) LOCATION 1...77
  hypothetical: YES
WQHSPHSYQKSAGERAGKYHQNHPRCRLPIGGIIIMERKGIFIKVFSYTIIVLLLLVVVTATLFAQQFVSYFRAMEA

SEQ ID NO: 6025 - protein, 255 aa, Enterococcus faecium
  misc_feature (B) LOCATION 1...255
  hypothetical: YES
SPNRLSIHQAIILIKRCEQMKKVIVDTNFWEVFPEATIEILSVNGIDNHVTKESEETYHQLLNEAAKEARNYLTEETFSQNEVIAQWRQAFTTFKTKKGARSSIEALLKRANQEREFFPINPLVDIYNSISLSFGVPCGGEDIEKIAGNLHLGKAQGGESFLPLGADSDAPALPEEIIYYDEQGAICRCLNWREAQRTMLTEETQAAVLVIESINAEQAARGAQAIEALKEKIDQTFGVTSVRHTLTKDESEAEL

SEQ ID NO: 6026 - protein, 170 aa, Enterococcus faecium
  misc_feature (B) LOCATION 1...170
  hypothetical: YES
KENRVKEYMKVEEGQREKLKTEMERLHTYITQLSQTFYDPDKEKVMVNYPNNSEGRQLEQVYHEVFKHLLTVKKELDYYSLPIIDTGILKYDGKKERFIFKSVREDLPLSAGMDLEVLVEDYFTEEKHWVRTKLDYLPQAAGGTQASGWYITEDKELELEGVMARIRKKN

SEQ ID NO: 6027 - protein, 374 aa, Enterococcus faecium
  misc_feature (B) LOCATION 1...374
  hypothetical: YES
ELNSVLGGGVVPGSMVLIGGDPGIGKSTLLLQVSQQLAAIGGKVLYVSGEESAEQIKLRAERLGSINTEFYLYAETDMNEISRAIEHISPDYVIIDSIQTMTQPDITSVAGSVSQVRETTAELLKIAKTNGIAIFIVGHVTKEGSIAGPRMLEHMVDTVLYFEGEQHHSFRILRAVKNRFGSTNEIGIFEMHEHGLEEVANPSQIFLEERLDGATGSAIVVAMEGTRPILVEIQALVTPTMFGNAKRTTTGLDFNRVSLIMAVLEKRAGLLLQNQDAYLKAAGGVKLNEPAIDLAIAVSIASSYKEKGTQPTECFIGEIGLTGEIRRVSHIEQRVKEVQKLGFTKVYLPKNNLGNWEAPKGIEIVGVRQLWLKR

SEQ ID NO: 6028 - protein, 676 aa, Enterococcus faecium
  misc_feature (B) LOCATION 1...676
  hypothetical: YES
EVNSAVNYKISYLLKTPREISLEKAAEIIEVNTSEAIKQLTPFAEYVDDTRIRIKKFRAIDWAEKFLDITRFEAVYTEQERRDLLYLMVYSTATSVSVFHFQDFLQVSKGTVLSDIKKIRNELEVEDCQLSYTRKTGFRLLGSEAILRREAKNRTARLMQSLAGRFGLTYLTATLSIDYYAKVRDLLDKTISLSDLRFAPNRMDELAYYLSLTTIRIGKTSMELVKDAELLASLAVTDISRQVLTGLGYSEHQNSEIIFFSLCLASIVEGDVQEPALDFLLECSSEVIHRMEFLMAVEFASFRELLMNVFYHLVPAYFRISYSFYLPNVMIDQIKHQYASIYEMTRKALLPLERRIGKSIPEEEIGFFTILFGGEIRKADAEERNRKIRAVIVCPSGISSSLILKSELQQLFPMIFFTETNSADRLHEVDETSYDIIFSTVPLTLTDKKKSLYVLHPIMTDLEKNQLINQVQRDWLIPGFSMPSAQELLSALLPYIELKEGVDEEKLYQVLNRKMNKLLEKKEDQRPMLSELLTEEMIQLSDQPKNWQEAITFAAQPLLSENKIEESYIKAMIERVEQYGAFIHIGDHIALPHARPEDGVNEVGMSLLKLQQPVDLLDNPAHPISLFICLAAIDNEAHLRALANLTKLLSNKQNLQDLLHASTKEEILAIIRKGDE

SEQ ID NO: 6029 - protein, 176 aa, Enterococcus faecium
  misc_feature (B) LOCATION 1...176
  hypothetical: YES
VWNRRAIIVSVFVKLINLLDVVIKQFMIQVRRWKCMTSQVYQMSLFNPSDQWTSFAADFRAKLFQLRESGKDFPILEVLYSLKSLGSPLFSDLSFYSLRTSEDCSITKEGLRSRRSSERWMDWGMTWSGRCLTQRPTFPKAGSGYSLSDILETHVPNKYFLSLDRLQHLIKTSEIW

SEQ ID NO: 6030 - protein, 284 aa, Enterococcus faecium
  misc_feature (B) LOCATION 1...284
  hypothetical: YES
IYDRRKDGGLVMDIRFEQVDFTYQPNTPFEQRALFDINMTIKENSYTALVGHTGSGKSTLLQHLNALVKPTSGTVHIGERDIQPDTDNKNLKPIRKKVGIVFQFPEAQLFEETVAKDIAFGPKNFGVSEEEALVLAKETLEQVGLDESYLERSPFELSGGQMRRVAIAGVLAMRPEVLVLDEPTAGLDPQGRKEMMEMFWRLHKEQQITIVLVTHLMDDVANFADYVYVLEKGRIVNSGEPQEVFQNIEWLKEKQLGVPTATEFAEELMAKGMNFATLPLTAEN

SEQ ID NO: 6031 - protein, 68 aa, Enterococcus faecium
  misc_feature (B) LOCATION 1...68
  hypothetical: YES
KKDRSLLRMELYFTRHGKTQWNQERRFQGSNGDSPLLPQSYEEIKAFGKKVKYVPFKAIYSSTGKAST

SEQ ID NO: 6032 - protein, 73 aa, Enterococcus faecium
  misc_feature (B) LOCATION 1...73
  hypothetical: YES
LFCRRTIYLHKIIDAPSKSSIVLNKVEYKSLICCFNSPTSSLELTFKLIFLSSFIILSVTIFISCILFFIDFA

SEQ ID NO: 6033 - protein, 358 aa, Enterococcus faecium
  misc_feature (B) LOCATION 1...358
  hypothetical: YES
LFCRRTIYLHKIIDAPKLTGNPKNIRLFLYNLFNSTEISFVELYTLPIIIKTEKMLKDLKQYYPLSAYEKKKLFHFLAINLLAEQADSLDIASNQSLFFSDIGFYHLKGVLGEKSVIFINKTLSWLYLHDKLDQKYLRKNEDETIEWLNERFIESFENQFNLLREETSQLIRRELTKIHFKLLHYTINKADEFPLDVSFFRENYPAFYCYLIEYINDLTSKRKELLQDKFFLFFSYLLLLINHIPIQLISEPVKIIIDFSYGAAYNQFIKKNLSLYINLNTEVIEAGKPEFPDVIITNRNNLYEESASQVVVWLDPPRAVDWGNLTKILLTIQEEKYKDSKIDKQIDDFPEEIIDRIE

SEQ ID NO: 6034 - protein, 71 aa, Enterococcus faecium
  misc_feature (B) LOCATION 1...71
  hypothetical: YES
LFCRRTIYLHKIIDAPKFFCENYFYIIYMSKIYIIKEMLFDQLLFGISSKQNGKVYGATLPFCFSNTQVSL

SEQ ID NO: 6035 - protein, 107 aa, Enterococcus faecium
  misc_feature (B) LOCATION 1...107
  hypothetical: YES
LFCRRTIYLHKIIDAPKLTGNPKNIRLFLYNLFNSTEISFVELYTLPIIIKTEKMLKDLKQYYPLSAYEKKKLFHFLAINLLAEQAESLEYASNQSLIFSGYRKFTT

SEQ ID NO: 6036 - protein, 154 aa, Enterococcus faecium
  misc_feature (B) LOCATION 1...154
  hypothetical: YES
LICRKKDFDEAYLAECVWAISENAYPYGSPWTKMQFLTDIQQPHTDYLLLVEDNQICGFVGYSKVMDEVEITNIAVAVSEQGKGYARHLLHLLIAEQIKDSLHVFLEVRLSNEAARKLYESEKFRILGKRKSYYRNPTEDAIIMSRKLKTETMK

SEQ ID NO: 6037 - protein, 598 aa, Enterococcus faecium
  misc_feature (B) LOCATION 1...598
  hypothetical: YES
NTCSLFTKIVKEKIMEERIQKSYQKYHANAFQTLLHLYQGNYWRFAMSGLFFIIKHLPSWLMPIAIANVINAASSKDSSQLQAIYFNAFLMACLIGQNILTNYFHVKYHSTSIRQVEAGLRATLIKKIQELSIPYQKELQSGRIQSKIIRDVEAIQTLSSQVFVSGLNIAVNLFVALGITLYKSPVVFMFFLLTVPLAAFVTLFFRKRIRQSNSDFRQEMEETSAKVIEVIELAPIARAHGLEKHETTRLNKHFTQIYEKGFHLDILQSVFGSVSWASFQIFQLICLIFTGILALQGRIQPGDVVMYQTYFTTIVNSVSGMITLIPTISKGMESITSIGELLIAGDVETYHGKKKIQHLDGNFRFEDVSFLYPDSLKPIIDHFSLEVKAGETIAFVGPSGSGKSTLLNLLIGFIQPTSGKIFLDDQPLDELDMRSVRNYLAVVPQTTLLFSASIKENITYGLKNVSKERLDEVIEAAQLSSLIDQLPDGLDTLVGEHGNKLSGGQKQRISIARALIRQPKIILLDEATSALDNQSEKKIQQALNYLTETPTTFIVAHRLSTIKEADKIVVIDEGKIVEIGTYEKLLAQKGYFYRLKNE

SEQ ID NO: 6038 - protein, 67 aa, Enterococcus faecium
  misc_feature (B) LOCATION 1...67
  hypothetical: YES
RSCSIVLTQLDNSIRTFASFRIFQSNWFHRSEKHRFESSLCHYFNWHTSFKIFFFLKRFKFCHFGID

SEQ ID NO: 6039 - protein, 115 aa, Enterococcus faecium
  misc_feature (B) LOCATION 1...115
  hypothetical: YES
SLCSTSTISVRINRAESASGDMANAIVGKIVYTKPSHFAIGKTCNLIAKIYCNKTANTKFGMERPNIATSVEDVSAHVFCFMAEIVPKIVPRTVPKIFACNPNCKDVRLARTRGS

SEQ ID NO: 6040 - protein, 376 aa, Enterococcus faecium
  misc_feature (B) LOCATION 1...376
  hypothetical: YES
KKCRERVNKFMALTAGIVGLPNVGKSTLFNAITKAGAEAANYPFATIDPNVGMVEVPDWRLQRLTELVHPKKTVPTTFEFTDIAGIVKGASKGEGLGNQFLSHIRQVDAICHVVRCFDDDNITHVEGRVDPLEDIDTINLELVLADLESINKRYTRVAKVAKTKDKDAVAELAVLDKIKPVLEEGKSARTIEFTEEEQKIVKSLFLLTTKPILYVANVSEDDVADADANHYVQEVRNFAAEENAEVIVVSARAEEEIAELDEEDKAEFLEALGIEESGLDQLIRAAYDLLGLATYFTAGEQEVRAWTFKKGIKAPQAAGIIHSDFERGFIRAETVSFEDLDHYGNMHAAKEAGRVRLEGKDYVVQDGDVMLFRFNV

SEQ ID NO: 6041 - protein, 107 aa, Enterococcus faecium
  misc_feature (B) LOCATION 1...107
  hypothetical: YES
QKCRKRSQASGGLFDLDQLEEDIAEAEAKMAEPGFWDDSEAAQKVISENNANKETYDQFHSLAEELEEIELMVEMLQEEPDAAMQEEAETRINALDEKMKTYEYSPQ

SEQ ID NO: 6042 - protein, 113 aa, Enterococcus faecium
  misc_feature (B) LOCATION 1...113
  hypothetical: YES
CPCRDSRRKKDLSSTIFAKSLCFPNEWNEEKDKFMFSNKEKIVYIGGFYRSHQDEKMAESIIMTTEPNRTVAPIHDRMPLVLTEEQIEPWVTDISFARKIITQQMPELVMEKV

SEQ ID NO: 6043 - protein, 71 aa, Enterococcus faecium
  misc_feature (B) LOCATION 1...71
  hypothetical: YES
YTRRVFSDLRVQELKSGIRHGIMAFLEKHLAGNCRPLIGSGLNSPEYISRRWGTIKKGPRMGDCYLLPLKG

SEQ ID NO: 6044 - protein, 64 aa, Enterococcus faecium
  misc_feature (B) LOCATION 1...64
  hypothetical: YES
IFSRCSYRNRIRNFKKKRCNRLIRQKSERTNTHPLFKREVSCPSFVVGGFLNKAFQTYIPVFSF

SEQ ID NO: 6045 - protein, 77 aa, Enterococcus faecium
  misc_feature (B) LOCATION 1...77
  hypothetical: YES
GVSRRTLFAGEVVTKILSQPFCFEMKTRRKPMKFMTLNTHSWLEPEPEIKLPELADKILLEDYEVIALQENQPITGI

SEQ ID NO: 6046 - protein, 77 aa, Enterococcus faecium
  misc_feature (B) LOCATION 1...77
  hypothetical: YES
SPSSIRSMGIRTGGSGMKKTIKTEEAYIEVFDTQACNMGVHIYSNTDPDMFVEIYLSQREYKALYKILGEFAKEEKE

SEQ ID NO: 6047 - protein, 708 aa, Enterococcus faecium
  misc_feature (B) LOCATION 1...708
  hypothetical: YES
MASSLYNLALDFSKELNYTKAIMARQGDKGITVTVKPFLNGLQMDTSGGTFTLKGTTPSNRYVDNVATSVTSEEVTFSLDGTFMSEAGYYKHCYVEYRKDNQILTTQDIIFFSLGVSDISQGQADEYVSQLEELIRKYNETFDAFMAEIKGRVDSLNQQITDLTGQAKTLQDKLDALKEEISKLGNLQVMYSNSIDFGDYDYSENPNLMPYITEPWVGPLLGNGHTVKDSVKRVITHTKTRTANSGDILSLGLGIPCTAEANNRYLITTLRPSTTYTLSVTMSVGSDWTGETNTIGVRLRYLNEQGGIELPINALIPANVERDKMVTHTFTGITKDNVTSITNCYVEIFSLNSEYKGTVSVSYDVKLKAHYPNLLDGPYWLGKVPLGENIADPTVVFPHKTSEYMVYGRRNTENYIADQTYTISMKATKLTVQSFAVYIAAGRVKVGDMKPTEGLANTWELTFTVTKQHIDSGVTNYLEIYQYPSATKGAVQIEWLKLEKGNTRTPNISEYKYRGTGMRDSNNPKDYVWDLAPEYVEDNLATDIKISEITGKANNYTDGKVSEINSQLTASINEVDTTAKDAQTKANANATAIDELDNKIDERINDTATTTLTVTNGNTGSAKLYREGKTVSIYFVALNGKSSGGNDSTILTIPEGYRPPISFEQLVGSIDRSTLNSAQLSIGADGAIKWRRNSSYGSDYTFAITYTI

SEQ ID NO: 6048 - protein, 74 aa, Enterococcus faecium
  misc_feature (B) LOCATION 1...74
  hypothetical: YES
YCSSYSEAKIKEVVTKDVSQPLDKRCSKASFSVVSQIYAKMWKPMFTKFFLLLETKRLYHNLLINGVQSAVPRY

SEQ ID NO: 6049 - protein, 344 aa, Enterococcus faecium
  misc_feature (B) LOCATION 1...344
  hypothetical: YES
RRSRALSDSRIPRFCLNSNPCRTSSERISRSNRREVEWMIDAKKLRNDFPILFQDVNDEPLVYLDNAATTQKPKQVLQALAYYYEHDNANVHRGVHTLAERATHDYEQAREKVRAFIHAKETAEVLFTRGTTTSLNWVARTFGDRYIKAGDEIVLSYMEHHSNVIPWQQLAKRTGAVLKYIELTEEGFLDMEDAAKKITDKTKIVSIAHVSNVLGVFNPVQELAELVHENGGVIVVDGAQSAPHMAIDVQALDCDFFAFSGHKMCGPTGIGVLYGKRKWLEEMEPVEFGGEMIDFVELYDSTWKELPWKFEAGTPNIAGAIALGHAIDYLQKLGIDNIHRYEED

SEQ ID NO: 6050 - protein, 332 aa, Enterococcus faecium
  misc_feature (B) LOCATION 1...332
  hypothetical: YES
RWSREFFRSLRDVGISAVIVSDPALIEICATEAPGLPIHLSTQASATNFETLEFWKEEGLERVVLAREVSMEEVAEIRKNTDTEIEAFIHGAMCISYSGRCTLSNHMSMRDANRGGCSQSCRWKYGLFDMPFGQERNSLTDTGEVEEEFSMSAVDMSMIEHIPELIENGVDSFKIEGRMKSIHYVSTVSNVYKAAVDSYMEDPENYVCKQEWIDELWKVAQRELATGFYYNTPTENEQLFGERRKIPVYKFVGEVLSYDEATQIATIRQRNLFSVGDEIEFYGPGFSHFSQTVEVMHNEEGESIDRAPNPMMILTMPVAQPVKPGDMIRKRK

SEQ ID NO: 6051 - protein, 73 aa, Enterococcus faecium
  misc_feature (B) LOCATION 1...73
  hypothetical: YES
KWSSLLPWMELSIALSGAVIHLTGAIYLQYSTCLNFFSVTNRSQWQYVHPCILKWYKQGDYPSVFFQTSLELP

SEQ ID NO: 6052 - protein, 390 aa, Enterococcus faecium
  misc_feature (B) LOCATION 1...390
  hypothetical: YES
QRSRHMSSFFQKRLARHQKKMMKYMRYVLNDHFVLVCLFLIGGVGLYYSNWLKTLQPPFAIGGLIISVFWMLCLFVGKMATFAEAADIVFLLPKEKEMQTYLERAFRYSCIFPLIFLILACGLAMPLVVVSTEQSFSMFFVYLIILWSLKFSHLQIKRAELFRLDQQVIRYWKLGWFFSSLIFLFLSFYWLIWAGIAGALVQASLYYWFLWKQQEKGLDWEKMVHVEEHRLHQIYQFINLFTDVPEITAKIKRRRYLDPILTHIKRESKNTYLYLFARRLARGSDFSGLYFRLVIIGGLLIAGVVDFYFSLIIGFLFLYLIGFQLLPLANQFRYMVLVQLYPIHKNQKKQAIQYLLTWVLIIASVIFGLIAAVVLDGQQRWVPLAAYLIV

SEQ ID NO: 6053 - protein, 149 aa, Enterococcus faecium
  misc_feature (B) LOCATION 1...149
  hypothetical: YES
YFGSKEGLIYEVFFAFMNDLGQEAKALIAENLPFEETLIAMSENKIRYLNRVNKQFYIDLMTYYXKKEKKEFSDAMDAYTQESFSIMLDLFHRRRKEGKVDLKYSDEFLILYFQAMVEGISKPEIYAKLLPYTAEWTEVLIKGIAPKKI

SEQ ID NO: 6054 - protein, 347 aa, Enterococcus faecium
  misc_feature (B) LOCATION 1...347
  hypothetical: YES
KSRLYGMIKENFKRSVSRMNAFRSFQVIKEPVFHTAISDLPFTELAENEVLVKIAYSDVNYKDALAMSESGQVIRTYPMTPGIDLSGTVVQSNNPRFSKEDLVLATGFGLGVTHPGGYSQYQKVPGDWLVPLPKNMTLRQAMILGTAGFTAMLCVNALIRQGMTSDKKVVVTGASGGVGSTAIALLHKLGFQSIIAFSRKEESVTWLKSLGALQVVRPDEFLPETTKALGKQQIDYVIDTVCGEQLSSLLPLISYNGAVALCGNAGGIKLNATVLPFILRNIQLIGIDSVNVPIDQRLSLWQQMADLQIADELVVQEITLDQLPETASKLLAGTHQGRTLVNVGDHK

SEQ ID NO: 6055 - protein, 101 aa, Enterococcus faecium
  misc_feature (B) LOCATION 1...101
  hypothetical: YES
NFLRIEGKNMNYWMNTIINRLETAYQTRFDMKASLVFLNDAYQNSIELIKAVDENPTNECEEFLNLFMSTRDLFIRQLVDRYPSNYHDVEVQIQKLKAYSA

SEQ ID NO: 6056 - protein, 62 aa, Enterococcus faecium
  misc_feature (B) LOCATION 1...62
  hypothetical: YES
IVLSTLLNSLIWQLSTSEYKEILKARADYMFCAGFFLAFFFTLPKGIGGIPVYIFRRMQKGG

SEQ ID NO: 6057 - protein, 268 aa, Enterococcus faecium
  misc_feature (B) LOCATION 1...268
  hypothetical: YES
KRLRGNKRRNMMTESVYVHIDTTSNAVLTKGLTATDFANSIVHFPQNLLLLDPSASAGEYESHTGLKVIRGTENIQRFFSSSRNRRGFDELKWIDFTDLTMLKELTPLEISELLYFGHMKTHLHSPFFYKLQNNFVYFDLNDQLNRIYYRYLDEFYRIFASKLSSILSDKINVKKSFFKKETPVEKISVELLKEMRNLMQEGIIFSFDQVGLIDGKYRIPIYVIEDYIWKLKGTRYREEEIIATLIYSVTDRHWQLVEDADLSYLPLK

SEQ ID NO: 6058 - protein, 517 aa, Enterococcus faecium
  misc_feature (B) LOCATION 1...517
  hypothetical: YES
KWRLSEMTRALISVSDKTGIVAFAQGLIEQGVEIISTGGTKHALDKAGIKTLSIEEVTGFPEMMDGRVKTLHPKIHGGLLGRRDLPSHMEAMETENIQPIDFVCVNLYPFKETIMKPDVEIAEAIENIDIGGLSMLRSAAKNHEFVTSVVDPSDYEEVLSELRQYGHTSLSFRQKLAAKVFRHTAAYDALIAQYLTDWVEEKEPEKLTLTYERKQTLRYGENSHQAAAFYQSALLEKYSIAAAKQLHGKELSYNNIRDADAALRIMKEYDEPTVVALKHMNPCGIGTASTILEAWEAAYEADPVSIFGGIIVLNREVDLPTAEQMHKLFLEIIIAPSYTQEALELLQKKKNIRLLTVDFAQEENQNREETVSVLGGLLVQDQDLAIENEEEWKVVTKRKPTPAEAKALAFAWRAVKHVKSNAIVLANERQTVGIGAGQMNRVGSVKIAIEQAQEKMEGAVLASDAYFPMDDSVEYAAKHGIKAIIQPGGSIKDQDSIDMANKYDLAMVFTDVRHFRH

SEQ ID NO: 6059 - protein, 84 aa, Enterococcus faecium
  misc_feature (B) LOCATION 1...84
  hypothetical: YES
EIISERWGNMKRLGLFWLILLLVIVAFYMEPVLFPPKLEVKENSDQQISNQMTTWKYQELKATGFSTYIGKPIDQLEKDFGPSL

SEQ ID NO: 6060 - protein, 293 aa, Enterococcus faecium
  misc_feature (B) LOCATION 1...293
  hypothetical: YES
KVVRMGKVMKKRMKPLIWPIAVSSIFLLGQTAFAETSEPAQTEPSTTISSSGAENGASETEMTSNVPTDNSGETISSSEDTSINSSTSSDQIDHLQDLENKRKELEEALEAAKNKLKEDQAAIDQDLADLKNKVGNDRAQLEKKLAEAKAKAEAVQTDLDGKIQQAKEFNQQLNQVAQTASGKLSQTQADITAASQAIHGKISEAQTVANDFEAKKADLAASFQRIKDILHSAGEKSVTSGSTTETVQQTTEPSKSTSQTLPKTNEKTASVSYSLAGAGVLVAAAYGIIRKKK

SEQ ID NO: 6061 - protein, 171 aa, Enterococcus faecium
  misc_feature (B) LOCATION 1...171
  hypothetical: YES
IFSSTCHLRIKTSRINNNNNGESRKTNMLPNIGYYVQSIDQIVKETEAIGEGMHPKYEVIRNAIDEGKTSELDKSTLEEIILLFEEGTKKYRAMLMKVSTLRPPAKAMGIHKNFEKAYLSYVAGCEEMIQSIDLESGVDEDLFNTSEAKQDQATDQLTAAIQKMTNLLLKK

SEQ ID NO: 6062 - protein, 67 aa, Enterococcus faecium
  misc_feature (B) LOCATION 1...67
  hypothetical: YES
LVSRRIIMNIKDLMVKEAMIMDLQATDKKGAIDEMVQKMFDAGRISDIETYKEGILAPRSTNFYRSW

SEQ ID NO: 6063 - protein, 443 aa, Enterococcus faecium
  misc_feature (B) LOCATION 1...443
  hypothetical: YES
RNSRNIKGESYVEQIQIIDSKNHVGETVTIGAWVANKRSSGKIAFLQLRDGTAFFQGVVVKSEVPEEVFQTAKNLHQETSVLVTGEIREDSRSKFGYEIGITNVEVVSESHDYPITPKEHGTDFLMDHRHLWLRSSRQHAIMQIRNEIIRATYEFFNQHHFVKIDPPILTGSAPEGTTDLFETNYFDQKAYLSQSGQLYMEAAAMAFGKVFSFGPTFRAEKSKTRRHLIEFWMIEPEMAFTHQEESLEVQEQYVAFLVQNVLDHCEYALDVLGRDKEVLKTYTKLPFPRITYDDAIELLKKNGFDDIEWGEDFGSPHETFIANSFEQPVFILNYPKAIKPFYMKPHPTREDVVICADMIAPEGYGEIIGGSERATDYDFLLEQIRDHGLDEKEYSWYLDLRKYGSVPHSGFGLGLERTVTWIAGIDHVREAIPFPRLLNRIYP

SEQ ID NO: 6064 - protein, 229 aa, Enterococcus faecium
  misc_feature (B) LOCATION 1...229
  hypothetical: YES
KNSRKFYGYRRVTLALRWKGYTINHKTVKKLMSQMGLTCQIRIKRYKSYKGTVGKIAKNVLKRNFSVDTPNKKWVTDVTEFKIKGRKIYLSPILDLFNGEIISYSISTSPTYKLIEEMLQQAIKKKGTEGSLILHSDQGWQYQMPQYQKKLKENNIIQSMSRKGNCLDNSVIENFFGVLKSEFFYREKFRSIEIFQSKLNEYIRWYNNKRIKLKLNGLSPVEYRKQSIK

SEQ ID NO: 6065 - protein, 791 aa, Enterococcus faecium
  misc_feature (B) LOCATION 1...791
  hypothetical: YES
VSSRGSKKMLVSYKWLNRYVDLSNVTPKELADKMSVTGIEVEGVTVPEEGLKKIVVGEVKECVPHPDSDHLSICQVDIGEDELSQIVCGAPNVKVGIKVIVALPNSRIAGNVKIKKGKMRGQVSNGMICSLQEIGYSDSVIPKEYAEGIYYMPQEAVNGDPVFPYLDMDDSIIELSITPNRADALSMRGVAYEVGAIYRQTPTFDDEKLVESSRPASDKIQVEVEDKEAVPAYQIRIIEGVRIQPSPQWLQNLLMNEGIRPINNVVDVTNYILLLFGQPLHAFDYDKLKSKEIFVRRAKENETLVTLDGESRELTTDNLVITNGKEPVALAGVMGGLDSEITNETTTVALESALFDPISIRRTAKQFNLRSESSARFEKGINHATVGEASEVAAAMIVSLAGGEVLQGAVKGSEIKAEDVSVKISLERINQYLGTSLVVKEVNEIFEALGFSYEEKEYVYSVVVPPRRWDIQIEADIIEEVARIYGYDQLPSTLPSGETVAGSLSKEQETTRKIRTIFEGSGLSEAISYALTTEEKSRQFVINESNITRLDWPMSEERSVLRMNLISGLLDDISYNTARKNTEIALYEIGRVFFQENDPRTHLPQEVKHAAIAISGIWEEKDWQTKAQNVDFFTIKGLLENLFEQLGITEDVHYQTVTEMKEMHPGRTAAIYLGEKFIGFVGQVHPTITKSYDIPETYVAEFDLSAIVEAAQKGIVFEAVTKFPAVSRDIALLVKETVTNQELTEVIRSAAGRFLTDIQLFDVYQGENIEKGHKSMAYSLTFVQPRSNIDR

SEQ ID NO: 6066 - protein, 410 aa, Enterococcus faecium
  misc_feature (B) LOCATION 1...410
  hypothetical: YES
LFSSTGRNGTMPKIKNIYQDKKTKKWFFRAYLGIDENGRKVQKTKRGYASQKDAKIAYDKYMETHDFNKTIPNQLCSTNQMTFEEFYKDRFVKWYERQVKSQTYENAQFIFEKRMQFFYHFRVRDITSHDIEDWLFELSQTESRNSRKKVNGETLSKSYINRIRGHLKIVLDRAVKEGVIAKNPVEDVSSLPSENKKVEFWEHSEFQKVMNELKDDKIQTHHRKIVYEMLFYTGIRIGELEALSWSNVDFEKNTITIEKTLIYNTKDDWYFSTPKTKCAYRTIGLGKKLSLKLRQWYDLQKRIGNFEYVAQLDGTFTPPYSFANWLKEAAKKAGVKPIKLHALRHSHVAFLIEQNIQPLSIQERLGHANIQITLGTYGHLYAKSDQQVVSAIDNVQEGAILSKNDNLLPV

SEQ ID NO: 6067 - protein, 534 aa, Enterococcus faecium
  misc_feature (B) LOCATION 1...534
  hypothetical: YES
VVSRREIMIIQAISIKKTIGGNPLFEDLSCQIEAGEKIALVGINGTGKSTFLQILTGREGVDSGVISRKKGLKIGTVEQELTVSEATVNHYLLHSAAEIQDLKQQMSRYEALMTEPDTNLEKCLARYGELQHRFEELGGYVLEDRIAAILQGLGIPHRQEARLTELSGGERVKVALAKILAADADLLLLDEPTNHLDLNSIRWLENYLQNTKKSVLVVSHDRQFLDQVTTKTWELEEGALIEYPGNYSRFRVLKEARLAELTKNYELQQKEVQRLKVMIRRFRQWAHEGDNESFFKKAKELERRLAKLTLVKPPPPPKNRLQSLSNGGKSGKEVFIIQNLHQQYADQVLFKDSSFAVYRGDHLAIIGDNGAGKSTLLKLLLGEEKPYGGTIKLGSSLQIGYLPQQLQFADPDSRLLAYAITLTGNEEVARRQLAKSGFYQSDVGKRIKDLSGGEKIRLALLKLFLEKINVLILDEPTNHLDSYAREEIEEMLQDYQGTLLAVSHDRYFLQQHFQEALVIDQEQISRQPLGQLID

SEQ ID NO: 6068 - protein, 96 aa, Enterococcus faecium
  misc_feature (B) LOCATION 1...96
  hypothetical: YES
ISSRYTAHNKKKKGNAEAFPFSDLMKTTRFDLEPFYLNSFSLYPTSFDHLITRLNTFDMSINETFINYGCLFLTAFLANANPPIIPALSPNSGVIM

SEQ ID NO: 6069 - protein, 96 aa, Enterococcus faecium
  misc_feature (B) LOCATION 1...96
  hypothetical: YES
NCSRNDGSLKFNFWRKYMVRKVLLSMDSKNIDAYRRYRFAKQMRLNGSTLADIAATLHVSIDTVHRVLKRDPDCCFIKVNTGRSRRLAKRHNSLAN

SEQ ID NO: 6070 - protein, 205 aa, Enterococcus faecium
  misc_feature (B) LOCATION 1...205
  hypothetical: YES
TKSRRNSIMNLIPTVIEQSSRGERAYDIYSRLLKDRIIMLSGQVTDDLANSIIAQLLFLDAQDSEKDIYLYINSPGGSVTAGMAIYDTMNFVKADVQTIVMGMAASMGSFLLTAGTKGKRFALPNAEIMIHQPLGGAQGQATEIEIAARHILQTRERLNKILAERTGQPLEVIEKDTDRDNYMTAEQAKAYGLIDEVMENSSSLN

SEQ ID NO: 6071 - protein, 382 aa, Enterococcus faecium
  misc_feature (B) LOCATION 1...382
  hypothetical: YES
AGSRYKGERNMKIANFGVEEWLNKWEKKAVYDIAQSSIEALTLDELVGLDGTSVSKFFEKRKNEPLDYGWIEGSDVFKQEVASLYQTVDPENILQTNGATGANLLALYALVEAGDHVVSMLPTYQQLYDIPKSLGAAVDFVHLKEEEDWQFDLEQLEALVKPETKIICLNSANNPTGTLLDRKTLEKIAEIARTVDAYVLIDEVYAPLTDKGEFLSIVDVYEKGIATNSLSKTYSIPGIRIGWTATGPELAEVFRKYRDYTMICGGVLSDDLAVHALKNKEKILARNKKIITENLVILKQWVANEPKVELVAPNYVSTSFIKLAIEEDDQTFCINLLEETGVLLVPGSAFDLPKHARLGYCCKKETLEKGLFLLSEFLKKQA

SEQ ID NO: 6072 - protein, 132 aa, Enterococcus faecium
  misc_feature (B) LOCATION 1...132
  hypothetical: YES
TTSRIIGCAINMARIARVNIPRDKRVVVSLTYIYGIGNTTAKKILADAGVSEDVRVRELTNEQTDAIRAEVDKLKVEGDLRREVNLNIKRLMEIGSYRGIRHRRGLPVRGQNTKNNARTRKGPARAIAGKKK

SEQ ID NO: 6073 - protein, 418 aa, Enterococcus faecium
  misc_feature (B) LOCATION 1...418
  hypothetical: YES
IRSRTSLEAKNMKIGFFTDTYFPQVSGVATSIKTLKQELERHGHEVYIFTTTDPNADKLEKDVIRMPSVPFISFKDRRVVVRGMWYAYLVAKELELDLIHTHTEFGAGILGKMVAKKLKIPLIHTYHTMYEDYLHYIGKGKVIRQSHVKYLSRLFANHTTGVVCPSERVIDTLRSYGVIAPLRVIPTGIDIEKFKRSDITQQDISKLRESLGLQENHLMILSLSRISYEKNIQALINGFPQVISAYPNARLVIVGKGPYVEELEELISELQLEEFVQFTGEVDNNDVALYYKAADYFVSASTSETQGLTYTEAMAAGTPCVVEGNAYLNRLFDHPSLGKTFETDEDFAPALIDYISSEVPKDPKVLEAKLYDISSTHFGEAMIEFYQDMVVYHEEEMRRKEEEDSIERIKIKLNSFKR

SEQ ID NO: 6074 - protein, 180 aa, Enterococcus faecium
  misc_feature (B) LOCATION 1...180
  hypothetical: YES
KNGLKIMSEEVGIILREAVPGDAKDILLMMGQVNKETEFLVLDEAELLLPPETLEEELDYIYESNNNLLLLAIYEGTIIGTASVKADSQFRLSHVGEVGISILQEYWGMGLGTLMLEEIISWAKEMGVLFRLELDVQVRNERAVHLYRKMGFQIEAVMPRGARTDLGEFLDVYKMSYLIE

SEQ ID NO: 6075 - protein, 453 aa, Enterococcus faecium
  misc_feature (B) LOCATION 1...453
  hypothetical: YES
KITRGLDKKMKFEQNFSQKQQQTQKLAMTQQLQQSIQVLQYNSEELLAFVENQAMENPLVEVVEPEWQPDYIKASSSSYEGEETNYLNQIPDTKGSLFDSLIEQVHLNYRDTFLRKIVLYLVEYIDLNGFLTISLEEAGKEIGATPIQMLDALTLIQQLEPAGVGARSLQECLMLQTERDDYAPELAYIVLEECFEELVERKWKEIAQRFSVDLHAVQQIFDYLQTLSPSPGRIFDRSSEFNIIPDVRVLVDDDKNVQVISNRKNQPNIRFQESYFKQMSQQADKETENYLKERKQEFEWLKKTILQRGDTILRVAQVIVSRQKAFFIDKERPIKPLTLKEVATEIDVHESTVSRAVNGKYLETDFGVFELKKFFTTRIPTNSTEQTEDLSADTAKKKLQELVDQEDKNKPLSDQKLVELLKKDEIAISRRTVAKYRDLLGIPSSSKRKRYDN

SEQ ID NO: 6076 - protein, 220 aa, Enterococcus faecium
  misc_feature (B) LOCATION 1...220
  hypothetical: YES
EETRMKIAPSILSADFANLQRDIELVEKGGADYIHVDVMDGQFVPNITLGPNIVQAIRPVTKLPLDVHLMIVDPENYIPAFAKAGADIITVHVEATPHIHRALQMTKSLGVKAGVVINPGTPVSMIKHVLPLADQVLVMTVNPGFGGQSFIEETVEKITELADLRRENNWTYAIEVDGGIVPETAKICKDAGADVFVAGSYIYGAENPVGQIERLKEALD

SEQ ID NO: 6077 - protein, 605 aa, Enterococcus faecium
  misc_feature (B) LOCATION 1...605
  hypothetical: YES
TSASDYCHLRGFSCMFITKRRCKQMDLNKRQLQILVVLRNKNHWITSEELAEALGTNKKTIQTEIKNMLAIYEKKIIIQSNKRSGYFLESIESETKQQIIQEVTKHKIYSSMDFRASTIVTYLLFQKGYVSMQKIADIFFLSKTAVSLQIKTILRWIERNPKLELEVSSTKGLKIIAEENSKRIFLSLVGTETVIQHARFPQQISTIFSNIMPTVQKTLKEVLISYNYIVSGEDFIRFSRYLVLTILRREELLEKTNRYTLFIPMVETLTKKLSSELPYSFSNQEKQAIENRLLELNYLMINDEKNKEIEKNLRAFEQTIIRFLDLPVSLLFHETEFLLTHIKQMKTRMDAGHNTMNHFVQKIISRYPLEIYLIRRFFPIHFQLRPNLAESAYFVLYLAEALNPFRKQGEILIVSNQPISILNTLKKQIQQSMNMWIKECRIEPVYLFKNQSNKITEYDAILTTEQELIFEWDDLIYLPSVLDEFESWEIYQILREKLTIVEEKKKTKLLDHYYKEENQIKIHKKIDSIQQLISPSSDLVMLPLNAETLLCCLIKSQVETKITEYQLEIPLIHQQRKIKRVFFVSFDYKRNDILVFFQAVSDLLG

SEQ ID NO: 6078 - protein, 216 aa, Enterococcus faecium
  misc_feature (B) LOCATION 1...216
  hypothetical: YES
TDASCLRYRGNNRLQAALYKQMQNLLSPPGKCGYSGGEPMRKSMGITVFGCEQDEANAFRTLSPDFHIIPTLISDAISADNAKLAAGNQCISVGHKSEVSEATILALRKVGVKYISTRSIGCNHIDTTAAERMGISVGTVAYSPDSVADYALMLMLMAIRGAKSTIHAVAQQNFRLDCVRGKELRDMTVGVIGTGHIWQAVVKMLRGFGCRVLAYG

SEQ ID NO: 6079 - protein, 235 aa, Enterococcus faecium
  misc_feature (B) LOCATION 1...235
  hypothetical: YES
RGARNMKDFQLGAATYLKSVAIRVKDRDKMIDFYKNVVGFDLKREENELAILGTEEAGSEMLLLEESPRANDHMGVIKKLNRFSLIIPSTEEMADILCRIRKMNYPIKEALEDHGRMGILVVDPEENELEIYHEENKNDQREIPETMDQEALLRKSEEKFSKLSTGSYFEKIHLNVTNLTKERQFLNHVLGLKVHNEEEGIHVLNERDFHFGSTDPKXEMCNAPRRFTLGSAPRH

SEQ ID NO: 6080 - protein, 379 aa, Enterococcus faecium
  misc_feature (B) LOCATION 1...379
  hypothetical: YES
GGARMKEKNWLDYLDAVNDFSLSKGEPDWMRTFRQDALAKADELPLPHIDRVKFHRWSLFDVKETQTISETGTIPAFDAMKDNPVLVQQGSWTIFEQLPVELAEKGVIFTDLFTAMIEYPELVQEYYMKKAVNMNEDQLTALHVAFMNSGIFLYVPKNVVIDEPLESLFIQDGASDEHFFKHVLIVADEHSEFSYLERFQTTKEQVAKSSGNIIVEVIAKAGSKIKYSAVDQLGENITSYMNRRGHILRDASVDWAIGVMNDGHVIADFDSDLAGEGAHAEVKIVAISSGRQIQGIDTRVTNKAPHTIGHILQHGVIREKGTLTFNGIGHILKGAKGADAQQESRVLMLSDKARGDANRILLIDDKRSNCWTCCQCRTS

SEQ ID NO: 6081 - protein, 108 aa, Enterococcus faecium
  misc_feature (B) LOCATION 1...108
  hypothetical: YES
LLARSRIAKIEQTKKDKKISKNKTKFFKAEDVKRIAWSVKTFDEDRYVKVSMNGLFVQLGNFSNFKTIDELYPEIRNIVDSKGLIVAKRKSRNSGLAYCKNKGIMIPA

SEQ ID NO: 6082 - protein, 137 aa, Enterococcus faecium
  misc_feature (B) LOCATION 1...137
  hypothetical: YES
EEASSMKEPDTNANYEPDELEETNADQDTGQESSSFYDIKEKASMNLSQLLEDLQAFEKAVREEDIPEIYRLYNGRLNEELKRSSNENHEIDQLLMRKIHDRFLQEFPFMEQVENISPTMSYYKIGTYYHDRPTVRY

SEQ ID NO: 6083 - protein, 321 aa, Enterococcus faecium
  misc_feature (B) LOCATION 1...321
  hypothetical: YES
SYQRRATIDQPNQSWYELSIYKKRRKIKMSKINLENLTTERRNQETFGLDEMSISQAVQLMNKEDQKVAAAVEKELTSIEPVIANTIESFKKGGRLIYMGAGTSGRLGVLDAAECVPTFGVEPEMVIGLIAGGEEAMTVAVEGAEDSYELGQEDLIKLNLTKNDIVIGIAASGRTPYVIGGLDYAKSIGAVTGTISCNKQAEISKHADFPIEVDAGPEFLTGSTRLKSGTAQKLILNMISTISMIGIGKVFNNLMVDVKPTNEKLIERSKRIIMQATEADYETAEKYFEEADQNVKLAIVMILTNSDKEEAQAKLSEASAF

SEQ ID NO: 6084 - protein, 373 aa, Enterococcus faecium
  misc_feature (B) LOCATION 1...373
  hypothetical: YES
INQRTLVIKKKREKEMFENKKIKINVSDFQKVSAVTAVMMQTILSFALANSHSATNTAFLGTFYVIVKYTAPMFIFAIVYNMVKTSQHLSYWEFLKEKFFELVVPYLLWTTAYLWLFPAVQQQTPYTDTASFLLKYVTGDGAPHLWYTVMMLQIQLFMPFFVWLGYKVFANKKYVWPVLIGSTILYVAWYLFYQTQVLTGPYHDSWYLLDRFVASFMIYGVAAFVYHEKVYQYLDRVRYLFLPVALVIAFFSVRSLLAHPGDLSFANAPYLNTIQSLYSLVIIFAVFIGASKMIVNDSPKLPLFKWLSVYAYRTYLANVFVFQVLLLLFKDSWLQLPSGVMILVAYLMTASCAFALSWLLHIIWVAIKKGFSK

SEQ ID NO: 6085 - protein, 120 aa, Enterococcus faecium
  misc_feature (B) LOCATION 1...120
  hypothetical: YES
SCQSNQKKIANHLDRKFTQTKALSAVVTDLTYVRVGTNWAYICLMIDLFNREIIGHSCGNKKDAQLVKRAIQSIPYSLQEIELFHTDRGKEFDNQTIQNLMNGLVIKFLSTVCMKKLDVC

SEQ ID NO: 6086 - protein, 589 aa, Enterococcus faecium
  misc_feature (B) LOCATION 1...589
  hypothetical: YES
MAQRTIYCGLVSEQQLEQTVTLKGWVQKRRDLGGVIFIDLRDREGIVQIVFNPEINKEAWEIADKCRSEYVIEVTGEVRRRGENAVNPKMATGEFEVIASEIVILNQAKTPPFQIEDDQAISDEIRLKYRYLDLRRPKMTKNIKLRNATTKAIRHYLDDNDFLDIETPYLGKSTPEGARDYLVPSRVHAGHFYALPQSPQLFKQLLMNAGFDRYYQIVRCFRDEDLRGDRQPEFTQVDIETTFLTAEEIQTYTEGLIAKVMKEVRGIEVTLPFPRMTYDEAMARYGSDKPDTRFDMELIDLSDTVKEVEFKVFQMALENGGVVKALNAKGAADRYSRKDMDQLGQYVGQFGAKGLAWLKVEEDGLKGPIAKFMGEATEAIIKATDAKPGDLLMFGADKSEIVAAALGAIRTRLGKELGLIDESKFNFLWVTDWPQFEFSEEEGRYVSAHHPFTMPKEEDIPLLAEDPAKVYAEAYDIVLNGYELGGGSIRIHTRELQEKVLETLGFTKEQMEEQFGFLLTALDYGFPPHGGIALGLDRFAMLLAGEDNIREVIAFPKNGKAADVMSDAPSMVSPLQLFELNIDVTNIEE

SEQ ID NO: 6087 - protein, 60 aa, Enterococcus faecium
  misc_feature (B) LOCATION 1...60
  hypothetical: YES
RKQRLISYLLEECFPVEENNPSSSLVVSILFCYALFLTFTPPITKGTIKSNNKQKEYRND

SEQ ID NO: 6088 - protein, 280 aa, Enterococcus faecium
  misc_feature (B) LOCATION 1...280
  hypothetical: YES
EEQSQTKIDFYVKGVIHMLKKERQEQIITLLEKDFYLTNSEIANKLGVSEMTIRRDVTELAKKNKVKKLYGGVERKEPYNRELSTQEKIDTNVAEKKYIGQVMNSMIPDNSTIYVGAGTTILYALPFIQKKNLFVITNSLIAFNYLKNHTSYRILLTGGEFSPITEEFIGEVAERSFESLNVDISFAATNGIFDNNVTTAQFIEGNIQNAALNAAKIKCIVADYSKLNKSDVYTFRKLTDFDYLITDNHLSEQDFNHYSKYLTILKEPKNDTDNHDEPIH

SEQ ID NO: 6089 - protein, 65 aa, Enterococcus faecium
  misc_feature (B) LOCATION 1...65
  hypothetical: YES
PMQSRLDKLIVVILDGCRYDTAVAQLGFMNHLVEHQQASLLKVKSELPSNSRPLYEVLMTGVPSL

SEQ ID NO: 6090 - protein, 478 aa, Enterococcus faecium
  misc_feature (B) LOCATION 1...478
  hypothetical: YES
HTQRSRCECRTDCCSFNAENSGGGKMSNTLKVAKFGGTSMSHEEQFKKVRTIVLSDPNRQVIVVSALGKRTSDDDKVTDLLYLIYAYLQHHVDWTPLWKRICDRFIQVRDVLALQLPIEDELARIQKQLEDEKITEDYLVSRGEYLTAQLMAEYLGYQFIDAKDLIFFDYDGKIDQEKTAQEITKAFKRYPKMVVPGFYGANPAGKEKLLGRGGSDITGAILAKMLQAESYENWTDVSGIMMADPRIIDHPKIIEEISFRELREMAYMGANVLHEAAVFPVQEADIPIQIKNTNDPFAQGTKISNHEIEKENGLTGIAGRKDFLSITLFKRHMSDEIGFIWKAMSIFAKHEISIEHIPSGIDNIGVIVSAEAIADKLFLITKELKETLGVEEIVVIEDLALISVVGGPHKELIGLSGKVLSILNKLEIRTSILSQGAQELNLIIGVPNNQYETVVKGIYEGMVNTDAERISNGTPSNS

SEQ ID NO: 6091 - protein, 232 aa, Enterococcus faecium
  misc_feature (B) LOCATION 1...232
  hypothetical: YES
EKQRFFSWRTRIMKRSYKTVAVILLIVLLASIGLFFRKTPQKIQVCGEERDSWNLLLVNAKHKIPQGYTVELQKLSNDQAVDKRIYPDLQLMLDAARAEGIYPKIVSSFRTTEDQEKIMEDKIAAFQEKGYSNQKAKEEAAKWVAAPGTSEHELGLAVDINAESSISTDKEVYEWLADNAYQYGFILRYPSNKVHITGVGYEPWHYRYVGKKAAKKITEAGITLEEYLGKTE

SEQ ID NO: 6092 - protein, 158 aa, Enterococcus faecium
  misc_feature (B) LOCATION 1...158
  hypothetical: YES
LGQRNSYTKIYILSCFLHRAIYTNEDALVIKKEQGFTGTETKSLFLKDKKDNNYVYLTFTTKQTDFKALGKIVGKRLSIVSSERMEEQTGQKQGAVSPFGYEKQIPIIIDEELLSNEKLVFAPGRPDQTMVIQTVDLNKIIQLLEMPIFLMPANEKNN

SEQ ID NO: 6093 - protein, 71 aa, Enterococcus faecium
  misc_feature (B) LOCATION 1...71
  hypothetical: YES
TTKRGRRVFYEHKDRYGSPGITQKLYDEGIEINKRVVAVLMREMNLCTRGFHRRKSSHGREKTIKEMVKKC

SEQ ID NO: 6094 - protein, 641 aa, Enterococcus faecium
  misc_feature (B) LOCATION 1...641
  hypothetical: YES
ENKRRNKRLEHYEADAYDVIVVGAGHAGSEAALAAARMGSKTLLLTINLDMVAFMPCNPSVGGPAKGVVVREIDALGGEMGKNIDKTYIQMRMLNTGKGPAVRALRAQADKHAYSTEMKHTIEKEPNLTLRQGIVEELIVEDGVCHGVVTSTGASYRAKAVVITAGTALRGEIIIGELKYSSGPNNSQPSIGLANHLKELGFAIERFKTGTPPRVKSSTIDYSVTEEQPGDKEPNHFSFSTPDSAYKLDQESCWLTYTGETTHQIIRDNLHRAPMFTGIVEGVGARYCPSIEDKIVRFADKPRHQLFLEPEGLNTEEVYVQGLSTSLPEDVQVNMLHSIAGLEKVEMMRTGYAIEYDVVEPHQLRPTLETKVVENLYTAGQTNGTSGYEEAAGQGLIAGINAALKVQGKEPLVIKRSDGYIGVMIDDLVTKGTNEPYRLLTSRAEYRLLLRHDNADLRLTEMGHRVGLVKEDQYKNYLKKKEAVEQEIKRLMNVRIKPTEEVQDFLATINAAPLKDGVLASDFLRRPEITYAELLRFIPENEELTRKEIEQVEVQIKYEGYIKKAMEKVEKLKRMEAKKIPENIDYAAINGLATEAKQKLQKIQPETIAQASRISGVNPADLSILMVYIEQGKIAKVSEPA

SEQ ID NO: 6095 - protein, 89 aa, Enterococcus faecium
  misc_feature (B) LOCATION 1...89
  hypothetical: YES
RDKSLVVTASLHGIQKPVSRYSYKKRGCDKILVAAPYFLMQDSFFTTSSLNGVLLPTPRPQVTIFIKHEKLFFEIVPCGSELNGRLKTS

SEQ ID NO: 6096 - protein, 133 aa, Enterococcus faecium
  misc_feature (B) LOCATION 1...133
  hypothetical: YES
LSKRKRRDESMKMAHTCVRVKDLEASIEFYQKAFGFEESRRRDFPENKFTLVYLTLPGDDYELELTYNYDHGAYDLGDGYGHIAIAADDLEKLHEQHKAAGLEITDLKGLPGTAPSYYFVIDPDGYKIEVIRG

SEQ ID NO: 6097 - protein, 291 aa, Enterococcus faecium
  misc_feature (B) LOCATION 1...291
  hypothetical: YES
IIKSEVYMMKSNFLGYVIAINMFKGGVGKSTLTQLMADILSARGFKVLVIDVDPQGTVTKKFQRQYDLKVVGKMTLFEAVINMSFLDCISPVKENLDIVLGSEQMSRFTKVLRDMWRSTGFTDEGEEVFWNLFNYMIGNDNLRDQYDFILFDTIPTVSEFTDNVYVASDFLVIPTQTEQDSIDNLHSTVTNYQTAVKEVNGDLEILGIVPYLVDTKLKTGLELLSELQEEYGDLVYSHIVSERGVIKRWGREGLNKSIPHSKTAYSMYVDIVEETLVRLEKATGENILERV

SEQ ID NO: 6098 - protein, 100 aa, Enterococcus faecium
  misc_feature (B) LOCATION 1...100
  hypothetical: YES
TIKSTILRGGKLKIDYLELINEIASYKTGEEIEILRDVYEQLDEAGIERIKNDRSSWSKLRYYFALYIDATQLRNLAYTKLLFADCVKGLQKHLSELEQV

SEQ ID NO: 6099 - protein, 100 aa, Enterococcus faecium
  misc_feature (B) LOCATION 1...100
  hypothetical: YES
TIKSTILRGGKMKIDYLELINEIANYKKGEELDVLRDVYDQLEEAGIEGIKNDRSSWSKLRYYFALYIDTTQLRNLAYTKLLFVDCVKGLQKHLNELEQV

SEQ ID NO: 6100 - protein, 66 aa, Enterococcus faecium
  misc_feature (B) LOCATION 1...66
  hypothetical: YES
VSKSLYKIEKTYNETALKVIFGSFNIFIFSCIKIYHNKNNKKMSGKSNIKVSDLNIPAAEEEKQNR

SEQ ID NO: 6101 - protein, 901 aa, Enterococcus faecium
  misc_feature (B) LOCATION 1...901
  hypothetical: YES
ASKSNLERREEILTESINWRKLNVQWLKYKWPIIVSLIIILFMAYPQRVFALPWITDNKEVLKFLTKYQDYLQFTKGGFGSIVVQSLSWGLIRGAYFVCKSAENLVPQSLSLFSFVESSSLGAVYQSVLNTVVVGLMILSLMFVGYKMITGKGTVDLKSVGMNVVMSIALILLMPTMISSGIQFAKTFYKDSTTITKADGGVAWSLIEDGVTDLVYINKNDAYDRLGKDGVQKNALKEKNFFSYDFSEVITVDTAKDLEDDNKKAEYLQSRLTPDGEGNMQAVKIDDGWMSMFSDSFKGGYYRFTKNTFALTLGLLSLAVAYVFSIFIIVTAILELAFKRVLGVLVFATDIETGQRSKVVLSDILQCYLTVGFQGFGLSMFAMFVSYLGTGGGSSVNPFIKAVAYVCAVFVLIKGSGTVMRYFGVDIGLKEGYGQLASAFGMGAMLFRKGSNGFNRAKGSGNGNGSDSGEGEDRKPEKNFGETLSKKAGKTGRALGYAHERGLSGLASDGATMASERATKPFKSMRDMANDTKNKFKEGLDDGTVSAINKNSKPMLAKNKEDETGKYADSMPTRLSDRKDGAKVENADRIMSSSERMREAMKNNAESNNNPVSAIQQKVQQDIEERKNAMHGQAKSAEELINQKRQEAKYTPEAMNREEMLRKRVEGRTGTNTDEKEALTKERIQEAKNSNTGLEKLVKENLQNSTSSQGGRSVDVRENIQGSLNGHVGRNVDVRENLQSSSNGQGTKTIGVRENLQSSSTSQPKTVDVRENVQNSTSSQGFKSVDVRENVQGSSASQPKTVDVRENVQSSTSSQGFKTVDVRENVQKDSGEMKEKTQKINIVEDRKSAKKFDSNHETVIIDSEIRENDKGSKPRRRFTYEDNELFRDTLNDPNPLFDNLN

SEQ ID NO: 6102 - protein, 383 aa, Enterococcus faecium
  misc_feature (B) LOCATION 1...383
  hypothetical: YES
KRGLAHMNDRSEKFRNLLVPVLSVVLGLILGAILMAAFGFQPIQGYSSMLDAALGSQRGIGETLRQATPLIFTALGFSVANSAGFFNIGLSGQALCGWIVSVWVALAFPDLPKVVLLPLCVILGALAGAMAAAVPGLLRAFFGTSEVIVTIMMNYILLYVSTFALHEVMPESYRSSLDSSNMISQNASLRLPWLTQAFGGSRVNSGLFLAIIALIFVWLLMKKTTLGFEIRSVGLNPFASEYAGMSSKRTIVLSMVISGALAGLGGVVEGLGTYQNFFVQTTSLSIGFDGMAVSLLGSGSAIGILLSAILFSILKIGGLGMQTGAGVPFEIVNVSIALIIFFVGINFLIRFVMAKVFQGKKQEEIVATIESKPTNQNHEGGEL

SEQ ID NO: 6103 - protein, 130 aa, Enterococcus faecium
  misc_feature (B) LOCATION 1...130
  hypothetical: YES
KRGLLMNIDGIYNESDFKKGIVDIDRKEYLFPDEIGLFKIVGETVCRYWGKKGNIILLVDTIEGRKLKFSFWSNTKYCCEPVPKREVDVAKESVRFLPDRSKITLICERTSNAKFTRIRDILLSTTSSQS

SEQ ID NO: 6104 - protein, 113 aa, Enterococcus faecium
  misc_feature (B) LOCATION 1...113
  hypothetical: YES
LLKSKGIISMKVVFHIDELEKWSETGKNVKNLIKASPETTIVVSVNGIAITGYLDSANAEFLDLQGVVFHACANAMRANHISESSLPEQVIVVPAGVLDLVELQSQGYAYIKP

SEQ ID NO: 6105 - protein, 478 aa, Enterococcus faecium
  misc_feature (B) LOCATION 1...478
  hypothetical: YES
RLKRKKRLRQNSGQPTPALLSLFFGFFHMIQNKKGSVKMAQKTTTATAVEEKKKEGFWSTKITGVSLPLYLIMVLVLIIAMALGKLPTNMIGPIAVLVIFGNLFHFIGTKIPIVKSYLGGGSVFAIFASAAIATFGILPEYVVKSTENFVSNMGFWDFYIAALITGSILGMNRNLLMKASVRFIPVALISMVVSFFAVGLVGMLIGNGFANSVLYISLPAMAGGVGAGAVPLSTIYANVLGTDASSIISRLIPATAMTNVLAIIGAALVARAGQSMPKFNGNGKLMEKGDLGDGKPRTVKPSIPQLGVGLMVSLTFFILGQIGNYFVPKVHAYAFMIIIVVICKIANLLPEYYEDAAIMFNNLIVKNLTAAVLAGIGIALLNLNVLASALTWQFVVLCLTSVIAISVVSGFVGRLFGLYPIESTITAGLCNNSMGGTGNVAVLSAANRMELIAFAQMGNRLGGAIVLIISGFLMQLLS

SEQ ID NO: 6106 - protein, 452 aa, Enterococcus faecium
  misc_feature (B) LOCATION 1...452
  hypothetical: YES
IIKRFERGEKMIGEDKLLMTIQLTDLNEEEKKQEISDWAILTRLLIQPTFIRSFTQQADPYDLRKLQEKIMLASVRDESWLVVGNDENECSFRLEDNQLLIKNVLSISVFKEKQFLIRDFIQKKMIAHGVFAYMRAYSEFIYHNTKQISQRLLFEKKDEIEHLPKMKQQNGEVVVDCNQFPGYDLFYQGLCFTSCWEMYYSRYYHQIIPKPIFLDIQQVEKVKELENEVICIQLYRDPFNWQKPNNQMFQSYFRDQLGFDHLAWDNGVGLLKPPFVEYIYTDHTIQSVQYQNAQMQPVPKKNASFFVTKSYDIQQGDYKERRVRGTLNAQAYFPWVDENRSRMMCYKVIDPTVALDNGIEAYCYYIREYLEVEVTDEKYQEYLLSLRIYVPSESLSELPLKEIKHRLSDVTFKRIKKKRRSIQFDVKKGEQHLRVQFLDYRELEQLITLQKI

SEQ ID NO: 6107 - protein, 263 aa, Enterococcus faecium
  misc_feature (B) LOCATION 1...263
  hypothetical: YES
EIKREETREMIDLHCHILPGIDDGAENLDASIAMAEKAIQQGITHILCTPHHNNGKYSNEKSQVISLVASLQAELEKRQLPLTLLEGQEVRITGTLIEDIHRDEILFTDLDDTYLLIEFPTLEVSLYAERLFFELLQLGKTPVIVHPERNAHFRKDPNHLLPFLDMGCLAQLTAPSYVGVFGKDIQKTAKTMVKHNLVQMAASDAHGVSKRTFYLKECYEQIAKDFGKEKVAQMKQVAKDLINGDEISYPVYEEVKKKKFGLF

SEQ ID NO: 6108 - protein, 76 aa, Enterococcus faecium
  misc_feature (B) LOCATION 1...76
  hypothetical: YES
RIKRVGYGKCFSSRPFCFKGNKNKKKEGIIMFKRVHLIVMDSVGIGEAPDADKFGDVGSDTLGHIAKEAGLNVPLL

SEQ ID NO: 6109 - protein, 63 aa, Enterococcus faecium
  misc_feature (B) LOCATION 1...63
  hypothetical: YES
SSKRAFATYNFDIIFGKIIHGSRNFMYNKQSYEDDSKEELFCQETNNTQAKTKKKPVRQLQQI

SEQ ID NO: 6110 - protein, 598 aa, Enterococcus faecium
  misc_feature (B) LOCATION 1...598
  hypothetical: YES
NSKRNGGVSMTDLIKASKFFYHYLKRYKLSFFFIFITVIIATYLQVKAPQYIGEAFQELANYVGGLMQGVDDKSKFVSVIWKLLLFYVLASAANFIYSILFTQVVGKSTNRMRIGLFNKLEKLTIRFFDSHQDGEILSRFTSDLDNIQNSLNQALLQVITNAVLLVGILIMMFRQNVELAWATIASTPVAVLIAVLIIRKARKYVDLQQDEVGKLNGYMDEKISGQRVIITNGLQEETIEGFLEHNQSVREATFKGQAYSGLLFPMMQGMSLVNTAIVIFFGGWLALNGDLERSVALGLVVTFVQYSQQYYQPLMQISSGYSMIQLAITGARRLNEIFDEKDEVKPENGKAFDGVEKGLALQHVDFGYSPEKLVLKDVSINVDKGEMVALVGPTGSGKTTIMNLLNRFYDVNDGSVVIDGIDIRDYDLDALRRHVGIVLQESVLFSGTIKDNITFGKPDASDEEVINAAKQANIHDFIMTLEKGYDTEISEENNLFSTGQKQLISIARTIITNPSLLILDEATSNVDTVTEARIQKAMDEAIKGRTSFVIAHRLKTILNADRIVVLRDGEVIEEGSHHELLAENGFYAELYHNQFVFE

SEQ ID NO: 6111 - protein, 151 aa, Enterococcus faecium
  misc_feature (B) LOCATION 1...151
  hypothetical: YES
KSKRKGCRFMKKAVIICALGIGFVGGNAMSSEVEANSVHGEIYYKSLKPGEIHFDAKGNIIKSNLPVDREISRTAINHSSGRWVYYSDTTCTRKTGHSNHYSRVYNRHGAKAKVGNSIRSANATKGVWAYASATGNRTDTFSCWYNPTGWY

SEQ ID NO: 6112 - protein, 511 aa, Enterococcus faecium
  misc_feature (B) LOCATION 1...511
  hypothetical: YES
MKKSRLEYSLINSSISMFIYILRIVIQFVGRSFFIYFLGAKYLGLNGLFTNILSFLSLAELGIGSSIIYSLYKPLAQKDESKVKALMNLYKKTYEFIGIFIGIVGVLIIPLLPLFIKNSTDIPHMYRYYVLFLLNSVLSYFFTYKRSLAIADQKNYLVAINDFAFLFFMNIVQVIALYFYSNFTLFLIVQILFTLFSNINISRTVDKRYSYLKEKDVVSLDKQTKDEVKKNVIGNMSSKIGGVIVMGTDNILISTFVNLTAVGIYSNYSLIVTSVQNLCKQITNSITASVGNFAVSNKKKDSFELFKKHFFINHSLIFFSSILLLTLMNPFISLWVGAKYMLPMSTTILIVLNYSVQVYRNTSFVFIESFGLYWSQRKKPIIEAGVNLLLSLLLLIVFDMGINGVLIGTIGSSLGFVIWYEAFIIYKTVFEKRFIHFFLTFWRSFIELIISAIVVFLLNEYLANGGSTFLQFITKTLITIVTTSILYLLLYFRREEFTFIKKILFRYILKK

SEQ ID NO: 6113 - protein, 303 aa, Enterococcus faecium
  misc_feature (B) LOCATION 1...303
  hypothetical: YES
MKKRFLALAIVLGTGLLSGCTNAGEKTAVSYKGGTISEQEVMDSLKKMQGADSAVQQLIVYQVFEDKYGDDVSTKEIDSQYDQTKKQLGDSFDSQLKSAGYTEQTFKDSIKQSLAFQEGLKKHIKLTDEDLKTAWESFHPEVEAQIIQVASEDDAKDVKKAADKGDDFSKLAKDKSTDTTTKEDGGKVKFDSTTTTVPAEVKEAAFKLKDGQVSDVITSTNASTYTTEYYVVKMVKNQNKGNDMDKYKKELKEIATDTKLSDSTFQNKVIGEVLKDANVKIKDKDFENVLSTFTSDSSTASSK

SEQ ID NO: 6114 - protein, 414 aa, Enterococcus faecium
  misc_feature (B) LOCATION 1...414
  hypothetical: YES
KKKRRKFLMVKFIHAADLHMDRSFEGLTTLDKTVQEKLLKTNLTVLSNIIEQAIINNVDFVLLAGDNFHQNRPSLKIQKHFSEQMKRLEKNHIPVFIIFGNHDFYQKERYWFSFPKNVHLFTSETVETKKITIKSGETVSLSGFSYRQPWIQKDKVMEFPSRELTDYHIGLYHGEPGVSQKGNYAPFQPSKMQEKGYDYWALGHIHVPTVLNEKQTIVYPGAPQGHTKKEQASTSILLVELSKGSCQIHPIKVAEVYWKTKEISLRKARTTKEVIVHIRQQLSKVEDGFSLIEIKLKDYDHLNTDVLERIQSGELLDYLLEEFSDRINDFFIWRISLIENTFYTKTPLAASAKLMEQLFQYYQTPQDFQQILNEVYSHQEAARILSELPEYQEETLEKAKQLLNQDFLFEEDQE

SEQ ID NO: 6115 - protein, 491 aa, Enterococcus faecium
  misc_feature (B) LOCATION 1...491
  hypothetical: YES
REKREVNQMKKSLKLASAVILMSQLLIATPFHVLASENSTYKIAKERTETTEMSNSDVTAESSELLTTSSSESSTTSNAESSTTSSSESSTTSNAESSTTSSSESSTTSNAESSTTSSSESSTISSTESSTTSSSTSEITSSKVTKPNHIESSKKEAPKTEGQTKTFSTPQQIESTESFQSQPILSGNEEIHFDKNESVENFIMKIGESARKIGQKYDLYASVMIAQAILESASGQSQLAQAPNYNLFGIKGTYNGNFVIMVTNEDLGNGTLYTTQSKFRVYENYEESFEDYAKLLTKGISGNKDFYAGALKANSKTYREATKFLTGRYATDTQYYLKLNELIKTYDLTNYDKEVKGPQMSKTGYQVPIHNYSITSLFGNRGNEFHRGLDMAATQGEPIHAVKAGKVVKAEFHYSWGNYVVIQHEDGSTALYAHQQQYLVKTGDNVLQGQIIGYVGSTGNSTGPHLHLEICKDSSLSQSMLVDPKTLLFGD

SEQ ID NO: 6116 - protein, 76 aa, Enterococcus faecium
  misc_feature (B) LOCATION 1...76
  hypothetical: YES
LRKRCDPKRFSKFATRNELLSLLSRSANTPNCRLVDRHERKPFVYVKFTTEGRTRYIFTRTCSNAHLIPYFSAPGS

SEQ ID NO: 6117 - protein, 472 aa, Enterococcus faecium
  misc_feature (B) LOCATION 1...472
  hypothetical: YES
KRKRGALMKKYQFPANFWWGSAASGPQTEGRISGDGKGENIFDYWYKKEPQKFFDQVGPEKTSQVYTKYQEDVQLMKQTGHNSFRTSIQWSRLIPDESGTINEEAVRFYHRYFDELIENGIEPFVNLYHFDMPMYLQEKGGWLNRETVEAYEKYAKSCFELFGSKVKKWFTHNEPIVPVEAGYLYRWHYPEESDMKKAIQVGYHEALASALAIKSYHEMEQGGVIGIILNLTPSYPRDESNPEDVKAAQIADAFFNRSFLDPAVKGEFPSELIEIVKELDLMPVIHAEDLTVIKENTVDLLGINYYQPRRVKAKETPIDTKNGPMPEDYFDNYEMPGRKMNPYRGWEIYEQGIYDILINVRDHYGNIDCFISENGMGVENEARFIKEDGMIHDDYRIEFVQSHLKYVHQAIQEGANCLGYHMWTCMDNWSWTNAYKNRYGFISVDLAQDGKRTIKKSGHWFKDVSDKNGFEA

SEQ ID NO: 6118 - protein, 145 aa, Enterococcus faecium
  misc_feature (B) LOCATION 1...145
  hypothetical: YES
SGKRRTKMSLKEFAEKSLLKPWDVFIILLLTVLSFLPVMIFGLQQNTATAEKEAVLRVDGTEIKTFPLMAGEESNTYTYKDEHGDYNLIEIDGDRVRIKEADCDDQICVRRGWATKNGETIVCLPHKLVIEVRSTDGGDEDSLIY

SEQ ID NO: 6119 - protein, 73 aa, Enterococcus faecium
  misc_feature (B) LOCATION 1...73
  hypothetical: YES
GGKRMKIYVVKFGNKFYRSDERSIGANKLSIVDILQSARWFDSLEEANQVSRRLGGLTQVYELVTVDHEEVER

SEQ ID NO: 6120 - protein, 70 aa, Enterococcus faecium
  misc_feature (B) LOCATION 1...70
  hypothetical: YES
NLKSYFLFCFSNTRIRTLISHSLFLTSYLVHEVLANEGLLSIIQSLHKLELSVLLFVHHQLKSSYEHSIC

SEQ ID NO: 6121 - protein, 147 aa, Enterococcus faecium
  misc_feature (B) LOCATION 1...147
  hypothetical: YES
VMKSFDRNDPIQAKHYRQVKALSRLLIKRQDTLVYDKWTKWRNFGWAYLTESEVVERLLSTSDELRIAYAYYQEILQAFYDKEADIFFQLVKTMPKSVPRELHHIKKAFINYESGIRLALELPYSNGKIENLHTHIKALKRIAYGLG

SEQ ID NO: 6122 - protein, 96 aa, Enterococcus faecium
  misc_feature (B) LOCATION 1...96
  hypothetical: YES
HVKRKKACYTQFKKGESRKNMPISFVKDREEKGKCVREILLDLPEWFGLPESTEKYIEESSKLPLWCEKRKEEYLGFITLSQTSEDTAEIYSIVWE

SEQ ID NO: 6123 - protein, 324 aa, Enterococcus faecium
  misc_feature (B) LOCATION 1...324
  hypothetical: YES
KTKSRELRYSFMYKNEENFMSNVIIKATNDQLSQMKAYYRSYLLNKQIPYTSFAAKKDGTTITAYTSGKVMFQGTNAAIEADKWGEAQDKQAKPAKTASSLPKNISQLSVLGSDEVGNGSYFGPLTVCAAYVKRDQLAELRKLGVRDSKELKDSQIIQLADILKKTIPYKLLVLSPEKYNEIQPKYNAVRMKVALHNQAIHLLLKKIEPEKPEAILIDQFTPEANFKKYARLEKNQLQEKLYFVTKGEQYHLAVAAASIISRASFLEELHKASAEAGITLPSGAGTKSDQVAAKLLEKGGMPMLEKYAKLHFANTEKALKLLKK

SEQ ID NO: 6124 - protein, 208 aa, Enterococcus faecium
  misc_feature (B) LOCATION 1...208
  hypothetical: YES
KQKRGNKMTYIFEKGTSGKHLILLHGTGGDEHSLLDIAHFLAPNSTLLSFRGTVQEDGMNRFFKRNGLNQFDLDSLEKETDKLHEKIKEISEKELIPLSDWLLVGYSNGANIAAHLLLERETELNKGLFFHPMSLGVHQSRSTLEDKTVWISYGDNDPIVSPASFKELADQFETRQANVTIQLTVTGHQLTMDEIKQAREWTDHLLTK

SEQ ID NO: 6125 - protein, 307 aa, Enterococcus faecium
  misc_feature (B) LOCATION 1...307
  hypothetical: YES
SWKSSSYIDSIVHHYCSGRLALTKEGGLEMKNKKSRKILFYATILLLLAVNLFPFLIMLMTSFKDSQEAIATTQTIFPKEWTFEHYQDIFNAEIFPFIMYFKNSLVISLIASVTAVVIGISGAYALSKLRFKARSKINASFYTVYMFSGILIVVPLFKIISGLGLYDTNTALIITMVVQTLPTAIFMLKSYFDTIPTDIEEAAMIDGLSRIQIIIRIIIPLAISGIISVFVYCFMVSWNDYLFASIFLSTSEKFTLPIGLNTLFSTPDYIWGRMMAASLVTALPVIIMYALSERFIKGDLVEGGVKG

SEQ ID NO: 6126 - protein, 1179 aa, Enterococcus faecium
  misc_feature (B) LOCATION 1...1179
  hypothetical: YES
RRKSMSLQFILGNGKKDHRQVLIDEASAWLDQDASNQVFFLVPNYSKFEQEQEILAEMRRRSGKKTFSTTNVQVFSFYRLAWYLLQQTTLLTGNELSESGSAMILRQILEKNEEELTIFRGEINKRGFIRQLQELYSELRTGNIQPEDLMLLFGDSPNAEDQQLKMKDLKLIFSAYDSELTQRALTNEDALSILANYMQTQDFNNVKFIVSGFSRINGQEYQLLQAMMEKGQLVVDLLLDRPYTADLPEVLTLFHETGKLYFRLFQSARERKVPILVDRFAPEQTRPTELQLLQTMWEETSSQKKAAVHKIGGQEHLHLWEAENPTEEVRQLAVEIRRLVSEENYRYRDIQVLTKNMSLYGNILRPIFQEMAIPFYIDEEQMMENHPLIEWINSLFALDRYSYRLSDIMRFFKTELFLSTEAETELDEWKQERDEFRKKLDITENVALAYNYQGTYWTREKDWQFVAYDFEAEQIEDVQYLEEQSNTIRRLFQKAVPVFLKKIKKSKTGQEAANVFYQFLIQSGVQQQLLFWRNQEVDRGNLEAARNHEQTWGALIDLLDEYVVIYGESAFDWSLFQEIITSGLENLSYGKIPTAIDQVRINRLELVRPNQAAVTFALGLNDQVFPDRKETKGLLSSEEREVLNQALPDGQFLFDPSKESISFEPFQAYLVFLSGTDRLYLSYAQSYDTDGSLKMSPYLRRITEYLSVPVERKEHLTIESDPNCYVGTYRSGINTVNRIYRLALDEKKPVPKHWQKLKELVLNSSWRNFALQIFESQEHLNVPVSMPEKMAEELYGKEIYTSISRMENFYNCEYKYFMQFGLKLKERTVYGLTPAATGDFYHESLDRFFKLLFSNQLSLVNMSDAQRRDFTEKVLQEVFGELRFEILDSSARMNYIRYQLGQTIQKVTWALQKQSKNTGMHPLQTEILFGQIAGAKGITGLELPLSNGGKLHVRGKIDRIDVASEQEDTWLSVVDYKSSGRSFDVTEAYYGMAMQLLTYLDVALMDAVRLTGKAAVKPAGSYYLHVHNPVLTETDDVEKNTLKKFSYDGVFVDDPALLEVLDHSLEAKEQSLIYPVKKNAKDEYQKGSFSKDKFFTEEELQLFMAHNRENMRLAGDAITSGEIKLNPAYKDKQRIACEFCPFRSICTFDVMLKENNYHRLEKIDKEEALRRILKRSEEE

SEQ ID NO: 6127 - protein, 275 aa, Enterococcus faecium
  misc_feature (B) LOCATION 1...275
  hypothetical: YES
RRKSMSLQFILGNGKKDHRQVLIDEASAWLLQSLVFQELRKLMESKIPNRTVEYLDSRISRYSMKSGKCEITKQFLPAKAVHCHHYLPKSLGGDDKFDNLRIIHKDIHLLIHTTNKMIIDHYVHELKLVPEQIAKINLYRQMCNLLYLHLIINKLNAAPRGGSPLPLWSGGGRKKKNXLLPPPPLNFLKKKKRGENLKKPPHQTRKFGVRQPWLSFLKFWGLPKRAGSAKYFRENGIPRNNSTFPVGFVGPYELKLGIFHERLGGGSKKNFSYET

SEQ ID NO: 6128 - protein, 153 aa, Enterococcus faecium
  misc_feature (B) LOCATION 1...153
  hypothetical: YES
FVERKRDLIRRYTARNPMEKRSMRDYTQLNGLALAYVGDAIYEIYVRDHLIDQGETKPNKLHRAATNYVSANAQAFLIQQMLEEHLLTEEEELYYRRGRNAKSHTSAKNADVTTYRVATGFEALMGYLHLTKQTERMEELIRWCIQKVGEKNG

SEQ ID NO: 6129 - protein, 72 aa, Enterococcus faecium
  misc_feature (B) LOCATION 1...72
  hypothetical: YES
SVERAKAIRKNQARTSRNSSKKKTRGRYFLVKNKLVCESYKNNFQKNEKIFSFSLTNDLMEGKLRTSQLFTQ

SEQ ID NO: 6130 - protein, 108 aa, Enterococcus faecium
  misc_feature (B) LOCATION 1...108
  hypothetical: YES
ANERKRYLGIWYCYWFYWNCVLSLVCDRNNMSKQDKNYSEETDLVLKNHLKDTRRELGLSQQQLADMIGVSRNTIGSIERCVFVPTAKLALILCIALDKKFEELFYFD

SEQ ID NO: 6131 - protein, 161 aa, Enterococcus faecium
  misc_feature (B) LOCATION 1...161
  hypothetical: YES
KNERMNKMKKLIIVVTSLIAMIVILVGCSNEKNKQTNQDNGVLKSGTMWKEEVGGLVYNLKIIDETTWEYSESVWHPDPVQITVKRQKDYKGLERYKIVDSASVREFINKSDSLFIVVPYEKNGVKKIIFLGSSKDEKRTKEKLIHDGSQSNKYKLQKTSE

SEQ ID NO: 6132 - protein, 121 aa, Enterococcus faecium
  misc_feature (B) LOCATION 1...121
  hypothetical: YES
DCERRRNMTEEFYRWLLQLTREDRLVKFYQSPKWRRLREKAMKRDHYECQECRRLGKYHRVENVHHIKEVKDRPDLALDLDNLICLCVEHHNEVHGRYLTALDKQEKKIESFANFDASERW

SEQ ID NO: 6133 - protein, 696 aa, Enterococcus faecium
  misc_feature (B) LOCATION 1...696
  hypothetical: YES
KAERNFMKQLILAEKPSVAKDLSKVLGANQKHKNYYEGPKVIVTWALGHLLGLKMPEDLNKEWQSWQMDTLPMIPKKLGIKPLPKTGHQLKAIKQLAQRKDVSEAVIATDAGREGELVARWILEYVHFNKPVKRLWISSQTDKAIKTGFKQLRPAKEYDALYESALARAKADWLVGLNVTRALTVKYADNLSAGRVQTPTLALVRDQEKKIEQFRPQTYFTITLQAGKEQAKMLQKNQFALKTQEEAQKLVQLISTSKGTVTEVQEKLKTESAPLPYDLTEIQREANQRYGYSAKKTLSLVQSLYETHKIVTYPRTDSKYLTNDMKSTMKERLQAVSDFAPEVKQYLKNGAIVQQTKVFQDSKVTDHHALLPTENRARYEKLSNEERKIYQMIVSRFLGLFAQPHKVSQTKVTVEFGKERFIFRQNRVVQAGWKGETETETETVKWEKGMRINPDFAIKKELSAPPKPLSEASLLGQMEKYSLGTPATRAEIIEKLIKSELMERTPQGLQVSPKGKQLLVLVNPSLVTPDLTESWEKDLEAIAAGKKQAGTFLNGIEKETKRLVNEIKSSKQEYQDFSITQKKCPECGANLREKNTRDGKIYVCTNSDCNYRRRKDPKVSNHRCPQCHRKMEIIEGKNGAYFRCKYDGTTEKLLDKKEQKKKMTKHEERRLLKKYAQAEEPEESPLAAALKAAMKK

SEQ ID NO: 6134 - protein, 223 aa, Enterococcus faecium
  misc_feature (B) LOCATION 1...223
  hypothetical: YES
YKESLYDNYKKESNMKIVFLHGLGQDEQSWKDVISYLPNSYSCKSLSLFNHLNSTDTATLDDLTKYIEVQLNQIKEPFILCGLSLGAVIALNYLATPSPYLKKVVLVAPQFESPNRLLLTFQNIYFYCVPSKIFEKLGLSKKQTLTLLRSLETLDCKKQLRTSRLPKLILCGTKDHANKPAAKRLYKLSTNGRLLFIKNGKHELNREKPEIMAQAMRSFIENS

SEQ ID NO: 6135 - protein, 322 aa, Enterococcus faecium
  misc_feature (B) LOCATION 1...322
  hypothetical: YES
FRESPKRRYTLRYYFVDEEKNVIETDEKKYNWLVLDSAKPEEIEQAIEEFELPDDIFVGTEYPEEVSRMERLYETKLEHPFSLVVINLDQSDNRIEKKLTPISFVLSDNLLITCIDRKTEFVDRLLTKHGNHLNSFEKIITYTLLDIYTHYVKELREMKKRIDALDKAARKTTENEELYKQADLERDIVYIDHTLRDQRETMDQLWNSETFIKRLDDEQLLYDVHLRQRQTEKMIEIYRDLLESIGDLFNGMMDNNLNHIMKYLDSAALIISVPALFAGIWGMNTGGLPGKSSALGFILVVFGSLIAAVVLGYHLYRKDYTN

SEQ ID NO: 6136 - protein, 285 aa, Enterococcus faecium
  misc_feature (B) LOCATION 1...285
  hypothetical: YES
TRERKYKMIGLIYFVVIVLANTVGAISGMGGGVLIKPILDLIGAHSVAGISFYSTVAVFTMSIVSTVRQVSSGKSLNWQIVGWVSSGAVVGGVVGNIVFEVFLQLFENEKHVQLIQIFLTVLTLVFAFFYTKHHQPKFHLTSWTWYLICGGVLGFLASFLGIGGGPVNVSLLMLMFALPIKEATLYSLSTIFFSQLAKLVTIALTSSFMRFDLSMLFYVIPAAVIGGLWGARFSRVLSPKKVTFIFQVIVLVVLLVNCYNAFVILQTLGESRLTQVKITETYCSK

SEQ ID NO: 6137 - protein, 75 aa, Enterococcus faecium
  misc_feature (B) LOCATION 1...75
  hypothetical: YES
FQESIQKRFIVSNGSMSIFDKRKKREIGDRRADLFLTIQYSKSSKVRKKSIPFIRIVTVWPGKTRIEKNRVHECL

SEQ ID NO: 6138 - protein, 211 aa, Enterococcus faecium
  misc_feature (B) LOCATION 1...211
  hypothetical: YES
NRESDRQRKTSCGVYRRRTMRIAVFASGNGSNFQALADYLSKKGLESSIDWLFCDQPEAYVLKRATALSVPADCFSPKEFDSKKEYEEAILHKLKEKKIDLIVLAGYMRIIGPVLLKNYDKRIINIHPSLLPAFPGLHGIRDAFEAGVKETGVTIHYIDQGVDTGPIIRQEKVRIEQEDTFDSLEEKIHRVEHRIYPEVISEIIENGGYLK

SEQ ID NO: 6139 - protein, 71 aa, Enterococcus faecium
  misc_feature (B) LOCATION 1...71
  hypothetical: YES
PNRSGVIGNINNFNVIFLLTVNGPTNSNFYGAGSTDLLVTWLYLTVTKIDYNLASVIGILIFIYMQKFIYY

SEQ ID NO: 6140 - protein, 95 aa, Enterococcus faecium
  misc_feature (B) LOCATION 1...95
  hypothetical: YES
TSRRATYTAVCSVLFPNGDFPSRSRFTRLSSNLAYTINIIRCYFIKKLTLGEVXGMIDTFPSPLCKPFTNRSAPLLNPIANVGYISTKKSYLDGS

SEQ ID NO: 6141 - protein, 277 aa, Enterococcus faecium
  misc_feature (B) LOCATION 1...277
  hypothetical: YES
QLRRIGGTRMKTMRRIYSVPYILWLGLFVIAPVLMIIYQSFFDMNGQFTLNNYLSYFTSGTSLSMTINSVWYAFLITFFTLIISYPTAYFLTKLKHKQLWLMLIILPTWVNLLLKAYAFIGIFSVHGSVNHFFDFIGIGPKQILFTDFSFLFVATYIEIPFMIMPIFNALEEMNPSLISASRDLGANSFETFRRVIFPLSLNGVKSGVQAVFIPSLSLFMLTRLIGGNRVITLGTAIEQHFLVTQNWGMGSTIGVILIIAMFIVMLLTGEKKKGGRS

SEQ ID NO: 6142 - protein, 69 aa, Enterococcus faecium
  misc_feature (B) LOCATION 1...69
  hypothetical: YES
NFRRIWIYSRKCREYVQSTIIDPSNCLTDKNSCLQVGDSCSLCVRRINQYYFSFSAMLHLNDKTKNSSD

SEQ ID NO: 6143 - protein, 240 aa, Enterococcus faecium
  misc_feature (B) LOCATION 1...240
  hypothetical: YES
LSRRSEAMNHLDLSQRLAAVGDFVPESARLADIGSDHAYLPVALILRGKIEYAVAGEVVQGPYESARKQVKKDGLEDRITVRLANGLDAIQPQDGITAVTIAGMGGSLIRDILEAGKLNQRLSGQERLILQPNIGERTLRSWLQENQYKIQSEKILEENKKIYEIIVAEKEQKPVTYNEMELMFGPFLLEEKSEIFKSKWTRELQQRKAIREQLKQAANQEARQKQIEQEIQMIEEVLKP

SEQ ID NO: 6144 - protein, 258 aa, Enterococcus faecium
  misc_feature (B) LOCATION 1...258
  hypothetical: YES
KDRRPLEKSEQRNLKDWNQLLNFLAAPEEGNFEELTAPTLILAGNCLPILADKAAQMYLNGQVNQLFLVRRVGHATRILYENFEKQRFHFEDGMSESEICRQYLKEIYDLADKAFLIESKSTNSGETHHFFTGDSPSLRAVPEKILLMNDPTLQRRTRATFEKVWQNEHTIFANAVPFVPEILHFSEEIIFTAKELNHQWPKEYFHALVLGEMERLHDDENGYGPKGKDFIPHIDISEEVWSSYTRIKESIKTDFSRT

SEQ ID NO: 6145 - protein, 324 aa, Enterococcus faecium
  misc_feature (B) LOCATION 1...324
  hypothetical: YES
MGRRLRGKRMEQAYLDLGRKLLEEGHRKEDRTGTGTLSLFGYQMRFDLQKGFPLLTTKRVPFGLIKSELLWFLKGDTNIRYLLQNKNHIWDEWAFERYIKSPDYNGPDMTDFGHRCLTDPEFNEEYKKQSKLFCEKILTDDSFAETYGDLGHIYGYQWRHWETKDGGFIDQIKQVIEAIKKTPDSRRLIVSAWNPEDVPSMALPPCHTMFQFYVQEGRLSCQLYQRSGDVFLGVPFNIASYALLTHLIAHETGLAVGEFVHTLGDAHLYINHIEQMKEQLSREIRAFPTLVLNQEKQSVFDFEMEDIQLEGYDPHPAIKAPIAV

SEQ ID NO: 6146 - protein, 99 aa, Enterococcus faecium
  misc_feature (B) LOCATION 1...99
  hypothetical: YES
NTRSWTADSSICYGGTSYSDGHSRRRWSVGNRVISSLYDGSTWEVFRKLLGRRRVWTRPRNHHHTFSRRNSRLSDIYENCYREGSTLKKQRFINCKKKE

SEQ ID NO: 6147 - protein, 112 aa, Enterococcus faecium
  misc_feature (B) LOCATION 1...112
  hypothetical: YES
LKRRSDTFLSGMIEKWKKNYPKVTQSLIENQDLLTFYDFPPSIRRTIYSTNLIESFNKQIKRYSRRKEQFQNEESLERFLVSIFDTYNQKFLNRSHKGFQQVTDTLVSMFTE

SEQ ID NO: 6148 - protein, 417 aa, Enterococcus faecium
  misc_feature (B) LOCATION 1...417
  hypothetical: YES
SKRRRQHNMDKPIHVFSEIGKLKTVLLKRPGQEVENLTPDIMDRLLFDDIPYLPIAQEEHDNFAKTLQNEGVETLYLEKLAAEAIDAGNVKEQFLNKMLDESHIASNAVRDGLHEFLLSMETQEMVDKIMAGVRTKDIEVRSSSLYDLSADDDYPFYMDPMPNLYFTRDPSASMGNGMTVNKMTFEARRRESMFTEYILKHHPRFANKGIEVWLDRENPDHIEGGDELILSDKVVAVGISQRTNAKALEKLARHLFAKNSGFEKVLAIKIPNNRAMMHLDTVFTMVDHDKFTIHPAIQSKDGKMDVFTIEPDGDDIKITHSDNLHETMKAALGLDDLVLIPTGNGDEIVAPREQWNDGSNTLAIAPGVVVTYNRNYVSNELLRSYGIKVLEINSSELSRGRGGPRCMSQPLVREDLK

SEQ ID NO: 6149 - protein, 274 aa, Enterococcus faecium
  misc_feature (B) LOCATION 1...274
  hypothetical: YES
EKRRRGSHMSDWLDIAGKVVIVTGGSSGIGRSIVENLLKQNAQVANFDVTECRIQHENLLSLKVDVSSKTDIEEGIYKVMKHFKTIDGLVNNAGINIPSLLIDRNHPKSKYELSEQVFDKMIAVNQKSVYLMSQAVGRILVQKGSGVIVNLSSESGLEGSEGQSCYAATKAAMNSFTRSWAKELGKRNVRVVGVAPGILEETGLRTQEYEEALSYTRGISVEQLRNGYSRTSTIPLGRSGKLQEVADLVCYYLSERSSYITGVTTNISGGKTRG

SEQ ID NO: 6150 - protein, 348 aa, Enterococcus faecium
  misc_feature (B) LOCATION 1...348
  hypothetical: YES
KRRRRKQMKKKITITAMSLLTALFLLPINTFAYTINDEYNLAPNQGDSRLAIPNKIILHETGIDAPARNVAANMKNNYNGSNSYTTDVIGDGGIVYRVGEQGYVSWGAGNANPYAPVQIELQRTYDKALFEKNYRAYIEYTRDSAKKYGIPLTLDQGTSLFTKGIISHLWVTNYVWGNHTDPYGYLSQMGVSKEKLAYDLAHGFTDENPTTSENKPVIDPTRAGAANPTLTDGTNHAHIDQFGEIENANLHVAGWHIANYKYEYIFIMDYNTGKELARVRADGIYRPDVNQAYNTSGNVGYHVSFNMRNFPSKKVYVMMRATNDPEGNTKGGAQDFHDKRWYLNIPKR

SEQ ID NO: 6151 - protein, 618 aa, Enterococcus faecium
  misc_feature (B) LOCATION 1...618
  hypothetical: YES
KRRSLVYFRGECRVFVLTRRRKIITLILVDSLLLIAANSAAVNFMEPFVAIPIDLILISSGLSIVFYLLYGSFFKVFTRINRYTNLREMIAIFGSLSASAASSIIVLLFINKQYSLRLVIFAYLLSLLLIIGSRLIWRIYIETKNMRYLSTDSAKNTLIVGAGEGGRILYNSFLGSKTAQDIHVVGFVDDDPNKRNTYLSGKKVLGSLKDIPELIEKYDIQMVTIAIPSLSRKKLRRVFELVESAHVKVNTMPSMEELASGKISVSKLKTIDVVDLLGRDEVELDIESIKDQITNKVILVTGAGGSIGSEICRQITQFDPAKLLLLGHGENSIYLIDRELRTHHQKCPTEIVPIIADIQDRKKINEIMEQYHPDIVYHAAAHKHVPLMEYNPKEAVKNNIFGTKNVAEAAKAARVKNFVMVSTDKANNPPNVMGSTKRIAEMIVTGLNEEGCTKFSAVRFGNVLGSRGSVIPVFREQIAQGGPVTVTDFRMTRYFMTIPEASRLVIQSGALAKGGEIFILDMSEPVKIVDLAKNMIRLSGYSEDEIEIIETGIRPGEKLYEELLLDKERNDEAVYEKIFVGNIKGYSMQTVMDFVNSLPQDDEQLAKEIVTFANASNK

SEQ ID NO: 6152 - protein, 273 aa, Enterococcus faecium
  misc_feature (B) LOCATION 1...273
  hypothetical: YES
GRRSKMKKYNWNETNVFTMPKEKEIALYTDDLHVWYGDNEAIEGVDLEFEKNKITALIGPSGCGKSTYLRSLNRMNDGIANTKITGKIMYQGVDINAPRVDVYDMRKRIGMVLQRPNPFSKSIYDYITFALKQHGEKNDKKLDEIVETSLKQAALWDQVKDSLDKSALALSGGQQQRLCIARAIAMKPDILLLDEPASALDPISTGTVEETLVNLKEDYTIIIVTHNMQQAARISDYTAFFYLGKVMEYDKTNKIFTRPKIQATEDYVSGHFG

SEQ ID NO: 6153 - protein, 125 aa, Enterococcus faecium
  misc_feature (B) LOCATION 1...125
  hypothetical: YES
QVRRRRYVHMYEESELSYFKGGLAVGIGLGLLSGVASTIWYHRKKVLSADQVLENIKSSFLKEGAIEGSWISFEKEPIRKFAVRSSAYRGGLSRIEDGETVYYEFLADAHTGTVLEISRKKGATD

SEQ ID NO: 6154 - protein, 289 aa, Enterococcus faecium
  misc_feature (B) LOCATION 1...289
  hypothetical: YES
SQRRKAKWGRSVKKANLVFQGKLTPAQSRNPKKNELYLVEGDSAGGSAKQGRDRKFQAILPLRGKVINTEKAKMQDILKNEEINTMIYTIGAGVGPEFSIEDCNYDKVIIMTDADTDGAHIQVLLLTFFYRYMKPLIEAGKVYIALPPLYKVSKGQGKKQVIEYAWTDDELAAMIKKVGKGYMLQRYKGLGEMNAEQLWETTMDPTSRTLIRVRIDDAAQAERRVTTLMGDKVEPRRKWIENHVQFTLEEDGSILDKKEDTEISPSVSNDLLDEERADKNENNQLFEVE

SEQ ID NO: 6155 - protein, 88 aa, Enterococcus faecium
  misc_feature (B) LOCATION 1...88
  hypothetical: YES
AWRSKQIPTITKKMLTQQLRELEQDESIHRKAYNQVPPKVEYSLTEEGKSLREILVALSVWEEERIEKQKASREEDTLLHTHGGYLNY

SEQ ID NO: 6156 - protein, 160 aa, Enterococcus faecium
  misc_feature (B) LOCATION 1...160
  hypothetical: YES
DHGSNCQGLPLKSWSEFMRVMGLDVGSKTVGVAISDPFGWTAQGVEIIRINEAEEEFGFDRLKELVAQYEVDRFVVGLPKNMNNSIGPRAEASMSYGEKIKELFSLPVDYQDERLTTVQAERMLVEQANTSRAKRKKVIDKLAAVMILQNYLDGSGKQLF

SEQ ID NO: 6157 - protein, 97 aa, Enterococcus faecium
  misc_feature (B) LOCATION 1...97
  hypothetical: YES
LPGSGIKPNSAPKLVKGKTEPTIIPNVMITNMANVALLWINGTFGVRSAWSTKVCVHSESNKHPAWNNAMKITRCELSNVWKLRPTTAGQITKYINK

SEQ ID NO: 6158 - protein, 418 aa, Enterococcus faecium
  misc_feature (B) LOCATION 1...418
  hypothetical: YES
KKGSPFCRIELPQHIHRKEDFHMNDFTTEILKTLANKGDLNELFRVHLEKAVNTLLKTELTAFLDYEKYDRIGFNTGNSRNGSYDRTVKTEYGELHLQIPRDRNGEFKQQTVPAYRRTNDTLEETVIHLFRKGITMSEIADLIEKMYGHHYTPQTMSNMTKSFTEEVTSFKERELHDRYAAIYMDATYIPLKRKTVAKEAIHIAVGIRPDGSKEVLSYAIAPTESITIWEEILIDLQERGVKNVLLFITDGLKGMAGAVQRFYPKARFQRCCVHVSRNISHKVRVDDRKEICDDFKMVYQASSKKAALEARGAFAEKWKTSYPKMVESILSNDYLLTFYDFPLAIRKSIYSTNLIESFNKQIKKYSHRKEQFQNEESMERFLVSSFDTYNQKFLGRSHKGFQQAEGELEQMLSQPMEN

SEQ ID NO: 6159 - protein, 416 aa, Enterococcus faecium
  misc_feature (B) LOCATION 1...416
  hypothetical: YES
KKGSPFCRIELPQHIHRKEDFHMNDFTTEILKTLANKGDLNELFRVHLEKAVNTLLKTELTAFLDYEKYDRIGFNTGNSRNGSYDRTVKTEYGELHLQIPRDRNGEFKQQTVPAYRRTNDTLEETVIHLFRKGITMSEIADLIEKMYGHHYTLQTMSNMTKVLTETEEVNAFKVRTLNDKYVAIFMNATYIPLKRQTVSKEAIYIAIGIREDGTKEVLSYAIAPTESTYVWNELLQDIYSRGVHDVLLFITDGLKGMKDTIHQIYPKAKYQHCCVHVSRNIAHKVRVKDRKEICDDFKAVYQASSKEEANTFLGSMIEKWQKTYPKVTQSLIKNQDLLTFYEFPPGIRRSIYSTNLIESFNKQIKKYSRRKDQFQNEESLERFLVSIFDTYNQKFLNRSHKGFQQVTDTLASMFTE

SEQ ID NO: 6160 - protein, 480 aa, Enterococcus faecium
  misc_feature (B) LOCATION 1...480
  hypothetical: YES
KRGRFMQQSKTKIPAKKLTFFGFLAMTISMVVSLYEYPTFATSGFSLVFFLLLGGLLWFIPVALCAAEMATVKGWEKGGVYTWVSRTLGKRFGFAAIFFQWFEITVGYLTMLYFLTGALSYATGIGAIQNNKYLKLAILLIIFWAILLSQLKGTKYTSLIARIGFVAGILLPALVLFGLGIHYVASGAPLQTILSMKTLIPDFSKLPTLVVFVSFILAYMGVETSASHANEMENPKKDYPLAMFVLVILAIILDTFGGLTVATTVPQHGLSLNTGVIQSLEFLLRHIDPNLAWIAKILAILVCLGVIGEIASWVTSPSKALHVAAEEGLLPEYFAKENTHGVPAHLMIANGIVATIWAAVFTLSGGGNNLSFLAAMSLTVVIYLMLYFMFFAGYLKLVFKDDSLERAYQVPGGKVVKVIVACLGLLTSLFAFCISFVPPASIAAGQHGIYETILIVSYLIVLVIPFTIYACRHKFQHAEK

SEQ ID NO: 6161 - protein, 224 aa, Enterococcus faecium
  misc_feature (B) LOCATION 1...224
  hypothetical: YES
MRGSTYEAIQLLXKMMHVDGHVYPSSETPLTLHAVFKDGTTAVGESKIAINRKTIDRVYVCNTNDKSEAKAARKVVSAIMDADMVVLGPGSLFTSILPNLVIPEIGEAMLKTTAETVYICNIMTQKGETEHFTDADHIRVLHKHLNQPFIDTVLVNTEKVPEDYMDPEIYDEYLVQVAHDFNGLRNEGCRVISTDFLELKDGGVFHDGDKVVEELFRLVFGSKY

SEQ ID NO: 6162 - protein, 101 aa, Enterococcus faecium
  misc_feature (B) LOCATION 1...101
  hypothetical: YES
SILRILRWELQFPPFYRVKMRNKYKEVLCVAKEDMIEVEGTVVETLPNAMFKVELENGHQVLATVSGKIRMHYIRILPGDKVTVELSPYDLNRGRITYRFK

SEQ ID NO: 6163 - protein, 112 aa, Enterococcus faecium
  misc_feature (B) LOCATION 1...112
  hypothetical: YES
TLLRKTYDRKFKLKISQDILEKKVTTKKIAEEYNISRPTISRWVSEYRRYGKNAFAGQGKRLPDKADFYILEQENKRLKEEDECSTNTKIDTDLQGSLKNFTMKESKSINVL

SEQ ID NO: 6164 - protein, 66 aa, Enterococcus faecium
  misc_feature (B) LOCATION 1...66
  hypothetical: YES
PSLRVGISFKSYRGFFHSMIQESSANMLDDVETIDDQLSIREKLFHQRNIRRIHINNNQLNGFTSR

SEQ ID NO: 6165 - protein, 66 aa, Enterococcus faecium; identical to SEQ ID NO: 6164
  misc_feature (B) LOCATION 1...66
  hypothetical: YES

SEQ ID NO: 6166 - protein, 66 aa, Enterococcus faecium; identical to SEQ ID NO: 6164
  misc_feature (B) LOCATION 1...66
  hypothetical: YES

SEQ ID NO: 6167 - protein, 66 aa, Enterococcus faecium; identical to SEQ ID NO: 6164
  misc_feature (B) LOCATION 1...66
  hypothetical: YES

SEQ ID NO: 6168 - protein, 70 aa, Enterococcus faecium
  misc_feature (B) LOCATION 1...70
  hypothetical: YES
NWLSHRKCYLAKQRENKHYNQQSIKKSPSFSFFIFQSQIEKLIPATLSLVSQSTDYNYSFTFYFKFLLNH

SEQ ID NO: 6169 - protein, 153 aa, Enterococcus faecium
  misc_feature (B) LOCATION 1...153
  hypothetical: YES
SILRSHLFFLPAIEKELVEHGVSLRADARALEYLETAALAEDTDWDTEYLDYILAVKVVDSLDEAIAHINRHNTKHSETIVTDSYAASQRFLNEVDAAAVYVNASTRFTDGSVFGFGAEIGISTQKLHARGPMGLNELTSTKYIIYGDGQIRE

SEQ ID NO: 6170 - protein, 65 aa, Enterococcus faecium
  misc_feature (B) LOCATION 1...65
  hypothetical: YES
KTLSGLFIHPAIDATFSFLYWYSDPYNHDRFMDPGTDSVGIAFSKENMLFLLQEENGESSDSSDR

SEQ ID NO: 6171 - protein, 511 aa, Enterococcus faecium
  misc_feature (B) LOCATION 1...511
  hypothetical: YES
KNMSYFSSQNTVCQIWCGQRWRILPMKIEALLERKEQLQILILRNLVLQGGTASINGLREHVQLSKASFDQYLEDIELIGRMMEKKVEVQRNEYQALLVLDEDVSLEKILLFLLQESLKFKMLVYLLEHQQVSIVRLATAFNISESSVFRKIKELNQLLEEFGLQIKNGQLYGEELQIRYFYYELFQYIPEDQRPLFLQNTPEKRPFILGLDRVLETTFTASAEAQIACWLGITKKRLLNEKSTYATLKEKKLLYQSDRLYQAIDPIIVMHLSRTAAELNVYETMMFYSFFVSFSIVDEEIFYQYDLTRSKKLPTAVLDTYIRETMLWHYRPRRLKIKEEKAVGYQISQINNEWFFFVGKIEVYERDRLLEQQQKMLGHSLTQLLAKLQETAVQQLPRKRAEDSELSYLMIQYANVLLMIDFYIAKPVVIGIDLESLPIYRIAFQQYLIRELRGIGGIEIGSYEEGKEYDLVITFCQRNKKQCEYYLSEFASPYDIIRLKRRIETLKKEKN

SEQ ID NO: 6172 - protein, 307 aa, Enterococcus faecium
  misc_feature (B) LOCATION 1...307
  hypothetical: YES
NQMRNILDVEQVRKRLEKGVILMEKRYGVVPVVTASDENYAPYLSVMIATALENCNKTRRIKFYVIDDGLSEYSKEGLEETVNKYSSNASIQFLTVEKDIYEDFLVSDHITTTAYLRISLPNLLAKEDYKKVLYLDSDVLVLDDIVKLYDEPLNGKTIGAIIDPGQVKALERLGIDSDDLYFNSGVMVIDIDQWNKKEITEKTIHYLSENGDRIIYHDQDALNAVLYEDWEQLHPKWNMQTSLIFERHPAPNEKYERQYKEGNEKPSIVHFTGHDKPWNTLKDHPYTNLYLKKLAHSTLTKVGEINE

SEQ ID NO: 6173 - protein, 385 aa, Enterococcus faecium
  misc_feature (B) LOCATION 1...385
  hypothetical: YES
TKMRVVHVEDRFEPNAGYQINELIKEQVKLGYDIEIITSTIPIFSSYEQLRKDDEIYFNKYGVKIIRIKPMFIISSRYYFKGLFKLIDSKIPDIVFLHGIADFKDLVLFQKRKNYLIFRDCHMSWTASQNRFSHIFATLFSYTFAKIINNNHKYKKIYSLGTEEEQYLEYIGVKKSLIKKIPHGYNSNEMYYSKEARDNLRRFYNIGEKECLIGYVGKLDFAKRPDLLFDIFEMIEEEVMSNVSILFVGNFEEKYKKIFYKKYETFRYKEKCIFMVAQKYSELYKVYSTLDICFWPRQTTLSSIHAQVCRTLPVMELHESNKERVYNDRYLFEKEDMEKAREKLLLAIKTFRDVDFSSMQVFLSQRDYIKTVKKIDSDWKRYLAE

SEQ ID NO: 6174 - protein, 153 aa, Enterococcus faecium
  misc_feature (B) LOCATION 1...153
  hypothetical: YES
WKMSKLNPKQQAFADEYIITGNAYQSALKAGYKENYAKNAQEKLVEKGGKVSDYIQEKLKEVQTKRHLTMEEALAITASIAKGEPQRFEVVKRDPYTNEIIEREVSEYSAGFKERNQALEHYYKINAAFVDKQKVEISEIPTFIDDISSDDDG

SEQ ID NO: 6175 - protein, 467 aa, Enterococcus faecium
  misc_feature (B) LOCATION 1...467
  hypothetical: YES
VRMSLTDILVCLSEKQNGRKNNMSDIIIGILLVISFFFMVWYCVKGYNLMVGFAIMATVWMGLALVGNTFSPNPAMEGQGVIDVLTHIYTTGPAEYAKSILVNVFFGAFFGRVLVDSGIAATLIRKVVELGGDKPRITMSLLCIVTAVIFMSMTGIGPVISIAVIVLPILMSLGISVPVALFSFMGSIMAGIFANIVNFKQYQTIYAGFNPAAESYTYNDYFQIGMIGMIVSLVVVLTVANISMNKKKRYAMAANVPAEGGDAPMISWLAVLLPVLGVVLLDLPIILGFILAGIWALLFTGKLRGGYKEICRQFAKLFTDGAVDVAPMVGFLMTLAMFNNSAAYASPYFSAIFGDWIPQSPLVLAIVFAILTPLGFFRGPMNLVGSGSAILAVVLAVNPTMSPAFLFPLFAITTIAPQHLDITQSWVAWGLGYTKVTSREYMKKSIPTGWIIGAILCLITFLLYGNA

SEQ ID NO: 6176 - protein, 163 aa, Enterococcus faecium
  misc_feature (B) LOCATION 1...163
  hypothetical: YES
CAMSRATEQEAYELLKKLGISFQKVDHPAITSVKNVPFSLPGPQVKNLLLKSRKGKQIYLVILPDEKHADLKQLAEQLKEKRLSFVSEEQLPDLLGVPAGTVTPLALMHDKEKKIQVVIDAAIDRQDTVGFHPNINTTTLIMDFSDFEKILVYLEHLPVYENL

SEQ ID NO: 6177 - protein, 331 aa, Enterococcus faecium
  misc_feature (B) LOCATION 1...331
  hypothetical: YES
SFVRRELSMKIINFEEVVASFSFEEAIQVMKKCFFDYESGKISQNPRLVEILPDGKGKNMFAMMPAYLGENRYFGTKVITAFPDNHQYHLPSHLGEIFLFDAQNGLPKALINANAVTWIRTAAVSALATDYLANPHAETLALIGAGQQALSHLTAISTIRPITTVFVYDILEERRNTFIAKAKKQYPKITFINAISVEDAVRPAEIICTLTSSKEAFLQKEWVREDAHINAVGTFTPDTREISTSLMETSQIYVDDYSAALTESGDLLIAMAEGDLEESCIVGTLGELVSEKKTFYKGESRPTIFDAVGLAIEDLCCAEYIYNKLEKGALK

SEQ ID NO: 6178 - protein, 72 aa, Enterococcus faecium
  misc_feature (B) LOCATION 1...72
  hypothetical: YES
DGVSVVLSDEIVSGFSLEIVSTIFSLSFGCSSADWTVSVVSAAGCETVGLANEGVGSNGSQPNPGKYTSGQE

SEQ ID NO: 6179 - protein, 89 aa, Enterococcus faecium
  misc_feature (B) LOCATION 1...89
  hypothetical: YES
EVVSLPLNSESQGAISKNSFSCFMTMVTCDRGVGRRILFIRKEGAVTRLLSQSLISFYYRISPFDWMTCLYQSNDFFFNRFFVPFPSSS

SEQ ID NO: 6180 - protein, 75 aa, Enterococcus faecium
  misc_feature (B) LOCATION 1...75
  hypothetical: YES
SKVRGCFMSNAQDIPVWEKYTLTIEEASKYFRIGENKLRRLAEENKDAGWLIMNGNRIQIKRRQFEQVIDKLDAI

SEQ ID NO: 6181 - protein, 327 aa, Enterococcus faecium
  misc_feature (B) LOCATION 1...327
  hypothetical: YES
LKVRNIMCEISIIVPVYKVEKYLRKCVDSILAQTFTDFEVILVDDGSPDNSGKICDEYAEKDNRVRVIHKENGGLSSARNAGIDVARGKYLGFVDSDDYIDEDMYEILYENLKIHDADISSVELIPFYGDRYKKANKEKKVIILNKKEAIKSVLEGTQFYAYAWNKLYRKELFKDNRYLDGKTFEDAYIIIDLLFQTEKIVVSNEEKYFYLQRNDSIMGKSFSMNNFDVIEAWQYNKEKILDAFPDLHDSYYRRLCWAYFYVLDKMVLSSSYQQIPRKKTVIEFLKKNRNFILTYKGFTKSRKIAIIALSFRVDWYRKLVEQKNKKN

SEQ ID NO: 6182 - protein, 116 aa, Enterococcus faecium
  misc_feature (B) LOCATION 1...116
  hypothetical: YES
RVSRSAIWIKMGDCFCDGRTSQRYQKNEEEARKQPLPKQQMTLQEIDSILTEAFLSRKAVIIQLNLKDEFGRLLDEVEGHFIGEAYEDYFMIDHQPILWEDVRYIELKETKKWFVT

SEQ ID NO: 6183 - protein, 61 aa, Enterococcus faecium
  misc_feature (B) LOCATION 1...61
  hypothetical: YES
PQTSRIGGDPKMKELFSTYKLPIIFGVLGLILAVLWITRGFFQDLIDLDHGSDRRRYRFFN

SEQ ID NO: 6184 - protein, 532 aa, Enterococcus faecium
  misc_feature (B) LOCATION 1...532
  hypothetical: YES
IVASMRTDVLAKILKNGIKQFNSKNLVAFKKNSNKIGAIAGFTSKTNMIKTKGLIYRSIDRVLEDSDVLTHWTPNVYSWLGGGENKTIFGHKEANLIQINTFVADIDYPVGEKKTDLNLLVLYLLEEGLLPTLIVDTPKGYHCYFLIQNYNQETDSFDKASYISNSNDFKSLRVAKRISENIRKSIQNRLPQVDMGCNHFGIFRFPTKKNIVHYEPNFVDTFEGYLKWSKDFEEKEYALKRSNLSLLAPNSTGKKGSKRQIDTKWYDFLIHTDIAEGDRNKTIFTLALACKSSGLSIGECMDQLDQLQFNNDLSYSEVERTIRSAYRGDYKGAKSSYVNEIIENYATPTEFEKYSINVNRQAVKRKGNRVDPSNWVKFAKPREERKYSHFEESKADLLAYLERKQRSLKKNELFLSVSMGTISEETQIPVSTLKVILKELRTANTVILRTSRGRYGSTKIATSKFVEAKILNTVIQNKKDKQVFVLELLGTANSHVETILRRYEDKTVPFHANILKEREKSKHAPIRGANTG

SEQ ID NO: 6185 - protein, 389 aa, Enterococcus faecium
  misc_feature (B) LOCATION 1...389
  hypothetical: YES
QQARKTMTLKEEIIQESKRLGIDKIGFTTAEPFDSLKESLEEQKAAGHTSGFEHPNIDERLYPEMTFDQPKSIISIALAYPTRIHEEVPRDEKRGQFARASWGIDYHDILRDRLNRLIEFIQTRAEKWQKEEEWRLAPQVDTGELIDVAVAQRAGLGFIGRNGLLITEEFGSFVYLGEIVTNIVFEPDKPGEFGCGDCMRCVTACPTKALLGDGRMNAQRCLSYQTQTKGMMPEEYRKKMRNVIYGCDICQLVCPYNQGKDFHFHEEMEPKVDEIYPKLKPMLSMSNKDFKQQFGHLAGSWRGKKPLQRNALIALANLGDRTALPEISECLTDVRPVIRGTAAWAIGRLGTKEPEKWLDVLDEILAKETEEVVINELEHAQKLLRRKLK

SEQ ID NO: 6186 - protein, 467 aa, Enterococcus faecium
  misc_feature (B) LOCATION 1...467
  hypothetical: YES
REARGYMEKIVILHTNDLHSHLENWPRIRRFLDQRKRENEKKEKTTTIAVDLGDFVDRWHPLSEATNGQENILLMNEVGYDAATIGNNEGVGNSKEELNHLYDHAEFDIILDNLFDKNTLQPPAWTKPYKIITTKHQTKIGLIAFTAPFPLTYNPNGWDIRNPYDILPELVEDLRSQVDVLVLMSHLGIQDDFQIAKEIPAIDVILGSHTHHLFREGHVINDVQIAAAGKYGQYVGEVHLTIDEEKKILKHSAKAIPTETMTAFTEDEQEINSYLERGHELLKEKEVADLPFSLSLDIFNEHSFIQVAFEAVKERGKTEAAILNSGLFLTEIPKGRVNQDQLHTALPHPMHLLNVTLGGNDLIRLVLEIEKNRNFLRNYPMKGMGFRGKIFGQMVYNGITYDSINHQVFWKNKPIDLNKNYTFTTVDHLMFVPFFPTIEIAGKNEFLFPEFIRSVVGDYLKAHYPIK

SEQ ID NO: 6187 - protein, 87 aa, Enterococcus faecium
  misc_feature (B) LOCATION 1...87
  hypothetical: YES
NYQSEYANKNDSHNPKKFLFHPLTPFSLEQVDGYQRHGRVLQRLDVPEPRLPDHTNPASSIGHFPNLVGVFDCFHLLDPSQRIPRFS

SEQ ID NO: 6188 - protein, 459 aa, Enterococcus faecium
  misc_feature (B) LOCATION 1...459
  hypothetical: YES
ILKSKIRSITWIWKDDWMKAITPDMTTKFNKQFQANIKQHALQRAVVKKGITASAENVSAHVENTPVFSIDLATGKVANQMQSGRCWMFAALNTFRHKMLNQFHLKECELSQNYTFFWDKYEKANYFYENIIATGKEAIDSRKVAFLLATPQQDGGQWDMIVSLFQKYGVVPKSVMPESANSSNSRDLNNYLNKLLRKDAVVLRKMVAQGETLDAIEEKKEEMLESIYNFLAISLGTPPKEFDFEYRDEEKNYHLDRGLTPQIFYDKYIGVKLDDYVSVINAPTKDKPFNRSYTVEMLGNVVGGKEVKYLNVDMETFKKLAIAQLEEGESVWFGCDVGQSSTRTSGIMALDAYSMDDLFDTDFTMTKAERLDFGESLMTHAMVLTGVDLVDGQSTKWKVENSWGEKVGKNGFFVMSDAWMDEYTYQIVVRKDLLTKEQLNAFNEEPIVLSPWDPMGALA

SEQ ID NO: 6189 - protein, 216 aa, Enterococcus faecium
  misc_feature (B) LOCATION 1...216
  hypothetical: YES
MIKRKNDNKWKYICGVLIIILVLGGLLSQLHTSNIQAKNKKLDQEVTQLEEQNSKLSKNISDLNANVEANLTNDDGSELNKQIAEVAKKFVELYPVYDIEKVEEKKADLEKIATPSVADSIVPDDMITTSKKTLESKSTTQKGEAYSSDPTFKSKYKDSKLYTNYVNANTINYFAEVNYKTESSSGDTENTVYMLFEVTNKDGQVLVDNYEIKYLK

SEQ ID NO: 6190 - protein, 65 aa, Enterococcus faecium
  misc_feature (B) LOCATION 1...65
  hypothetical: YES
KHKRLFLLGSSYYLMQNSFFTTSSLNGVLLPTPRSQVTIFIKHEKLFFEIVPCDSELNGRLTTSW

SEQ ID NO: 6191 - protein, 115 aa, Enterococcus faecium
  misc_feature (B) LOCATION 1...115
  hypothetical: YES
MDKRSLYDGLNQLESELRNTLTELVEMKHALHEIVEKNTTLEMENQRLREHLRELNQVAQAPAENVKQELSKSRMNLEKIYEEGFHVCYDLYGSRRDNDEPCAFCLEVIYRESGR

SEQ ID NO: 6192 - protein, 732 aa, Enterococcus faecium
  misc_feature (B) LOCATION 1...732
  hypothetical: YES
KSKRRDGVKMNGNDMEKKQEHKKEAGNKESAHSNEKQMEMKHDHSQMDHSMHMEHNHGDIADSKQMDHSMHMDHDHGGMDHSMHMGNFKQKFWLSLILAIPIILFSPMMGMEFPFQITFPGSDWLVLILATILFIYGGQPFLSGAKMELKQKSPAMMTLIAMGITVAYIYSVYSFIANLINPHTHVMDFFWELATLIVIMLLGHWIEMNAVSNASNALQKLAELLPESVKRLTKEGKEETVSLKEVTEGDHLIVRSGDKMPTDGVILKGETIVDESAVTGESKGIKKRANDKVIGGSINGDGTIEIEVTGTGENGYLAKVMEMVRKAQGEKSKLESLSDKVAKWLFYIALIVGILAFIAWLFLTDLPNALERMVTVFIIACPHALGLAIPLVVARSTSIAAKNGLLLKNRNALEQANDLDVIMLDKTGTLTEGKFTVTGVEVLDDAFNKNEILQYLGALEANANHPLAIGIMNYLKEHEIKPYQAENLKNLSGVGLEATVKNQQVKIVNEKEVERLGLNVEQALLKPYQEQGNTISFLILENHLAAIVALGDVVKTEAKEFIRTLKERKITPVMLTGDNKNAAQAVADYLGIEEYYGGLLPDDKEAVVQKYLDQGKKVIMVGDGINDAPSLARASIGMAIGAGTDIAIDSADVVLTNSDPKDILHFLDLAKQTRKKMIQNLWWGAGYNILAIPLAAGILAPIGILLSPAVGAVLMSLSTVVVALNALTLKIK

SEQ ID NO: 6193 - protein, 70 aa, Enterococcus faecium
  misc_feature (B) LOCATION 1...70
  hypothetical: YES
NGKRVRQMEAGKVLQEVKALCADKKYEEAKSLIEKNKENLEEKYPIAQEFIELKQGTILHRFKHFFGITE

SEQ ID NO: 6194 - protein, 237 aa, Enterococcus faecium
  misc_feature (B) LOCATION 1...237
  hypothetical: YES
DRKRGKDMLQSLDKINGRLNRILQLVYLNFLWGGLVIAGLGVFTFGPASYAMVAVIKKWLRSKETFPLTKTYFTYFKENYRETLLMSWIYGAIGIVLLVDLSFIHNWYLRIALYIAAFIYVLSALYIFPIMAHYDWKGYFFKMKMAFLFGFSHLHYSLVLILSMVGIYLMIIQTMPGVLTFIGGSLFFSAVTWTANSIFCHLEWKNSYTEKTEENKNIIKTVKEKIYEKSNARKIRS

SEQ ID NO: 6195 - protein, 207 aa, Enterococcus faecium
  misc_feature (B) LOCATION 1...207
  hypothetical: YES
KGKRMKMKFIGLVGTNSTRSTNRELLQFMKNYFVNEAEIEIVEIKELPLFNKPENTELPNVVKEIAGKIEQADGVIISTPEYDHAVPASLINALNWLSYGIFPFVDKPVMITGASYGTLGSSRAQAHLRQILDSPELKARIMPSSEFLLGHSLQAFDEQGRLIDEEQVAKLRELFKDFLLFVTITSQLQHAHQANKREAESFSWETI

SEQ ID NO: 6196 - protein, 408 aa, Enterococcus faecium
  misc_feature (B) LOCATION 1...408
  hypothetical: YES
KGKRETKVFSDKEVLLKSLHVCLKLPIVVFNSEFSIIKEYRSDRTTYFFYDYKKLLTDNIKKTKDFHFFTGDFNEMFLLYMFKTRYYLFGPFRANNIDKVFFKLKMNNLNVAMADRERLYNSLQNLTLYSLGDIRDILILVHYFFTGKIEDLFHEPLIEYTENLSKTIEQIKIDNLLSQNYDPEIYLFLYENKILEYVKNGDIRNLENMVFNLSNGIIPSVSGDTIRSEKNYSIIVFEKLAQTSITLGMDIIEAYQSRDALIQENELAVSLPEVLKVRDSGIVYYTKEIGKTKIEHLSPLISSVVQFIGLNIYKRITVKEIANYFSVSETKLRESFKNEMHITIYNYISKRKISTAKIMLKSNHTISEVSLGLGFSDSSHFSRVFKKYAGVSPKQYQLGLVDNFNNIS

SEQ ID NO: 6197 - protein, 167 aa, Enterococcus faecium
  misc_feature (B) LOCATION 1...167
  hypothetical: YES
WMKRQSPALVLLLKEHPECAMLAPKILNEDGTTQHLIREQLAVFDYVLRFVPFKWVKKKFDKRLAVFECRGLPTDANSYVRMISGSFMVADIDKFKEIKGFDERFFMYFEDNDLCLSFEKAGYKLLYTPFYAVIHFYGKGAHRNAKLFRVFLTSMMKFFNKWGWRFF

SEQ ID NO: 6198 - protein, 408 aa, Enterococcus faecium
  misc_feature (B) LOCATION 1...408
  hypothetical: YES
RKKRWVKLEQAKNLTDKKEKKLNLKSRAADLFGRYSMVIILAGLLIAFQLMTDGIFWRPLNITNLVLQNSHILVLAAGMLLVVLLGHVDLSVGSVMAFVGAIAGMMMVNRQMNPWMTVIACLAVGGLIGAWQGFWVAYAGIPAFIVTLAGLLMFRGLTQVVLGGQSLAPFPAVFQKMCTGYLPDLSEGSSLHFLTLILGMIITIVLVVGQWRTRNRRKNHLFEVESPTAFLVKAVFTAVVVLGITYIFASYQGYPIILIILGLIVAAYGFLTNKTVAGRQIYATGGNRKAAELSGIKTKRITFWVFVNMGVMAALAGLVLAARLNAATPQAGTSMELDAMAAVYFGGASTSGGIGTIMGAIVGGLVMGVLNNGMSILGVGVDWQQAIKGLILLLAVVLDLYNKKKRTT

SEQ ID NO: 6199 - protein, 226 aa, Enterococcus faecium
  misc_feature (B) LOCATION 1...226
  hypothetical: YES
QKKRKRRNESFMTMKGYPRIIRDKGEMWMPKETFFNLSNAKKQRIDDLLLEIFCSQHISQVKVSEIVDKMGMSRGAFYKYFQDLEDAYLYTIKSSSHIVHQDILKFISENKQHFFLGIEKYLEWCCDLDHESIYWQRLYLLTQRNDQQTTKRRELSADSPMNEKWLELLRINHFSIQSSEEAVSFLYFSMTLVMNTLTDLIANNWTKEELLKDFRYKSRWIAEGIQ

SEQ ID NO: 6200 - protein, 275 aa, Enterococcus faecium
  misc_feature (B) LOCATION 1...275
  hypothetical: YES
KRKRDTMVKKQITGEEIKRIIEEENVRFLRLMFTDILGTIKNVEVPVSQIDKVLENKMMFDGSSIEGFVRIEESDMYLYPDLSTWMIFPWESAHGKVARLICDIYNPDGTPFAGDPRGNLKRALKDMRDLGFTSFNLGPEPEFFLFKLDEDGGITTTLNDKGGYFDFAPTDLGENCRRDIVLELESLGFEVEASHHEVAPGQHEIDFKYADVVDACDNIQTFKLVVKTIARKHGLHATFMPKPLFGINGSVNAIAICLCSHDERNVSMIKTVNWN

SEQ ID NO: 6201 - protein, 674 aa, Enterococcus faecium
  misc_feature (B) LOCATION 1...674
  hypothetical: YES
RRKSPVAEKETFYITTPIYYPSGKLHIGNSYTTIACDAIARYKRLMGFDVFYLTGVDEHGQKIETKAEELGVKPQEYVDKMAADVKKLWKTLDISYDKFIRTTDDYHKAAVQKIFDRLLEQGDIYLGEYEGWYSVSDEEFFTETQLAEVYKDDEGNVIGGKAPSGHEVELVKEESYFFRMSKYADRLLEYYEEHPEFIQPESRKNEMINNFIKPGLEDLAVSRTTFTWGVPVKSDPKHVVYVWIDALSNYITALGYGSEDESLFEKYWPADVQMVGKEIVRFHTIYWPIMLMALDLPLPKKVFGHGWLLMKDGKMSKSKGNVVYPEMLVERYGLDALRYYLLRAVPFGSDGVFTPEDFVSRVNYDLANDLGNLLNRTIAMINKYCDGLVPDYASLVTPFDSELSTTAANVVGRYHDAMEKMEFNTALAEIWVLISRANKYIDETEPWVLAKDEEKKAELNSVMIHLAESLRIAAILLQPIMTETPEKIFNQLGLDSETMNLEGLHFGEFPSGTKVVAKGTPIFPRLDMEEEVAFIQEKMSEGTQTNEDTVKWDPEETELVSTKEKQIKFDVFEKVELKVAEVINCQKVEGADKLLQFRLDAGDSQDRQILSGIAEFYPDPSELIGKKVVIVANLKPRKMRGQISQGMILSAEAPDGSLQVIEAPKSMPNGSEIA

SEQ ID NO: 6202 - protein, 439 aa, Enterococcus faecium
  misc_feature (B) LOCATION 1...439
  hypothetical: YES
TTERTICYMNDSIKKMLRLIEKDLMITEVSYETFQKKKTLIVDAVFSPAPHTCRNCGSTVVDGNGKVIVVKNGKKETIVRFEQYNHMPLVMRLKKQRYTCKNCRTHWTAQSYFVQPRHSIANHVRYKIASLLTEKVSLSFIAKNCQVSLTTVIRTLKEFKSYLPKQSKRILPRVLMVDEFRSHASIEDKMSFICADGETGQLIDVLPTRKLPRLTSYFLGCANPEEVKFLVTDMNAAYFQLTKRILPNAKVVIDRFHIIKHMNQAFNELRIREMNELRKVGQKSQAEKLKKNWRFLLKNRANINHYEYKTWKSFRAPKYPFLTEAMMIDRLLGFSTSLKEAYPYFHELVEAFRDKDPDLFFSLLAELPETLDDGFREKLQNLLTYEEGITNAMIYPYSNGKIEAKNTHIKTMKRVSYGFKSFENMRIRIFLINQLIKVR

SEQ ID NO: 6203 - protein, 82 aa, Enterococcus faecium
  misc_feature (B) LOCATION 1...82
  hypothetical: YES
TTERTICFMNGSIKKILRSIDKNLMITEVSYETLQKKKTLIVAAVLFPAPCVCRNCGSAVVDGNRKLMVVKNKKKETIVHFE

SEQ ID NO: 6204 - protein, 439 aa, Enterococcus faecium
  misc_feature (B) LOCATION 1...439
  hypothetical: YES
TTERTIRYMNDSIKKMLRITEKDLMITEVSYETLQKKKTLVVDAVLSPTPRACRSCGSTVVDGNGKAIIVKNGKKETIVRFEQYNHMPLVMRLKKQRYTCKNCRTHWTAQSYFVQPRHSIANHVRYKIASLLTEKVSLSFIAKSCQVSLTTVIRTLKEFKSYLPKQSKKILPRVLMVDEFRSHASIEDKMSFICADGETGKLIDVLPTRKLPRLTSYFLGCTNPEEVEFLVTDMNAAYFQLTKRVLPNAKVVIDRFHIVKHMNQAFNELRIREMNELRKAGQKSQAEKLKKNWRFLLKNRANINHYEYKTWKSFRAPKYPFLTEAMMIDRLLEFSPPLKEAYPFFHELVEAFRDKDPDLFFSLLAELPETLDDSFREKLQNLLTYEEGITNAMIYPYSNGKIEAKNTHIKTMKRVSYGFKSFENMRIRIFLINQLINVR

SEQ ID NO: 6205 - protein, 439 aa, Enterococcus faecium; identical to SEQ ID NO: 6204
  misc_feature (B) LOCATION 1...439
  hypothetical: YES

SEQ ID NO: 6206 - protein, 439 aa, Enterococcus faecium; identical to SEQ ID NO: 6204
  misc_feature (B) LOCATION 1...439
  hypothetical: YES

SEQ ID NO: 6207 - protein, 439 aa, Enterococcus faecium
  misc_feature (B) LOCATION 1...439
  hypothetical: YES
TTERTICYMNDSIKKMLRLIEKDLMITEVSYETFQKKKTLIVDAVFSPAPHTCRNCGSTVVDGNGKVIVVKNGKKETIVRFEQYNHMPLVMRLKKQRYTCKNCRTHWTAQSYFVQPRHSIANHVRYKIASLLTEKVSLSFIAKNCQVSLTTVIRTLKEFKSYLPKQSKRILPRVLMVDEFRSHASIEDKMSFICADGETGQLIDVLPTRKLPRLTSYFLGCANPEEVKFLVTDMNAAYFQLTKRILPNAKVVIDRFHIIKHMNQAFNELRIREMNELRKVGQKSQAEKLKKNWRFLLKNRANINHYEYKTWKSFRAPKYPFLTEAMMIDRLLGFSTSLKEAYPYFHELVEAFRDKDPDLFFSLLAELPETLDDGFREKLQNLLTYEEGITNAMIYPYTNGKIEAKNTHIKTMKRVSYGFKSFENMRIRIFLINQLIKVR

SEQ ID NO: 6208 - protein, 81 aa, Enterococcus faecium
  misc_feature (B) LOCATION 1...81
  hypothetical: YES
TTERTIRYMNDSIKKMLRITEKDLMITEVSYETLHKKKTLVVDAVLSPTPRACTSRGSTVVDGNGKAIIVKNGKNETIVPF

SEQ ID NO: 6209 - protein, 439 aa, Enterococcus faecium; identical to SEQ ID NO: 6207
  misc_feature (B) LOCATION 1...439
  hypothetical: YES

SEQ ID NO: 6210 - protein, 439 aa, Enterococcus faecium; identical to SEQ ID NO: 6204
  misc_feature (B) LOCATION 1...439
  hypothetical: YES

SEQ ID NO: 6211 - protein, 273 aa, Enterococcus faecium
  misc_feature (B) LOCATION 1...273
  hypothetical: YES
LFERQVSIYKKARRQEMRRKLFAFDIDGTLLDSNKQALDSTREALEKLRKAGLLVTIATGRSRFHAQEIIRDLDFTNYILCNGAAGFLDHEQVYKNLLDRDQLDAFVQEAHHEQIDTAFVSLDNIKRSSSNDVTVMEEAMHSFGAVLPELDQFFAEEQEIYQALAFFDQTYDGKFSSYDKIRFVRWHENSVDVVPKNGSKAATILHLAEQVGIPHEDIISFGDGQNDREMLRMSGIGIAMGNAVPEVQAEAKMVTDTNDQDGIWKALKELSVI

SEQ ID NO: 6212 - protein, 341 aa, Enterococcus faecium
  misc_feature (B) LOCATION 1...341
  hypothetical: YES
EAERGIRLSDNQLLEVQNLHTGFRLKDDYYDAVDDVSFTLDKNEILAIVGESGCGKSTLATTIMGLLDPNNTKITGEILYNDLNLIDLNETLYNKIRGNDIGMIFQDPLSALNPLMRIEDQIKEGLSYHTKMNAEQRQARALELLEQVGIPNPARVGRQYPHELSGGMRQRVIIAIAIACKPPIVIADEPTTALDVTIQAQILDLLKDLQEETKTGIILITHDLGVVAEMADRVAVMYGGQFVEVAGVKELFDHPKHPYTRSLLNSIPQEGNHDAELHVIEGVVPSLKNMPRKGCRFAPRIPWIPASDHEEEPILHEVAPNHLVRCSCYKHFHFRDEKGEV

SEQ ID NO: 6213 - protein, 113 aa, Enterococcus faecium
  misc_feature (B) LOCATION 1...113
  hypothetical: YES
LKERSDRMITTTTNSVEGKAVVAYKGIVFGEVITGIHAFKDLEAGLRNIFGGRSKSYENELMGAREEALAEMAERAKALGADAIIGVKMDYEVLGSDNGMLMVTCSGTAVSTR

SEQ ID NO: 6214 - protein, 515 aa, Enterococcus faecium
  misc_feature (B) LOCATION 1...515
  hypothetical: YES
VRERIRIMADCILKMADITKKFSGIRALDCVNLMIERGEIHALCGENGAGKSTLMNVLSGLYPYGSYDGEIFYDGKLCQFKDLKDSEEKGIVIIHQELALSPYLSIKENIFLGNEQAERGVIDWELTEKKTYELLNKVGLSIDPNLLVSQIGVGQQQLVEIAKALSKSVRLLILDEPTAALNEEESANLLRLIRELKEQGVTSIIISHKLNEIVDIADRITILRDGQTIETLENEMISEEHIIRGMVGRDLVDRYPERKPDIGEVYFKVEDWTVYHPLDHERIINDHINLHLKKGEIVGIAGLMGAGRTEFAMSLFGHSYGSKISGRILKEGAEISVKTVPSAIANGLAYVSEDRKSLGLNLLMDIRENVTLSSLDKISQKGVLDKEKEVTEAENFRKKMRIKTNSIHQIVSSLSGGNQQKVVLSKWLMTQPDILFLDEPTRGIDVGAKYEIYTIIEEMAANGKAVCLISSELPEILGMCDRIYTMNEGRITGEVSREDADQEVLMKLMTKEEVG

SEQ ID NO: 6215 - protein, 319 aa, Enterococcus faecium
  misc_feature (B) LOCATION 1...319
  hypothetical: YES
IKERKNMKIAIAGAGAMGSRIGLMLHQSGNEVLLIDRWPAHIEAIRTNGLIADFNGKEVVAKLPIYSPEEIIESNEHVDLIVALTKANQLDDMFCSIQSIITDNTYVLCLLNGLGHEDVLEKYVPKKNILFGITMWTAGLAGPGKVTLLGDGEIELENLEPEGEAFTKKVVEVFQEANLNPIYSHNVRYSIWRKACVNGTLNGLCTILDCNIAELGAQKAAESMVRTIVSEFASIAAKEGIILDQEEVYQHIASTYDPDNIGLHYPSMYQDLIKNHRLTEIDYINGAIWRKGQKYDIATPYCAFLTQLVHAKEGILGAE

SEQ ID NO: 6216 - protein, 417 aa, Enterococcus faecium
  misc_feature (B) LOCATION 1...417
  hypothetical: YES
EKESKQMNRVVITGYGVTSPIGNDADSFLNSLKEGTNGIAPITKFDASETGITLAGEVKDFPYDKYFIKKDSKRMDMFSIYGIYAALEAMEMSGLDKEKMNQDRFGVIIGSGIGGLPTIENQVIRLHEKGAKRVSPMFVPMAIANMAAGNIALRVGAKGICTAIVTACASGTNSIGEAFRNIKHGYSDVILAGGTEATICEMGIAGFAALTALSESTDPNRGSIPFDENRNGFVMGEGAGVLVLESLEHAQARGAKIYGEIVGYGANCDAYHMTALTPDGSGASKAMKLAMEEAGVQPEQVGYINAHGTSTPANDQAEAKAIQIALGENFRDTYVSSTKSMTGHLLGAAGGIEALATLLALEHQFIPPTINVEKQDPEIDLTVVKNESKPASFTYAMSNSLGFGGHNAVLCMKRWEE

SEQ ID NO: 6217 - protein, 522 aa, Enterococcus faecium
  misc_feature (B) LOCATION 1...522
  hypothetical: YES
EKERQMDQELFIIEVLSAKQKIIEKAKKRAKRIMFKLLSLVFSSGVLFFGAVSFLYRHMSAVVRSAEGMQKLNNLYHFSWGVGGITIVVLIVFLLLIWLRYHQLSRHFDQWLSQRAQQFLHNKPTSQDDDYLYFEKTSTSQAFRIQKSDCQLLLRSLDDLPIYLGESKSKFGMNTFHIFLLENEPRWEKSQSSPGGYLTTKMSTLVTGFFLILLAGTIYYGRYTQPKMSSHINAASHMTMNSTNDTHIQKTNEGLLADPKQKVNLTTQKINDLKLDTETHSLYMTTDSGANWVFVPIDSQWLRFGEYTLTTGLIPEGYWMDNTYDISADFSWFIYSSGDDVRLLTSRDNGKTWQTSIITQSVQPIRYRKAVFYGNDGLFICTSASGMSAETLYIYTTMDGGITWIKSGSTMINQPVQNVSFVTTSLGFVSTRESLFYTNNGGRSFKESVLSIPENYQTGGIDLFQSPNEVTQISANTLETKFYLLKKGPIDAGKMFACLFRSTDNGETWQFVQQLSQVEQGD

SEQ ID NO: 6218 - protein, 738 aa, Enterococcus faecium
  misc_feature (B) LOCATION 1...738
  hypothetical: YES
KEERKKMKKSTVFYKIFLPMFLLGAVLVIGFSLFIYQNTYESIESSYLTDKKNLLRQVKTNVEWKIRTIEYSFSTYGSTKNFSDIFKHPLTYTDYSTYSEIRKELNFIETIVMDDNNYDLVSLAGKWGVINGSLSQLTEEEVEKYQQKYINNKNNLFWQKKNKGIEMVISLPMFEKEKYALGIATIEKHTIEQVVGESGEDILSIENEVGNLFTTQTVKNKEQPTVLTDVDLDYNQLKVIREKDKTYIVLKSDYNNWIYRLEVDSSAIGAMIRNLRIGLVAVSLTLVGLIGLLSYLFSDRFARPISQIQERLNLKSKGFSGKELDLVAQSVSRIIGEKEALSAHLVTQKPQLETLFVLSLFRNRVERRELDQRLQQFGYSSQNDCYYTALVQIDLLEDSHGGERDLLLLAINNMITEIVPKENRMLPIVLNEEMQATIYRMDKDDAEASKKVMEYCRLIQKRVKEYLNLTISIGISNRFETLNESKQSVDRAKEALYYRVNTGPSSIIFYQEIVPAAHEKTLIRYPIEEQNRLFEAIRSGNQEVKNLVHELIDALFAQNKNPLSREVVSVRLINELVQLGQLLGVDSKNFDNMKQIYVKALNNYHPKELEKLVLEQLVLPITECSQAITDHEFKNLSENIMHIVYTEYDRDLSLDVIADRLHYNPNYLSNVFKKETGEKFGDFVQNHRLEVAKKWLKETNLSVKEIAERLQYRNPQNFIRFFKKKESITPGEYRKKYL

SEQ ID NO: 6219 - protein, 312 aa, Enterococcus faecium
  misc_feature (B) LOCATION 1...312
  hypothetical: YES
VRERYMKVWNKIKQNENLMRFIETTQKRITDSEMSTTSVVVAYYLLLSLFPLIIAFGNILPFLHIDQETVLTYLREVIPETVYQFIGPAIKDLLTQSSGGLLSVSALAALWSASQSINALQIAMNKAYGVENRKNFLIVRFFSLIVIVLFMIAISGVTIVLGLGQLILDAIQPIVQIPVNFIDQFQTLKWPITLVALFVIMFLIYLIVPNAQLKLKTIIPGTIFATVGWMLLSQVFSIYARYFATRISGYQIIGSFIVLMLWLNFAATIIILGGIINAVVQEYVTGHQIKKRRDPSRKWFNKLKTKFSHKKK

SEQ ID NO: 6220 - protein, 1224 aa, Enterococcus faecium
  misc_feature (B) LOCATION 1...1224
  hypothetical: YES
MKWREPLLIDVNKFESMQIGLASPEKIRSWSYGEVKKPETINYRTLKPEREGLFCERIFGPTKDWECACGKYKRIRYKGIVCDRCGVEVTRSKVRRERMGHIELAAPVSHIWYFKGIPSRMGLVLDMSPRALEEIIYFASYVVIEPGNTNLEKKQLLTEREYREKREQYGQEFQAAMGAEAIKQLLDNVDLDAEAAELKEELKSAQGQKRTRAIRRLDILEAFRASGNQPSWMVMDVIPVIPPDLRPMVQLEGGRFATSDLNDLYRRVINRNNRLKRLLDLNAPGIIVQNEKRMLQEAVDALIDNGRRGRPVTGPGNRPLKSLSHMLKGKQGRFRQNLLGKRVHYSGRSVIVVGPFLKMYQCGLPKEMAIELFKPFVMRELVQRELASNIKNAKRKIERQEDEVWDVLEDVIKEHPVLLNRAPTLHRLGIQAFEPVLVQGRAIRLHPLVCEAYNADFDGDQMAVHVPLNEEAQAEARMLMLAAQNILNPKDGKPVVTPSQDMVLGNYYLTMEEEGREGEGMVFRDQNEAVIAWRNGYVHLHSRIGVNPNSLGEKPFTEWQKERTMITTVGKIIFNEIMPPEFPYLNEPTDFNLTVQTPDKYFVEAGTDIPAHIKEQELVLPFKKKNLGNIIAEVFKRFKVTETSKMLDRMKDLGYKHSTHAGITVGIADISVLNEKQEIIENAHKQVETITKQFRRGLITDDERYERVIAVWNAAKDSIQQKLMEGLEAKNPIFMMSDSGARGNISNFTQLAGMRGLMAAPNGRIMELPIISNFREGLSVLEMFISTHGARKGMTDTALKTADSGYLTRRLVDVAQDVIIREEDCGTDRGLEIQAIREGNEIIESLKDRLVGRYTRKEVRHPETNELIIAGNQLISEDIAKQIVDAGVETVTIRSVFTCNTKHGVCKHCYGRNLATGSDVEVGEAVGTIAAQSIGEPGTQLTMRTFHTGGVAGDDITQGLPRVQKIFEARNPKGQAVITEVTGDVIDISEDPATRTKEVTIKGKTDTRTYTVPYTARMKVAEGDMIHRGAPLTEGSIDPKQLLQVRDVLSVENYLLREVQRVYRMQGVEIGDKHIEVMVRQMLRKVRVMDPGDTDILPGTLLDIADFKDQNYNTLVSGGVPATSRPVLLGITKASLETNSFLSAASFQETTRVLTDAAIRGKKDPLLGLKENVIIGKIIPAGTGMQRYRDMEPKEVGVASENVYSISDIEAQMAAEDAMNNQTK

SEQ ID NO: 6221 - protein, 240 aa, Enterococcus faecium
  misc_feature (B) LOCATION 1...240
  hypothetical: YES
TKWRRIKLTEFFVNPLFGLSLTLGVYVLSDKFLRKYKLPVLNPLVLSIVVIILFLHFSGISYKDYNIGGNFLTMLITPATVALAIPLYKNFRLLKENFYPVMAAILAGIVANCLVSVGFGYFFSLHKEMVISLLPKSVTTAISVDLSHTVGGVNAVTLAIVVSTGIFGSLIATHIFRLFKIESPVARGVALGSTSHAIGTAKAIEIGEIEGIISGLAICVNGILTVLLLPLFFQPFAGLF

SEQ ID NO: 6222 - protein, 338 aa, Enterococcus faecium
  misc_feature (B) LOCATION 1...338
  hypothetical: YES
RRWRKMREIDTCIVGATGLVGQTMLKVLEEYDFPVGRLKLLASKRSAGKVCVFKKKKHTVQELTETSFEGYDLALFSAGASVSKEFAPIARSQGLFVIDNSSAWREDSDIPLIVPEVNLEDYTLNRLIANPNCSTIQAVLPLKALQEAFGIQRVNYSTYQAVSGSGQKGIEDLHRTQNDEEPVLYPYNISQTVIPEIDQPLENGYTKEEQKMINETRKILHQPALPVSATCVRVPIENGHGVSVAVQLQKEFTTEEIRECLSQFPGIQLEDDLAAHKYPTSILARGTDMVYVGRIRKDTSLENGLLFYTTADNIRKGAAANAVQIAAALMQKIAEVAR

SEQ ID NO: 6223 - protein, 793 aa, Enterococcus faecium
  misc_feature (B) LOCATION 1...793
  hypothetical: YES
RKWRKYMAVVILAEKPDQGAKFASALAGKKLSKKSGKYEFKSEIFGDTIVTWGIGHLVGLSLPEKYEWLPNKDKWHLDNLPFLPKFNELKYEVSKGKNQQFSIVKSCLENADEIIIATDPDREGENIAYNIFKLCKQSIFNKPIKRLWINSLVQKEIIKGFKNLRNSEETISYFKEANARQIADYLVGMNYTELYSLKLQEKGISGVVSLGRVQTPVNTLVVENDLAIRNFRPEKYKTIECHTTDKQPKAIFKNSLEYFKLEKFEEDTKKFGLDSASTGIIKKIEVSKKQTEPQKLFSLGGIQEYANKKWKYSAKKTDKIIQSLYDRGYLSYPRTDSELITTNEFEYLKANLDVYKSVLGISIDTPCLEPKKRFVDNDKVLEHYALIPTMDIPDIANLTLDEKNIYEIVTRRACLMFAEPYKYENTKVTLDVNGLEFTTSGNVPISLGWKQVDTNLDESDDKEETLPKFHEQETINIDIRFIDKLTKEPKRLTEGKLLGKTGIMAKLGLGTPATRSNIVDTLLNREYIKIENTNVYPTPKGYLLWDLTKNKDLLIGKPENTAIWEESLGKIAQGSYTQEAFLRNIYNYINKTVSDLKKVEFTSDYLEKTVNQNKFDIGSYQVEEKKKVYSILNITSGEQFVIFKNISGKAINKKVLQELLLNNRTDKVLSGFKSKEGKAFNARLLFDPNVMKVVMEFEKNSPKGDKKSKHDTVNGYEIVEKAKVFEIKELATGESFIFYKNNSGKTLSSKTVKELLENGKTKEKVTGFISKDNKKYSAYLVFDNKNKVIKKEF

SEQ ID NO: 6224 - protein, 270 aa, Enterococcus faecium
  misc_feature (B) LOCATION 1...270
  hypothetical: YES
ICRRNLFCHKIDSRKEEYPMIDLQKVNKLYHGKSVVKDVQLTIPEKKLTAFIGPNGAGKSTVLSMISRLIPKDTGEIYLDHNEVKAWKSNELAKKLSILRQSNEINVQITVKELVEFGRFPYTKGKLTTKDEEIVQESLEHLGLEEIADQSIDTLSGGQLQRAYIAMVLAQDTDYILLDEPLNNLDMNFAVQIMQILKNLVQEIGKTIVIVLHDINFAASYADEIVAMKDGQLFTQGTTQEMIKKDVLDELYEMDIRICEIEGRRFCLYF

SEQ ID NO: 6225 - protein, 69 aa, Enterococcus faecium
  misc_feature (B) LOCATION 1...69
  hypothetical: YES
TPRRFNLEQRMLLLSDRKQNHLDCIYKTREQLNKLDTVRYYFTYFSENDEQRWDIFHDGNYEEFFYTES

SEQ ID NO: 6226 - protein, 90 aa, Enterococcus faecium
  misc_feature (B) LOCATION 1...90
  hypothetical: YES
DRRSKHGKKISLTMDLLIPVIAFIDGISLGVTENPLVNRIAKGSLFLVFVYLVCSYLLKRAGKDNSFWRLTKVTVAATAVILTAILPLYM

SEQ ID NO: 6227 - protein, 871 aa, Enterococcus faecium
  misc_feature (B) LOCATION 1...871
  hypothetical: YES
PIRRIMMAKVIEKEKTKTIDVQAMIDDLAEKANAALKEMESFDQEKVDHIVHEMAMAALDQHMPLAKMAVEETGRGVYEDKAIKNMYASEYIWHNIKHDKTVGVINEDVQKGLIEIAEPVGVVCGVTPTTNPTSTTIFKSMIALKTRNPIVFAFHPSAQKSSAEAARVVRDAAIAAGAPENCIQWIEHPSIEATSMLMNHPGIAIVLATGGAGMVKSAYSTGKPALGVGPGNVPAYIEKTAKIKRAVNDLIVSKTFDNGMICASEQAVIVDKEIYAAVKAEFQAHQVYIVKPDELQKLEDAVMNEGKYAVNPSIVGHSAMEIAKLAGISVPKGTKMLIAELEGVGPDYPLSREKLSPVLAMIKANNTDHAFDLCEGMLNLGGLGHTAVIHSENEELHVKFGLRMKACRILVNTPSAEGGIGDIYNEMIPSLTLGCGSYGKNSVSRNVSAVNLINVKTVAKRRNNMQWFKLPPKIFFEKNSLLYLEKMENVERVMIVCDPGMVQFGYCDTVREVLARRKNDVKIEVCSDVEPNPSTNTVYAGTKLMADFKPDTVIALGGGSAMDAAKGMWMFYEHPDTSFFGAKQKFLDIRKRTYKIDKPEKTQFVCIPTTSGTGSEVTPFAVITDSETHVKYPLADYALTPDVAIVDPQFVMSVPASVTADTGMDVLTHAIESYVSVMASDYTRGLSLQAIKLVFDYLEKSVKTPDMESREKMHNASTMAGMAFANAFLGICHSVAHKIGGEYGIPHGRTNAILLPHIIRYNAKDPQKHAMFPKYDYFRADTDYADIAKFLGLKGETTEELVEALATAVYELGKSVGINMSLKAQGVTQETLDTTVDRMAELAYEDQCTTANPKEPLISELKQIIIDAYNG

SEQ ID NO: 6228 - protein, 177 aa, Enterococcus faecium
  misc_feature (B) LOCATION 1...177
  hypothetical: YES
QPRRKQRVDLKDYIASIPDYPSKGIVFRDISPLMADGDAYREATKQIVNYAKEKRIDMVVGPEARGFIVGCPVAYELGVGFAPVRKKGKLPRETIEVTYGLEYGTDTLTLHKDAIKPGQRVLICDDLLATGGTIKATIELIEQLGGVVVGCAFLIELMDLHGRDKIKGYDIITLMEY

SEQ ID NO: 6229 - protein, 194 aa, Enterococcus faecium
  misc_feature (B) LOCATION 1...194
  hypothetical: YES
VYRRWKMNKGLKIIGVIMSLLLLSVFLAIALINAPYIMPEQLERFRFFTLTNYYMQQYIFWAAVVFAVLAIIILLVVLFYPKSRGTFVMKREDGKLTIDKKAIEGLVRSHLHEEEFIHSPKVRIRSTKNRIHIHVNGDLKRTSSLVGKTGVLMQDIEEEVTKVLGTKETVKVAVTYSGYEEQEDTRDYKHSRVE

SEQ ID NO: 6230 - protein, 288 aa, Enterococcus faecium
  misc_feature (B) LOCATION 1...288
  hypothetical: YES
ENRSVAILKKIDILQAPYVKEMIETTSNLYRLGWDERNGGNISYLLKEEEITPFLDPEKVIRRISMIFDASRLAGCYFIVTGSGRYFKNVASEPAENLGIVRVAEDGKTLELLWGLENECLPTSELPSHFMSHIARLEVDPDNRIVMHCHASHLLAMSFTHELDERSFSRTLWQMCTECLVVFPEGISIIPWMVPGTNEIGEATAEKMKETRLVLWPQHGIYGSGKDMDEVFGLIETAEKAAEVYTYVKAQGPILQTITDENLWHLADAFGVTPKAGYLEEVHTKAGV

SEQ ID NO: 6231 - protein, 331 aa, Enterococcus faecium
  misc_feature (B) LOCATION 1...331
  hypothetical: YES
VNRRKFIMDTQIRGIHHVTAMTSSATKIYRFFTDILGMRLIKKTVNQDDIETYHLYFTDDTGAPGTDMTFFDFPNQPKGKKGTDTISRASFRVPSDAALDFWLERFEKYDVTHSAINERFGKKYIEFEDFDNQYYQLISDENNQGVAAGIPWKNSNVPTEFAITGLGPVFVRVSQLEHIRLILEKILGFKETDHSGDFYLFEIGEGGNGASIIIEHRTDLPKAIEGFGNIHHLALRVADKEALEYWIQVINKIELPNSGFVDRFYFQSEYFLAAHHVLFELATDGPGFLEDEPAESAGEKLSLPPFLEERREAIEAYVRPFDTSDANKKRE

SEQ ID NO: 6232 - protein, 238 aa, Enterococcus faecium
  misc_feature (B) LOCATION 1...238
  hypothetical: YES
NDRRKIKMAKKGGFLLGAVVGGTAAAIAALLLAPKSGKELRDELAAQADDLMDMASDYTDMAKEKSTELTGIAKEKAQDLSQQAGDLAGSVKQKVSESADEAGSESDDILLNLKEQSADLSNRFKKTAEDMKKPADELGSIAKDTSEDIMIDVKDAAGKAGDTVNEGMSEAKPVADDSKEMMKMAKEDAKEAKKEIKDTMTDSSTNHSNHKFIEYKGGSGLALTFSTIIFIRQVILVV

SEQ ID NO: 6233 - protein, 349 aa, Enterococcus faecium
  misc_feature (B) LOCATION 1...349
  hypothetical: YES
ELRRNFLMKNIIVTGGAGFIGSNFVHYVVNNHPEVHVTVLDKLTYAGNKENLAGLPSDRVELVVGDVADAELVDRLVKEADAVVHYAAESHNDNSLKDPFPFVQTNIIGTYTLLEACRKYDVRYHHVSTDEVYGDLPLREDLPGHGEGEGEKFTAETPYNPSSPYSSTKAGSDLLVKAWVRSFGLRATISNCSNNYGPYQHIEKFIPRQVTSILSGIRPKLYGEGKNVRDWIHTNDHSSAVWLILTKGRIGETYLIGADGEEDNKTVMELILEMMGQPKDAYDHVNDRAGHDLRYAIDSTKLREELGWQPEFTNFRDGLADTIKWYEEHEDWWKKEKEAVEAAYAKNGQ

SEQ ID NO: 6234 - protein, 183 aa, Enterococcus faecium
  misc_feature (B) LOCATION 1...183
  hypothetical: YES
FIRRCLNMKEFKELEDFIGTHFIYTYDNGWEYEWYAKNDHTVDYRIHGGMVKGRWVKDQEADIVKLTDGVFKITWTEPTGTDVALDFMPNEKKLHGMIFFPKWVEEHPEITVTFQNEHIAEMEAAREKYETYPKLLVPEFATITYMGDAGIDNEDVISEEPYDGMPDDIRSGKYFDENYKRVK

SEQ ID NO: 6235 - protein, 73 aa, Enterococcus faecium
  misc_feature (B) LOCATION 1...73
  hypothetical: YES
NTRRIFIMETGTVKWFNSEKGFGFITAENGNDVFVHFSAIQGDGFKTLEEGQTVTFDVEEGQRGPQATNVTKA

SEQ ID NO: 6236 - protein, 564 aa, Enterococcus faecium
  misc_feature (B) LOCATION 1...564
  hypothetical: YES
NTRRKSMDTAAIYHRPESEYAFLYTNTRFRIRLRTRKNDIKKVYVLCGDPYTITTEKWYQKQRPMKKCLSTNVHDYWEIEVTSETRRLQYAFHVVGEDNTDCFYGDQGIFPYRENVITEPNFYFRIPYFHQIDRFTIPEWVKETVWYQIFPERFANGDKANDPEHILLWGSKDPDREDIFGGDLQGVRDHLDYLTDLGVNGIYFCPIFKATSNHKYDTIDYYEVDPAFGDKKLLKNLIDEAHKRGIRIMFDAVFNHMGVHSPQWQDVLKNGEKSIYKDWFHIRFFPVDSYQMTDLPETAENIPYDTFAFTPFMPKLNTANPEVQKYLLDIATYWIKEFDIDGWRLDVANEVDHHFWKKFREAVTEIKPDIYILGEIWHSSQAWLQGDEFHAVMNYAFTDSIKDYFAKKKITASQMVSGMNHQQMLYRDQVNEGTFNLLDSHDTARILTLCQGNKELMKSVMAFMFLQKGSPCIYYGTEIGMTGEDDPDCRKCMIWEKEEQDLELFGFIKELVSLRKQLSKIISEGSTQWLIVYDREDKLYFTRELEGQIIYVYYNQSKEPGLGA

SEQ ID NO: 6237 - protein, 564 aa, Enterococcus faecium; identical to SEQ ID NO: 6236
  misc_feature (B) LOCATION 1...564
  hypothetical: YES

SEQ ID NO: 6238 - protein, 424 aa, Enterococcus faecium
  misc_feature (B) LOCATION 1...424
  hypothetical: YES
NQRSNRMNTIERNYEQAKEKYATIGVDTDAVLEKIQDIKISMHCWQGDDVKGFLTPDGELTGGIMATGNFPGAARTPEELRQDLEKAYSLIPGKHKLNLHAIYLDTEESVDLNEIEPKHFEKWVEWAKKEEIGLDFNPTFFSHPMMKDGFTLAHPDKEVREYWIEHGKRSRKIAEYFGKETGQTSINNFWVPDGMKDNPIDRFTPRERLMESLDEIFTEELDERYVQDAVESKLFGLGAEAYTVGSHEFYMGYGLTRDKLVCLDAGHFHPTEVISNKLSSLALFSKGIMLHVSRPVRWDSDHVVLMDDELQEIAKELVRNELLEKTNIGLDFFDATINRIAAWVIGTRNTQKALLKAMLEPVERLKEMELAFDFTSRMAYTEELKDFPYADVWNYFCYKNQVPVGLDWLEEVQEYQKDVLELRK

SEQ ID NO: 6239 - protein, 290 aa, Enterococcus faecium
  misc_feature (B) LOCATION 1...290
  hypothetical: YES
EQRRNKMISGQTKLAGLFADPASHSLSPLMHNTAFEANNIDAVYLAFQVNPMNLKQAVESIRTFDMLGVNLSMPNKTAVIPYLDEVSQEAQLIGAVNTIVHEKGRLIGYNTDGAGFMQSVQEAGISIKKKKMTLLGAGGAAKAVTVQAALDGAEEIVVYKRNNQTFAQVKETFEQLSYRTSCKIKVRDFADTHQLRKDLKESCLLVNATDIGMGKKINQSPLLDISMMHENLAVFDLIYAPRETRLLKEAKKVGAKGYNGLGMLIYQGAIAFELWTKEKMPIHVIEKLFD

SEQ ID NO: 6240 - protein, 81 aa, Enterococcus faecium
  misc_feature (B) LOCATION 1...81
  hypothetical: YES
NKRRLVMEILIALVPMLAWGSIGLVSGKIGGDANQQTLGMTIGAFLFSLVVFFVVSPVITPWIFLIGFLSGLAWSVGQNGQ

SEQ ID NO: 6241 - protein, 305 aa, Enterococcus faecium
  misc_feature (B) LOCATION 1...305
  hypothetical: YES
LKRRTYMPEHKSGFVAIVGRPNVGKSTLLNRIVGQKIAIMSDKAQTTRNKIQGVYTTPEAQLIFIDTPGIHKPKHRLGDFMVEAAYSALKEVDAVLFMISADQKRGRGDDFIIERLKNVHSPVYLIINKIDKIHPDELLGIIEDYSTQMPFAQVIPISATEGNNVERLMDVLVSEMPEGPQYFPDDQVTDHPEYFIVSELIREKVLFLTRDEVPHSVAVVVDSMKRNENDKIHIQATIIVERDSQKGIIIGKGGKMLKQVGTKARKDIENLLGDKVFLELWVKVQKDWRDKKVYLQDFGYRKDEY

SEQ ID NO: 6242 - protein, 142 aa, Enterococcus faecium
  misc_feature (B) LOCATION 1...142
  hypothetical: YES
LKRSEKMIKVYTSPSCTSCRKARAWLQANQLEFEEKNIFAEPLTESEIKKILAATEGGVQDIISTRSKIYEKLGIDFNELTLKQMIVLFKEYPSLLRRPILIDEKRILIGFNEDEIRSFVPREIRCVARNLIYLQNNNILNS

SEQ ID NO: 6243 - protein, 479 aa, Enterococcus faecium
  misc_feature (B) LOCATION 1...479
  hypothetical: YES
RKRRKTTMKIVGVTACPTGIAHTYMSAEKLEVTARNLNHQAKFETQGVKTENQLSEQEIKEADAIILAVDKEIELDRFAGKKVKRVSTSRAIKEPQVVIDEALRDIGVFVVSNEKEPAANEKKPTIYNHFMNGVNYMLPFVIAGGIIIALSFAFGITAADPNSADYNVLAAAFSRIGGDTAFAMMVPALGAGIATSIAGKAGFAPGIVAGLLASTGGSGFLGGMIGGVLAGYICDFLANKISVKKEFSAIYQLIVVPLLSILIIGLLMVFVIEQPITWVLDALTNWLNSLGNTSGLLFGLLIGIMMAADMGGPINKSISTFSIGLMSAGVNAPIAACMAAGMTPPLGIALATLLFKHKFTKEERTSGQSCWILGASYITEGAIPFAVSDPIRVIPSLMTGSAVAAGISMAAGVTSMAPHGGIWVMLIPNVMNNLPMYVLAIAAGTVTTAFMLGLLKKTVKEKKQDKWTKNENLTNEVEA

SEQ ID NO: 6244 - protein, 242 aa, Enterococcus faecium
  misc_feature (B) LOCATION 1...242
  hypothetical: YES
TKRSETKMYGYGMYGFLDPTFLLVILGLVISGIASAYVNSTFRKYDQVRSKNNVTGTQAAQYILQSQQINNVGVQQIAGDLTDNYNSGNKMLSLSQATAQSTSVAAIGVAAHECGHAVQDASGYVPLKIRAALVPAANFGSMISFPLIMVGVLLSWNSTLINIGIFAFSLALLFQLVTLPVEFNASRRAIQILSEGGLLTEEEVPMARHVLFAAALTYVAAALSTFLQLLRLILLFGGNRRD

SEQ ID NO: 6245 - protein, 79 aa, Enterococcus faecium
  misc_feature (B) LOCATION 1...79
  hypothetical: YES
QRRRKKMTFEEILPELKKGAKIIRKGWSGFELYVVLVSDDEFDGCPVTPYLLIKTSDEGFSSFAPTVCDILADDWAIVE

SEQ ID NO: 6246 - protein, 310 aa, Enterococcus faecium
  misc_feature (B) LOCATION 1...310
  hypothetical: YES
VQRRQENLKRLSIRKKKEARWAYLFISPFIIGFLVFMLGPMLFSVIGSFTDYNLTSKMNFIGLANFKRMFVHDDLFWKSLYNTVYFVIFNVPLTTIFSVFLATVLNQKIKGISVFRTAFYLPAVLSGVAVYILWMQLLSPSAGLINTFLGWFHIPGPAWLFDPQWTKPALILMKIWSSGGAMLLYLATLQNVPRSLYESAEIDGAGVWGKFKSITLPLITPIIFYDVITSTIGSFQIFQEAYVMTKNGTGGPANSLLFYNLHMWNKAFVAFDMGYAMAMSMILFLIVLVLTFVNLKLAPKWVYYSGGDGK

SEQ ID NO: 6247 - protein, 103 aa, Enterococcus faecium
  misc_feature (B) LOCATION 1...103
  hypothetical: YES
LKRSWQQKLAYEIVPSKHVIKYLKKLKEKPLKEKFLNLIYDEIAIDPYKGEQKTGDLSVIWSSGFKYAGTTYRVAYEIIENKVIPVLLCGTHEKFYEQLKKLI

SEQ ID NO: 6248 - protein, 717 aa, Enterococcus faecium
  misc_feature (B) LOCATION 1...717
  hypothetical: YES
KKRRMCMVNTQKQLEEAYLKNVYQKLIDKKNELRESMDTAKIEGNQSLKEMAGELRLNFDSYLDNLDTFSMIEMKNREIDQMNIKQKNAENQLAKIERLLKSPYFGKVVVDFLDNEPKESFYIGTANFTDDADENLVYDWRSPIAELFYNNMIGPSSYTVRQNKIDTVIKERRQFLLERDRLVKFFDTSVAIQDDVLLEVLGQDETNEMKAITATIQSEQNTIIRDVKSQNILVNGVAGSGKTSAIMQRIAYLLYLYRDTMTSDDLLILSPNHRFIDYISNVLPSLGERNPLNLTIIQLVSQLSAEEIEGEEAYFKRITGENVSEQTERLRSKKFIDNLKQSDPLFLDHPNFIRGLTKNGKTVLSKKTIEKIYEKVPAHPKLIDRLQATKKALMSEWKNHLLKQAKSPAVQNQVLSLTEDRQLELFGKLISDDSEQSIVAYARKLLQKKYRKITRQIEEMAWVDEHQLFERIYEKRYGSAYAWQPTRTVDEAVIILAIRHLLVEKVNVPAFRYLLIDEVQDYTLAQLGLLIELFPKTHFTLVGDENQAIFNSSTTFADIMRCFDDYHLPIHRYDLRNSYRSSGAITELFKTYAVDQEKIDIVSIRPQGKEPEYRSFRSSEELLKILAEILVSLKGEKAAVITQTEEETQTLQESIKKNSYGLENCQIIPLSLAKGLEFDHVILYPFENDGDEQRRRRQMYTAISRGMKSIVVLERAT

SEQ ID NO: 6249 - protein, 348 aa, Enterococcus faecium
  misc_feature (B) LOCATION 1...348
  hypothetical: YES
VERRKEMKTYDAIIIGSGVSGLSAAYGLKEAGKTVLVVEEDLWGGTCPNRGCDPKKVLLSAVEARNRVKQLSGKGFNEIPTANWEELQKFKRTFTDPVPESRKKQLAEAEIDHLSGTARFLDDSSIEVNEEVFHADYLVLATGQRPTILPVEGKEYLKTSADFLSLPVLRKEIIFIGGGYIAFELATIANAAGSKVTIVHHNQRPLKEFEASLVEEAVHQMEASGIQFAFGVETQKIISEGTRYRLVGKETELVADMIFCATGRQPNTESLALEQANIVFDKHGIAVNDYLQTSNPKIFACGDIVSRKTPKLTPVATFEGNYVAKRITDATSEPIKYPIIPTMRLRQS

SEQ ID NO: 6250 - protein, 217 aa, Enterococcus faecium
  misc_feature (B) LOCATION 1...217
  hypothetical: YES
NRRRIMETTEEQAKVLEAKRQKSFWFADWSFPLIVGIMSAAVFAGTHMYVMYGVGAFNEVSIVAMLKAGLDGGSYGAAAAFGASFLFARILEGSLVGILDLGGSILTGIGIGVPAILLSMKIAAPIDNFALSLLTGLVLGLIVGGIIVLIRKFTINQSNSTFGADVMMGAGNSSGRFLGPLIILSACAASIPIGIGATLGALGFYAWKKPIAGGAIL

SEQ ID NO: 6251 - protein, 288 aa, Enterococcus faecium
  misc_feature (B) LOCATION 1...288
  hypothetical: YES
KRRRGLLANNYQAATELQKSGWSIYPLSPGTKIPIKGSSGWNDATNDSNQINEWWTEDATRNIGLMLEDHQMVVVDLDQHSETRNGVENYKKLASMYDPFPSTYTEITPGKGIHFFFKIPDGVIIQQETGAFADIFGRDDKGKSLSGIDIITKGVPIAPTMIISRSVGRAYEPIENVSLNNIAPAPDWLVNLLLKKPQEIKTQYRPVAKTGTAKKLDMIVQGAGEGSRNDHLTKLCGWLLWHGVDNQTLAELIYTANAYNEPPLKDKEVNQIIRSMIKKDLRGKAHGS

SEQ ID NO: 6252 - protein, 295 aa, Enterococcus faecium
  misc_feature (B) LOCATION 1...295
  hypothetical: YES
QVGSVYMDYWEKANHSWSEDSKRVILTPTQRSRNLFFYIQEIGYFKAPIPYYTERAHLPSYLIKFTLSGKGSLTYNDNQQQLKAGDLFFIDCQEYQRYQTISEEPWEMDWIHLNGQNVQSFYQEFTKDGHNTFHSTGDPSENKIHHLITELIHMQQGTNARTDFQSSVAIHELLNELILQKYQLDFEEEDIPAYVYKLKQYLDEHFKETITLDQLEQQFLLNKYQLSKDFSKFIGSPPIDYLISKKLSYAKDLLRYTEFTVRMISEEIGIENFAYFSRLFKAKTGLSPRDFRKFS

SEQ ID NO: 6253 - protein, 408 aa, Enterococcus faecium
  misc_feature (B) LOCATION 1...408
  hypothetical: YES
RLGRATMNKKNNGMMKNALYYVLVILAMVMVVYFIFGNNGQRSSDIEYSKFTEQLQAGKIKEFEVQPANGVYKITGEYKEQQTVANSGGLAILGSTDTTTTHFTTIILPNDTTLSQVTELAKENKVATTVKEESSSGIWVSLLLSFLPIVIIIFFFYMMMGQQGGGGGGGGRVMNFGKSKAKEADKKANRVRFSDVAGAEEEKQELVEVVEFLKDPRRFVELGARIPAGVLLEGPPGTGKTLLAKAVAGEAGVPFYSISGSDFVEMFVGVGASRVRDLFETAKKNAPAIIFIDEIDAVGRQRGAGMGGGHDEREQTLNQLLVEMDGFDGNEGVIVIAATNRSDVLDPALLRPGRFDRQILVGRPDVKGREAILRVHARNKPMADDVDLKVVAQQTPSFCRSRFRKCLE

SEQ ID NO: 6254 - protein, 442 aa, Enterococcus faecium
  misc_feature (B) LOCATION 1...442
  hypothetical: YES
KIGRNVLRTKKGIINALNFKTNDTQQDDTIILQKAIDQGAKEHLPVFIPKGIYLVGALFLKDKSHLIFEEGAVLKGRTDIEAFPEIDTRVAGVEMKWPAAILNVLSAKDILIEGKGIIDGQGDHWWELYWGKDQKSGTRAEYDQKGLRWIADYAIKRPRACLLYHAEHVVVRDLIFQKSGFWNLQITYSNDVLVEKVIIRNNDGPSTDGIDIDSSTNVRVYECDLACGDDCIAIKSGRDGNGARVNRKSSRIEVARCKIRSGYGVTIGSEVSAGVSDVYIHDIDFFQSDCGIRMKSSKERGGVIENIRVENLNMIDVQFPFSWIMDWHNEYNRKNSNDLAQMPESWQAVAEEIPESKQMTKVKDIHIKNVQACLSPGYSLPSRAFDLVAFPEKPIEDVCFSHCQITAKEFGRIEAVQNLCFKSCDLSIETGNTAANNTFDNR

SEQ ID NO: 6255 - protein, 165 aa, Enterococcus faecium
  misc_feature (B) LOCATION 1...165
  hypothetical: YES
NKGSESMMSQTKVERYLEEQKISYQPLDFSHVVEESFTEELQKRGIDPALICKTLVVKGNKTGVIIALIPLNDHLDYKKTRQVTKDRKVGFPGMDFVLMHTGYPHGANTPIGIKLAHPDYCFLADSSLKEKEEVIVSSGEIGRSLRIKVADLEKIVHPIYADLIS

SEQ ID NO: 6256 - protein, 138 aa, Enterococcus faecium
  misc_feature (B) LOCATION 1...138
  hypothetical: YES
SRGSQMGFFDKIKRAFTGEEKTEEVEVQEKYDKGLEKTRKTFGERMNELFANFRTVDEDFFEELEETLIGADVGFETAIRITEALRQEVKLRNAKKSAEVQNAIIEKLVDLYEAEGINEVNELNIQGRRTNSYFVCRC

SEQ ID NO: 6257 - protein, 71 aa, Enterococcus faecium
  misc_feature (B) LOCATION 1...71
  hypothetical: YES
PSIFIKNGTGASDKSGKSEMENYLALVAIILKAVCGLASLEGAFRCSKIKQAISTKKKSRFVHLFQGWGSL

SEQ ID NO: 6258 - protein, 123 aa, Enterococcus faecium
  misc_feature (B) LOCATION 1...123
  hypothetical: YES
NSFGVYLGEPSSEQLNKGEARHALCRNIFYGRKGKLYQTYYDGMEEQLNALGLVTNAIIYWNSLYLEKVFEQIKTEGFDCSEEVLRKQFPLISDHINFVGKYSFRYEKELSNGILRPLNIENY

SEQ ID NO: 6259 - protein, 117 aa, Enterococcus faecium
  misc_feature (B) LOCATION 1...117
  hypothetical: YES
DSFGGKKMDKKRSLYSMQQEVDEYIQQFKVGYFSPLAQMARLTEEVGELAREVNHTYGEKSKKASEPVNSVAEELGDVLFVTMIMANSLNIDLTEVFEKNMEKFNQRDHNRFERKDE

SEQ ID NO: 6260 - protein, 89 aa, Enterococcus faecium
  misc_feature (B) LOCATION 1...89
  hypothetical: YES
NKFGTSKTCQQSILVLSLSVLFHKLDFLPVQSYRIIPTCLFCVFFTAALVPGRITPMTGIERAALISSKATAVAVLQAITSILIPCSTR

SEQ ID NO: 6261 - protein, 380 aa, Enterococcus faecium
  misc_feature (B) LOCATION 1...380
  hypothetical: YES
KLFGEWAIKLNKTGDAKNSSRLKKRLLKRLATQLSIFTVATISAFMMFFFVSRFLFGLYTWEWSDRFYQFAKNLERNYIFVVLIALLAGGLVILLRTWSRSMAQLDEVLEASRKLYQNQIEPLKLSEDLQEFEWELNQIRQEVVLSQHQAKEAEQRKNDLIVYLAHDLKTPLTSVIGYLTLLRDEQEISSELRKHYLSISLDKAERLEELINEFFEIARFNLSNIELMPTKVHLKMMLEQLSYEFLPLLSSKQLTLESELEADLSIRFDVDKMQRVFDNLLQNAINYSYEGAVIKLSAKTDQDKKRVKIIFSNQGPTIPPEKLSRIFEQFFRLDTARQTNRGGAGLGLAIAKQIIELHAGQLTAQSKDEETSFTIDLPLS

SEQ ID NO: 6262 - protein, 318 aa, Enterococcus faecium
  misc_feature (B) LOCATION 1...318
  hypothetical: YES
TEFGKISSTTAAFSIYRTEKSQTRTSDLHRSCQKSGRTLDHVLLYGPPGLGKTTMAMVIANEMTVNIRTTSGPAIERPGDLVAILNELEAGDVLFIDEIHRLPRVVEEMLYSAMEDFYVDIMVGQGPTAHPVHFPLPPFTLIGATTRAGMLSAPLRDRFGIISHMEYYDEQDLQEIVLRSSDIFQTEIIEEGALEIARRSRGTPRIANRLLKRVRDFAQVQGDGKIDRPIADQALTLLQVDQAGLDYVDQKLLRTMIELYGGGPVGLSTLSVNIGEERETVEDMYEPYLIQKGFLKRTPRGRIATAYAYEHFGYDYHI

SEQ ID NO: 6263 - protein, 323 aa, Enterococcus faecium
  misc_feature (B) LOCATION 1...323
  hypothetical: YES
KLLGTIQKESNFRKEDFMFSLLATAGTTDSSGETLTDQAVSKVNAFQRFWDGIDWDAILAAFIQKSLYLIFLIVLFWILHRVGKYLIDKSFNQYSKKAILNESRLKTLHSLLNTIFHYTLGFFFIYAILSAIGVPIGSLLAGAGIAGVAIGLGAQGFMSDVITGFFIIMEQQMDVGDYIKLANLTIEGTVVSVGIRTLQLKATDGTVHFIPNRNITTISNLSRANMQVLLDIRIVPEEGYDKIYEIIDRVNRTLAEKYQEELQTEPSIFGLVDLGNSNFAIRTVCYALNGKQYALKEEFLSSYVKELTASGFTIPNSPIAVGK

SEQ ID NO: 6264 - protein, 165 aa, Enterococcus faecium
  misc_feature (B) LOCATION 1...165
  hypothetical: YES
TNLGDRSSYRFFIKCHGHDNRRKTLMLRQLIVFDVMIEKAKKNYERLGLTDKVTLLEGQAADILPELSGPYDFIFMDSAKSKYIEFLPECLRLLRKGGVLMVDDIFQGGTILLPDEEIPRGKRAIHRKLNEFLRVVMDHPDLTSTILPLGDGVILMTKESETIEL

SEQ ID NO: 6265 - protein, 61 aa, Enterococcus faecium
  misc_feature (B) LOCATION 1...61
  hypothetical: YES
AGLGEDQHPIDGMLAPDVGSSHPGAVVGPKGWAVRPLKRHASWVQNVVRQFGPYPSRALEI

SEQ ID NO: 6266 - protein, 400 aa, Enterococcus faecium
  misc_feature (B) LOCATION 1...400
  hypothetical: YES
EMLGWKEGCVMTLYKTIWTLLKANKSNLLIGVIITVVATFFFAQNIDVENTSLQDAKIALISEEESPVVDGLRKYLNDKETVVTLDGTSQKEIDDALYFNRVNIILHLPADFTEQVEVGKMATIKIQSRPDAFSKTVVTQQVNTFLQTLILFQEEDKTIDAAMEQTQMALSVTGEVELSAGYSQRMKKLLTGTTFNFLSYGLFLSIFSGFSVINLAFNRKEISKRNQSAPITKRNLNRKVTFSLISYSLLLFSGFLLLMVLLVIHTSWDITVWYHILNTFLFLLPIISFSACITSLVKNSETSGGIKDIFITGSCFIGGVFVPAEYLPEMVSKIAAFTPTYWFVQNNNLISETLSYNQTFAESFWFNGCVLVAFAAVFSMIQFILGKERNYRWQPNWAKN

SEQ ID NO: 6267 - protein, 192 aa, Enterococcus faecium
  misc_feature (B) LOCATION 1...192
  hypothetical: YES
RVIGGTAMNKQEAIKKLESIKAIGNDAIAACYNESINSGITLMKKIDEPQKPVIPQLVAGWLEKSTDPFTKAEKIAYLIKSKDGDSYYFCDWFVRDGIVTQEQGEELLAWATRQSYETLLSLYNGYEVEKEPLWAIKNADGNYLTKCALWGKDGVNYSFECNPSHRLLFTDKATADAAALLVNGTVEEVVER

SEQ ID NO: 6268 - protein, 238 aa, Enterococcus faecium
  misc_feature (B) LOCATION 1...238
  hypothetical: YES
RVIGGTAMNKQELIDELAKYVKSYENVMDEHGQGRYGAYEVSLKLVKRLNESKITDEQAWNKVAEAYPESAQSLRNTLDNAVFGKTGEPQKHVMPKFFDKWAKQVLEKRDKFYAISLITRAGWGYGVDYELDNGRSPSGTKELLNWIVENEGDDYPNKKKATEALLYGYEVEEEPLYYVKLPVVYFNHLDLETYLMKDDRGNITIADNNDFDDMKFTESEIKAIDERYWPFAVPVEKV

SEQ ID NO: 6269 - protein, 352 aa, Enterococcus faecium
  misc_feature (B) LOCATION 1...352
  hypothetical: YES
NPIGLFRLEVEIIKMYKGHRIRAGDQHLIYHFVLGWLSALFIGWMGVFYFPELRQFGLSKVSFSTIEIAWSMKDLVCLLGSLALSGSMMLLYIHFFPDHWRSLWNRQKLARMILENHWYEVKQTQSDGFFKDLNRSRTKETISYFPKVYYRMKDGLLSIRVQISLGKYQDQLLKLEKKLESGLYCELVEKELKDSYVEYTLLYDMIANRIGIEEVVAENGTLRLMKNQVWAYDSLPHMLIAGGTGGGKTYFLLTIIQALLKSDAELFILDPKNADLADLGTVMPHVYSQKEEISKCVEDFYERMMARSRSMKEMPNYKTGENYAYLGLPPNFLIFDEYVAYMGANRFPTSIE

SEQ ID NO: 6270 - protein, 250 aa, Enterococcus faecium
  misc_feature (B) LOCATION 1...250
  hypothetical: YES
TGIGAVLVGLLVQLFASPAGISVTTFLISLLSGAFWVIGQTGQYTSFNLIGVSKTMPISTALQLVGTSLIGVFAFGEWSGSMGKIIGAAAIILLVFGSALTAISDDPGKKGGITKGISLLASTSIGYWVYSALPKLVDASGLSIFFPQMIGVFLGAVIYVIFRKPTAFSEDKSWKATIVGAIFSVSALAYIFSANENGVATAYIITQLNVIISTLRGMYILHDNKSPKEKKLTIIGLLLIVIRSMVPVFI

SEQ ID NO: 6271 - protein, 460 aa, Enterococcus faecium
  misc_feature (B) LOCATION 1...460
  hypothetical: YES
RNIGMKEEATTLPQQFIKKYRLLLGEEASDFFSALEQGSVKKGFRWNPLKPAGLDMVQTYHSEELQPAPYSNEGFLGTVNGKSFLHQAGYEYSQEPSAMIVGTAAAAKPGEKVLDLCAAPGGKSTQLAAQMKGKGLLVTNEIFPKRAKILSENIERWGVSNAIVTNHAPAELVPHFSGFFDRIVVDAPCSGEGMFRKDPNAIKEWTEESPLYCQKRQQEILSSAIKMLKNKGQLIYSTCTFAPEENEEIISWLVENYPVTIEEIPLTQSVSSGRSEWGSVAGLEKTIRIWPHKDQGEGHFVAKLTFHGQNQMHKEKKTRKKSKVQMTKEQEKLWTEFSNDFHYEATGRLLVFNDHLWEVPELAPSLDGLKVVRTGLHLGDFKKNRFEPSYALALATKKIENIPCLPITQKEWQSYTAGETFQRDGNQGWVLLVLDKIPVGFGKQVKGTVKNFFPKGLRFH

SEQ ID NO: 6272 - protein, 90 aa, Enterococcus faecium
  misc_feature (B) LOCATION 1...90
  hypothetical: YES
FGIGRRTPFIRKNRTVTRLLSQSFFRIQQVKLLRNIQRVKLKIADKRRWKFYVFLLVYAINKLNIQNTIDFNERASINGCVVFICPGRVK

SEQ ID NO: 6273 - protein, 258 aa, Enterococcus faecium
  misc_feature (B) LOCATION 1...258
  hypothetical: YES
GLIGEKIMNIEKFITARKAANLSQKEVSEGICTQATLSKFENNGQVPSLKILIKLCNRINLPLVELFSSMNVINTQLDEQLEKAEFSLITSEYEQLTQILAAIDPKVIDESELIARYYYLKGFEMIFTNAPITDVLFHFDQLLMAETANTLFRLLAYTGIGMVYAREKELEKAEVYFNRVFEKIYTYPIRTTEDIWRVLNIVFHCGVFFAQDGDLETSDALLNYAIDICSDNHLTYYLARAAAQLVKKASVFTPSLAP

SEQ ID NO: 6274 - protein, 306 aa, Enterococcus faecium
  misc_feature (B) LOCATION 1...306
  hypothetical: YES
MKIGVIGVGNIAEKAYLPTYAKKQGTLDFYFATRNKETKERIQKEYGFQHLYETIDELLEEKIEACMIHAATKVHYELAKKCLENGIHVYIDKPLSVHLNEVRELQELADKNQIILMIGFNRRFAPMVEELKRIPDKRLIHLQKNRIAAKETTEFVLYDLFLHLIDTAVYLLDEPILRTKYQIRETKEFLEYAILQLETQNQTAILTMDLASGANIEKYQVTSKNGTYEVNDLTQLVIQDADGKKVKEFGDWTNTLVKRGFEPMVEAFFSQIRLGKSETELLKQKEVVRSHELCEEVLKDHYRHQL

SEQ ID NO: 6275 - protein, 74 aa, Enterococcus faecium
  misc_feature (B) LOCATION 1...74
  hypothetical: YES
ITVGSPDNSAASFVIITFSMFSFEGISNITSIMISSMMERSPRAPVLRSIAFFAMALNASGSNSSSVLSRERSF

SEQ ID NO: 6276 - protein, 153 aa, Enterococcus faecium
  misc_feature (B) LOCATION 1...153
  hypothetical: YES
IGVGSVSLLSRLNDDMKAAMKAKDKESLQVIRMIKSSIQNEQIKEGHDLTEEEELTVLSREMKQRRDSLHEFEEAGRDDLAEKVKSEIVIVEKYMPEQLSDEEIRQLVQEAITQTGASSMKEFGKVMGAIMPKVKGKADGNQVNAIVKELLQS

SEQ ID NO: 6277 - protein, 717 aa, Enterococcus faecium
  misc_feature (B) LOCATION 1...717
  hypothetical: YES
SYSGDHHQGTYLAGVWYPDKTRVGWWKNGYPEYFGKVINAVDFIAMDLFIDDQLIDLATLTTEDFYWELNMKNGVLTRSYTVTTPSNKVRLSFERFLSIVKNEAAYIRLTIEMLEGNGTVKVISKLDGNVQNEDSNYDEHFWNDIDHGVKEEIAYLTTKTIPNNFEIEQFTVTSGMRHYVDGKLYTPSYQEGTLAIEGSFTFDLNENETLLIDKEVLIFTSRDIPEGQQATHLFKEFNELNVHYPQAKEEQTAAWSKRWELADVVIEGDDEAQQGIRFNLFQLFSTYYGEDERLNIGPKGFTGEKYGGATYWDTEAYAVPLYLALAKPEVTKNLLKYRHNQLPQAIHNAQQQGLKGALYPMVTFTGVECHNEWEITFEEIHRNGAIAYAIYNYTNYTGDIDYLKNEGLEVLAEIARFWADRVHFSKRNNQYMIHGVTGPNEYENNINNNWYTNTIACWVLRYTRENYLKFKEESTAKISDDELAHWQEIAENMYFPVDEELGIFVQHDTFLDKDLKPVAELSASELPLNQHWSWDKILRSCFIKQADVLQGIYFFNDSFTKEEKQRNFDFYEPMTVHESSLSPSIHAILAAELGMEDKAVEMYQRTARLDLDNYNNDTEDGLHITSMTGSWLAIVQGFAQMKTDHEQLRFAPFLPKTWSAYSFHINYRDRLLFVAVSNEQVTLNLLSGEALPLEVYEKAYVLTDHLTIPLREGEANV

SEQ ID NO: 6278 - protein, 283 aa, Enterococcus faecium
  misc_feature (B) LOCATION 1...283
  hypothetical: YES
SGPGLEDSETDLSNSHHATESLSQDKKHAGKVGKMKLKQLPLEYQKAIPVLKKLENAGYEAYFVGGSVRDILLNQPIHDVDIATSAFPEEIKQLFPKTIDIGIEHGTVLVLENDEQYEITTFRTESTYQDYRRPDHVEFVRSLAEDLKRRDFTINAFALKEDGEIIDLFDGLQDLEEQILRAVGNPHERFHEDALRMMRGLRFVSQLGFKLEEETFYAIKKKHELLGKISVERINVEFIKMLLGNERAAGIHAFIETECYICCLGLKKKAKHFYVLLNYHPSH

SEQ ID NO: 6279 - protein, 139 aa, Enterococcus faecium
  misc_feature (B) LOCATION 1...139
  hypothetical: YES
KEPGIYSFSSEKRVYDVLKRAGGLLEEADSDRIHFSAKIEDQQVLYIPAVGEELPEHLDQLASSEGKQPTADSEPPKININTATPSELQQIPGIGSVKAQEIIRFREENGSFQKVEDLQEISGIGEKTVEKLKNFVTIK

SEQ ID NO: 6280 - protein, 95 aa, Enterococcus faecium
  misc_feature (B) LOCATION 1...95
  hypothetical: YES
DTIFHSIFQTSFNSWNVFTRNNPTDDRIFKFETSTFFIWCKFNPYVTVLTFTTRLTYKLTFGLSASTESFTVRYLRRTYVSFNFEFTTHTVNDDI

SEQ ID NO: 6281 - protein, 297 aa, Enterococcus faecium
  misc_feature (B) LOCATION 1...297
  hypothetical: YES
LKAGIHMVKRKTVKEVLFIIIGTSIYAFGLVYLNIANHLAEGGVSGITLILRALFGIDPAYTTLLINIPLILLGGKILGKRSLAYTVLGTLSLSFFLWIWQRVPLEINLQHDLLIVSLLAGLVAGVGSGIVYRMGGTTGGSDIIARILEQNYGITMGRSLLAFDIIVLLASLTYIDLKRMMYTLIVSYVFSRVIDSILDGGYSAKGLLVVSNKSEEIAPLLMTGLQRGVTFLSGEGAFSGNSKKIIYMVVSSSELTEAKRIVHEIDEKAFLSIINVHEVEGQGFTYLKPQTRLLKKL

SEQ ID NO: 6282 - protein, 514 aa, Enterococcus faecium
  misc_feature (B) LOCATION 1...514
  hypothetical: YES
GDYGWCKQNTFREWSQKWNDISTSSFAELESQIFEVENLNESFRFLKGKKAVVEAEATMDQMEKQVTEIREGLKELRETEERNSLAVQQALDVYEELKEKVREDEHEYGPALFELQKQIKVIEKEFTQFVTLNTSGDPVEAREVLDKAEKHTYEVEALMKKIPPLYEELHTTFPEQLEEISDTYEKLMEEQYVFPEEDLAEDIAKVSRRIENSLANLEKTEVETVEFENRETADLIDSLYDILEREMEAQRYVKTNQSTIAEYIKHTTKNNRQLLIELDHTSQSYTLNHNEIGRVRGFQTEVEEMERQNEQMIPQIRQHEIPYSEVRTFYKTVFKVLEDIEKQQVEIDDSLHELRKGEKEAQEKIDTFEFKLRSLKRFVEKQRLPGLPNDYLEFFFVATDRIEELSVVLNKIRVNMEEVNRLVALCEEDLELLDKKTHDLVDAAALTEQMLQYANRYRHTHEEVREAIDKSYYLFNKEYHYQEALDEIGTALERVEPGAFKRIEDFYFNHPDLV

SEQ ID NO: 6283 - protein, 340 aa, Enterococcus faecium
  misc_feature (B) LOCATION 1...340
  hypothetical: YES
RSYGSSERYFVSSNNHSARNISKSKDHRRSDIRLFFSLYFSCTDLLGHLYRDRKSATVFRKTFYPSVNLKNRNGASVAGTISIFCFLYILPSILKPFHVKCKSKICSEVENMKTPLTIEIESSLYQYCIEQGGLVVEEVTMPDDQGIVDTLSCLTKFDGSREWRCYELKVTKADFRSTAKLSFVGHYNYFVLPSKLYEEVKTEIPTGIGVLVYRPYTVEEEMPASGTFLIAKKAAKKELAVPEEALTNRFMASLFREVRKAKQMERGVKYFPKDQLYKELKRRSENQDPFSNERYYERFLEEIASQAINELQEEVIALQHDYEYLRQQQQIRRLPTEPLE

SEQ ID NO: 6284 - protein, 396 aa, Enterococcus faecium
  misc_feature (B) LOCATION 1...396
  hypothetical: YES
LVHGFPRSRFWFAILASKSATIRRTIERYIVDKEVSLGYQHVYTPIMGDVELYKTSGHWDHYQEDMFPPMDMGDGEMLVLRPMNCPHHMMVYKNTIHSYRELPIRIAELGMMHRYEKSGALSGLQRVREMTLNDGHTFVRPDQIKDEFKRTLELMVAVYADFNITDYRFRLSYRDPNNTDKYFDDDAMWEKAQAMLKAAMDELELDYFEAEGEAAFYGPKLDVQVKTALGTEETLSTIQLDFLLPERFDLTYVGEDGENTHRPVVIHRGIVSTMERFVAYLTEVYKGAFPTWLAPIQATIIPVSVDAHGDYAYEIKERLQMKGLRVEVDDRNEKMGYKIRASQTQKIPYQLVVGDKELEDATVNVRRYGSKETAVEDLNIFIDAMEAEVKNYSREN

SEQ ID NO: 6285 - protein, 111 aa, Enterococcus faecium
  misc_feature (B) LOCATION 1...111
  hypothetical: YES
YNHGEVRNVKEIQSAKNPRIKELKKLHKKKYREEKEEYLLEGFHLIEEAASSDADIKELFVTQRGRKEWGDWLAANKGISTFLVSDDVMDAVSDLSLTHQGFLSVYWLLPA

SEQ ID NO: 6286 - protein, 356 aa, Enterococcus faecium
  misc_feature (B) LOCATION 1...356
  hypothetical: YES
KNHGRKVMKKLRKIFGSQNYSKGLTRSQQNQFAQTMGELLLSGFSLQESLYLLLTIRSFPPVILANIQHQLKEGQAFSEVLSQIGYGAEQLVQIELAERHGNLPTTLLEIAKQFRLVEGFRNDLKKLLAYPMLLLTFLLGILFSMRLFVLPQLIGSGMVMQEHWGIQLIQVFHWYVLLFILAVTLLALLVRYRLMKLSPVDQSEWISRQLLIGPIYSLYQSAYLSLEIGKLFHEGFELRQIIVCLKETKQESLIQHLASKLIQGLEAGMSLAEQFQNYRFLSEEFSKIVLQGEAKGSLGKELIFYSEWTRKQLFKRLHHWMHFIQPIIFLGVAALILLVYAAVLLPVYGSIEEVLP

SEQ ID NO: 6287 - protein, 257 aa, Enterococcus faecium
  misc_feature (B) LOCATION 1...257
  hypothetical: YES
KDNGGVIMSDGRMLFERERQDMARIVRVIFERKNTNVAGGNFSFKTTDDQGKDYIIMTPTMMSEAYLGEISPAQVLVVEPRTRRIVDGVGHLTREINMHEAMYETNPAIKAVLHAHAPNAMFWATTGLPMPNLTEATAKVKEIPVMDFEPNCSEELAELTSDYVKKQHLELPHMLLLNSHGVLINTGGESGIEAIHKALQILDTVEWNAEIAYKQTIFQALGITDGFYSKGEKIGGLEELKHKTAIYNKSVIAAGGD

SEQ ID NO: 6288 - protein, 286 aa, Enterococcus faecium
  misc_feature (B) LOCATION 1...286
  hypothetical: YES
MVNGKSQTLVISLVRRKKMSKKKGARQRFKKRKSYLRWLGIFMIIGFLILASPIYTHKKVDIPDEVSTNAFLNTKELTMVSKEKGANQQLVFEFAIDDEDQSLLKELANLNYRVEVKTAKGDYQAIKAKVIKVSDDYFAVKLSHVPEEYIAMRLTIIPEKIDPKVDMQEPQDLIFYIHEDKVKDHVKDEDYEQHAINYKVKGYKKEQKAAQKQIESFQATIDLNEELVKKLKDQLPYQVAEDQENTENKINSYQQEIETSKTQMKDQEESIQKLQEKIDRMTKENI

SEQ ID NO: 6289 - protein, 258 aa, Enterococcus faecium
  misc_feature (B) LOCATION 1...258
  hypothetical: YES
MNNGNRRVLIRRSNNYLLTKMKWEVFMNYQQQIKMRAWLRRPLWTYVFLGIQTIVFIIMELFPRLEIPYYTGMYGPYLVHFNEWWRLVTPIFIHFGVMHFVMNSLILYFMGQQIEAIYGHWRFFLIYMFSGIMGNTASFAFNEANVLSGGASTSIFGLFGALFILGFHFKYNTAIQQLVRHFLLFIAMTFVFGLLDTSVNVWGHVGGLVGGLVLGNILGLPKQQTSYSIHQKILSTLVFVFLFVICILLGLKKYGLLV

SEQ ID NO: 6290 - protein, 538 aa, Enterococcus faecium
  misc_feature (B) LOCATION 1...538
  hypothetical: YES
TINGKKGLIAMKYDFEMDLDEQSSVGKIAAQIKPGSKVLEFGPGNGRLTKHLIGAKQCEVSIVELDKELFDFVSEFAQDGFYGDIESFEWANYYAGQTFDYVLFADVLEHLVDPGKTLKKVREFLNEEGEILITFPNLAHNSVMIDLFNNQLPWASYGLLDETHNSFYTHDGFQKVFEKAGLYINIEDYLYLAVGDTELKSTYEELPEAVRYDFKMRPFGEVYQYFFSLMKHPVAQSSIAQPQNSNYVKVLEVIQQTKQDEIIQQIPFNNFTGENETLSFHVSELAERMVFRFAQQPSFIEFSAEAAGEKLTFIDSNAVVKTVNDCYLFDGKDLPEFFLTDIAGKEVTIHCHYRFIGELTPTMKELLETIRPMAEVTKQLSEKNDELERENHYLIENNTRLDQTLKTTINRYCTLLESDEWTIKHRLGRRKKETSKKIQEKELSLCIDEKIWDAETKILKIIGWGIANSDRQPLSYKLSADQSPFFEAIPVLREEVNQAKQLAEGAKAGFELRILCEKERSFLVEAVAQNGQSWIIEM

SEQ ID NO: 6291 - protein, 173 aa, Enterococcus faecium
  misc_feature (B) LOCATION 1...173
  hypothetical: YES
NRNGGHQMIGPIVREMLLENQETFLIPAENVANVMYHHPLSHGLLVLSKVGYSKIPVLGKDDHFVGLVSLSDVVNKMIDLQTISMDPLEGLTVADVTETDVPTIDENWELEEVLHLLVDSPFLPVVTEDRIFKGIITRKELLKAVNFMVHELERRNILSPKIEELKEQIDIVS

SEQ ID NO: 6292 - protein, 215 aa, Enterococcus faecium
  misc_feature (B) LOCATION 1...215
  hypothetical: YES
ITNGESTMFNNKNTAVVLTDPQVEFLKPAGGGFGLTKDILEKYNTIENMIEMVKQAKEKGYKLFISPHYFYPHDHKWQFGGAGEHMMLEQQMFARKSQYESVEEGSGADFIEELKPYLDENTIISSPHKIFGPESNDLALQLRKNGIDTVILGGMNGNLCSDSHMRELVESGFNVVVATDAIGAPGQEAMDAALTNFGFIADQVMTTEEVLEQLS

SEQ ID NO: 6293 - protein, 150 aa, Enterococcus faecium
  misc_feature (B) LOCATION 1...150
  hypothetical: YES
WRNGGLSMLMGEFQHNIDAKGRLIVPSKLREELGEKFVLTRGLDGCLFGYPMSEWENLEAKLNEMPLAKKDARTFVRFFYSAATECELDKQGRINIPSTLRNYAALTKGCVVIGVSNRIEIWDETRWQDFSAAAEENFDEIAESMIDFGL

SEQ ID NO: 6294 - protein, 104 aa, Enterococcus faecium
  misc_feature (B) LOCATION 1...104
  hypothetical: YES
SVDGVVGAGVVDSSVVEDSGTVVDSSVAEDSGTVVDSSVAEDSGAVVDSSVAEDSGAVDSSVEDSGVVDSSVAEDCVADDDSSVIEDCVADDSSVAELCAVDEA

SEQ ID NO: 6295 - protein, 64 aa, Enterococcus faecium
  misc_feature (B) LOCATION 1...64
  hypothetical: YES
KTDGTLTKVVSKSLFLNKRCSKAIFSVLSQIYAKMWKAIFTKFFLLLETKRLFHNLSIKRCSIS

SEQ ID NO: 6296 - protein, 167 aa, Enterococcus faecium
  misc_feature (B) LOCATION 1...167
  hypothetical: YES
YLDGFFIIKSKGVDVMYQQVEEYVKKFQEKYPSYQSEKLGFFSFGDTEKMADELSELVVKKIKTGTSSGYDLYKQENEPLPKVGQLDVVLNGKNEPVCIIKNINVTILPFSEVTKEHAWKEGEGDRTLAYWRKVHAEFFEHAYKEALNIEFTEEKLVVYEEFEVIFF

SEQ ID NO: 6297 - protein, 230 aa, Enterococcus faecium
  misc_feature (B) LOCATION 1...230
  hypothetical: YES
KEDGKMKVLIVLTNVEKYEKIERPTGLWLSELTHFYDVLVKNGIDADFVSPKGGYVPLEPQSVLNMDEIDWAYYEDEDFRNRALGNTLRPDDVDANDYAAVYYAGGHGTMWDFPEAIDLGKVASQIYRNEGLVSAVCHGVVGLLPVTDESGKSILAGRTVTGFSNEEEEANGTTNEVPFLAEDALKEKGANYQSGAAFSEVVQIDGRLLTGQNPQSAHQLGEAVVEALKN

SEQ ID NO: 6298 - protein, 126 aa, Enterococcus faecium
  misc_feature (B) LOCATION 1...126
  hypothetical: YES
YRDGDRMRVQSYGNSVFDVKREFQDSRRKTKKLIAYFILSAIVFYIVKFVLELNSIVFTDMVHKMLNGEPINFNFDYMLEKAQSNQIVAFIVSIYYFIEKSIFSLKDFFFEMLTKLTTFYNKISKN

SEQ ID NO: 6299 - protein, 77 aa, Enterococcus faecium
  misc_feature (B) LOCATION 1...77
  hypothetical: YES
GIRGEEAAQTRVQQTEAPKSAAVTNFDILKRLSNLEREVFGKKLDQQASAVKPAQPNPNNYTNADTSLDDNEKTRQF

SEQ ID NO: 6300 - protein, 264 aa, Enterococcus faecium
  misc_feature (B) LOCATION 1...264
  hypothetical: YES
PFRGEESFIRFKELKEARNVPFWKAIVYLLVLSIIMALPISFQVFQVLNNIQLDGQKIATRIPDFTIQNGQLQTEEKEGFIYQTNSIIFTFDPEGKRTEQDISTDLMGNFVSVGMLKNKLIIALPNTGTTSALLNNNQLELPYTNESLKNLTGKQLRSFLSEASIPLWIKVLTFIFSIYPSFLNLLITLLFTNIAAFLYARFRLTKATFLDCLKTLIYSISLPTIIATILMVFLPSFDTSAFIAFAGIFIFAQAVKGWAKISIN

SEQ ID NO: 6301 - protein, 169 aa, Enterococcus faecium
  misc_feature (B) LOCATION 1...169
  hypothetical: YES
KFRGEEPLKKPNCLPAQSTRAFILFGDAHEKLWEITEEALRPLTPAEAFPNTQNKLAGFKNGYGTVLFFKDTDVVKGLQEQFELYADNFPDWSEQSNGIATANTWVALVDKGLGANLQHYNPVIDEAVAKEWNIPSNWKLRSQLVFGSPETPAGEKEYMNDADRFRVFG

SEQ ID NO: 6302 - protein, 145 aa, Enterococcus faecium
  misc_feature (B) LOCATION 1...145
  hypothetical: YES
TFRGEEHLSEYLNSTLAIVDHADDASTEGGYVIGDVQGKTCIMVDDILNTGATLARAANVLKENGAKEVYACASHGLLSDHAKSILDNAPIKDICITDSVFTEENRHPENLTIVTCSELMGEAVKRIHENTPMSPLFRLEEKEFE

SEQ ID NO: 6303 - protein, 225 aa, Enterococcus faecium
  misc_feature (B) LOCATION 1...225
  hypothetical: YES
TIRGGHFVKDHIIPKATAKRLPLYYRYLRILNNAGKKKVSSTELSEAVQVDSATIRRDFSYFGELGKRGYGYDVEDLMHFFAKTLNDDQLTNVALIGVGNLGSALLKYKFHQSNSIRISCAFDVNEEIVGRIVDGIPVYPMEDMSEQIKIQQIEVAILTIPAERAQEVVNQLTEAGIKGILNFTAARLNAPSDVLIQNVDLTNELQTLIYFLHSDANAHSENTAE

SEQ ID NO: 6304 - protein, 350 aa, Enterococcus faecium
  misc_feature (B) LOCATION 1...350
  hypothetical: YES
KKRGSQMPEPSISVTPIPNTELKKITLKNDELTVVLLNYGARLHQIFAPDNKGHLENVLLSYDELSDVLTDESFFGATVGPVAGRIRNATWGNHQLEKNAGNHHIHGGTNGWSFQYWDVEVFKNPQSIGVVFYLQDTFSDYPGPITATITYQLTANSLEMITKTNSPVETICNPTNHAYFNLSGNGKRDIDTHELAVQAESLLVLDEDKLPTGEQITQADLPINFKKPHTIEEILNAYPEGLDDVFVLTTPKRSKKVLCLSEKQSGRQLSIATTNRSVVLFSTTGFEADFMINGKHMHSNYGLAIEPQEFPDLVHLPELGSIALYPGQEKVNHTTYQFTILPNEQIENTE

SEQ ID NO: 6305 - protein, 187 aa, Enterococcus faecium
  misc_feature (B) LOCATION 1...187
  hypothetical: YES
EKRGNLFWTIFLKRLPFAVFYRKKETLHMVEKVYPMTLEGKEKLEKELEELKTVKRGEIIERIKIARGFGDLSENSEYESAKDEQAFVEGRITTIENMIRFAQIIDNDGVDADEVSIGKTVTFIELPDGDEEEYTIVGSAEADPFSGKISNDSPIAQALIGKRKNDEVTIATPGGDMLVKIVKVEQA

SEQ ID NO: 6306 - protein, 304 aa, Enterococcus faecium
  misc_feature (B) LOCATION 1...304
  hypothetical: YES
KKSGMTMDNPEISVVPVPETEIKKITLKNDYLEVVLLNYGARLHQIFAPDKEGKSENVLLSYDRFEDVLTDKSFFGATVGPVAGRIRDASWGEHRLEKNCGSHHIHGGTKGWSFQFWEVEVFKTPSSIGVVFYLKDEFSTYPGPITATITYRLTKNELEMTTSASSLVETICNPTNHAYFNLSGNGTRDIYEHQLTVFLDGVLELDQEKLPTGNWTKKEKLPIDFRKSPTLQEILACYPDGLDDVFLLHHPRLSKTSLQLFEKHSGRQMTIATSNKSMVLFSTTGFEADFFCQXDVFHHPQFCX

SEQ ID NO: 6307 - protein, 133 aa, Enterococcus faecium
  misc_feature (B) LOCATION 1...133
  hypothetical: YES
GGSGMRKALKQLISEKESELKNLEDSLGLGFPIVEQAKMTQISHLRLESEDLRQIEKSIQLNDNQKIVLEWLKSETILTREAPILSVNAFSDKNLLGKLPDKVRKAYKLLACKQEYEVLAAFAQWGLEQEEVG

SEQ ID NO: 6308 - protein, 646 aa, Enterococcus faecium
  misc_feature (B) LOCATION 1...646
  hypothetical: YES
AEGGTESSSVLGFFAVELRLFKLIFFEYNYVVRLDCFFDRHAIITLIEYEGEYQMNERIKNKLALLPDQPGCYLMKDKNGTIIYVGKAKILKNRVRSYFTGSHNTKTERLVSEIEDFEYIVTESNIEALLLEINLIKKNDPKYNIMLKDDKTYPFLKITNEKYPRLVITRKVLKDKALYFGPYPDVGAANETKKILDRLFPLRKCKPSQTKEPCLYYHLGQCLCPYYFDVDPKVYTKIVDEVKKFLNGGHEKIESEIHQKMEKAAENMEFEKAAEYRDQIRAIETIMTRQKMTNTDLLDRDVFGYAIDKGWMCVQVFFVRQGELIERDVSMFPFYNEAEEDFLTYLGQFYQENEHFIPKEVLIPDTIDKPSVEALLATKVLQPKRGEKKKLVELANKNASVALNERFDLIARKQERTIGAVERLGNAMNIPTPIRIESFDNSNIMGTNPVAAMVVFIDGKPARKEYRKYKIKTVNGPDDYASMREVIYRRYSRVIREGLPLPDLILIDGGKGQVDVAKDVLENQLGIDIPIAGMAKNDKHKTNELLFGIDLAVVPLERNSPEFFLLQRIQDEVHRFAITFHRQLRSKNSFASRLDEIEGLGPKRKKMLLKEFKSLKNITAATTEELQEIGLPKNVAQNVFDKLHQE

SEQ ID NO: 6309 - protein, 435 aa, Enterococcus faecium
  misc_feature (B) LOCATION 1...435
  hypothetical: YES
KNIGVLEQTFQSFGVDAKVVKASLGPSVTKFEVQPAVGVKVSKIVNLTDDIALALAAKDVRMEAPIPGKSLIGIEVPNGKISMVSFREIIEAQPNHPDKLLEVPLGRDVSGRVQTADLSKMPHLLVAGSTGSGKSVAINGIITSILMRAKPHEVKLMMIDPKMVELNMYNGIPHLLTPVVTNPRKAAQALQKVVQEMEERYEKFAATGVRNISGYNEFVQQKNLENGTKHPTLPFIVVIVDELADLMMVASNEVEDAIIRLAQMARAAGIHMILATQRPSVDVITGIIKANVPSRMAFAVSSGTDSRTIIDSNGAEKLLGRGDMLFLPMGENKPIRVQGAFISDHEVERVVQFVTDQQEAHYEEKMMPTDEVETTGGPEQPQDELFEEAKALVVEMQTASISFLQRRFRIGYNRAARLVDELEAHGVVGPSEASK

SEQ ID NO: 6310 - protein, 252 aa, Enterococcus faecium
  misc_feature (B) LOCATION 1...252
  hypothetical: YES
QIIGHFPCFSRHFPLRLFVFSSEQVRLVVSDFYTPYRTLVKECFPNARIVADRFHISQHIGRAFTNHRIQVMKTFKKGDRRSKHLKKYWKLLQKNAWELKGQHRYWRPSFRDHLTEAEIVDRLLSYDDSLKRGYEVYQDFLSVIRRQDVPEFVALLKEDYKELPEHYQPVFTTFKKYQTEIKRALRVPYSNGPIECLNNHIKVLKRIAYGYRNFQNYRERIFLYRGKYFKKTKNTTQLTKARTTTRLDKIAV

SEQ ID NO: 6311 - protein, 317 aa, Enterococcus faecium
  misc_feature (B) LOCATION 1...317
  hypothetical: YES
RVIGTAENSTFHHQGQVHRQVEFHLGIQLQTEAAFTLVGGVFHLTNDHVRVEKFQFLRKAFFGEEVDEFIQHRFDVVGMDQVMEGLLQLLFSIVIQHVQQIQCWYSDVGIQVGSGQDQGSLLQVFRFVGGAVDGGAEFVVIQNDQLDIRLHVLLADAPQFLGNVPAGNAGDDDVFLHGEAFKILDVGDEVFFRCLGDGVETAAVQQLLADLQSEGGGEVVDYQKFSHNLGLQALVKLGQRAHIHQHDHAVTGLPFREPVLHLSHDIMDRGGEGHIDGVEKVLAAHFVGDPLDTGGGALPVSHQEGVIADLFIDRTYE

SEQ ID NO: 6312 - protein, 75 aa, Enterococcus faecium
  misc_feature (B) LOCATION 1...75
  hypothetical: YES
RISGTNGTAFAKIVCSFCHTFSKVARVLRCSVGSFINKIFSGTALRDGESPVKKWCVSPEFVDFDSIRKALSAKS

SEQ ID NO: 6313 - protein, 69 aa, Enterococcus faecium
  misc_feature (B) LOCATION 1...69
  hypothetical: YES
FRPGQSQVSFFKNPDLFCDSNSCCFVVTSNHDCFDSCTSCFCYRLSHFSTWRIDHSKQTNKDQIVFIFK

SEQ ID NO: 6314 - protein, 75 aa, Enterococcus faecium
  misc_feature (B) LOCATION 1...75
  hypothetical: YES
TSAGKMPPKAVTRRRTPRADRSGTNKLSRNPFHTGWVSIAVPVEFKSRGPIIQINGQKRPGVYMAKPSPVLIGSP

SEQ ID NO: 6315 - protein, 142 aa, Enterococcus faecium
  misc_feature (B) LOCATION 1...142
  hypothetical: YES
PGAGLHLYGTVRRRRGQHRVPGLHLTRKDCTGKAPVTDTETEPDEKPEKTKSGGSGTLILVLLVALAAGGAGYYFKIYKPKKDLDDAEDFDELTGGDEEETVNEDEDVDAQEETRQTGDEEPAAYDEPEEPDYPENYGGEDD

SEQ ID NO: 6316 - protein, 64 aa, Enterococcus faecium
  misc_feature (B) LOCATION 1...64
  hypothetical: YES
SGAGAIYQSADYHVVVYPDLHPGRAGRASVWPVGVHQNVCDGGCGAAGDRSDPDPDGALDPHSA

SEQ ID NO: 6317 - protein, 220 aa, Enterococcus faecium
  misc_feature (B) LOCATION 1...220
  hypothetical: YES
RGYGCGHGGLRLLQSLGASLEGYTEGNPLLSTKKLHFDRRNVLVSKVKLIIAADVTNPYTGQQGAAWQFGRQKGGIDTTLAFLDKQAGKIAQQIKDFWEVDLDDIPGSGAAGGIGGALFLLGAKMVSGFDLVSQITGLEKKIEQADVIITGEGRIDQQTIHGKVPYGVAVLAKKYRKPIIAICGSRDQELEGLSDFLPIVLSIHLGPIGLEEAMEHRQTX

SEQ ID NO: 6318 - protein, 229 aa, Enterococcus faecium
  misc_feature (B) LOCATION 1...229
  hypothetical: YES
GGNGMLRTQFEEELLNLHNQFYEMGMMVSSAVHKSVRAYIKHDKILAQEVIENDININNMETRLEKKSFEMIALQQPVTTDLRMIITVMKASSDLERMADHAVSVAKSTIRVKGQTRIPEIEKEISDMSDYVKKMVDNVLVAYVKTDEKDARTIANMDQRVNDYFNRIYNATIKNMQENPETVISGTDYLNVASYLERIGDYVTNICEWIVYLATGKITELNTNHNEIF

SEQ ID NO: 6319 - protein, 487 aa, Enterococcus faecium
  misc_feature (B) LOCATION 1...487
  hypothetical: YES
KMNGLSSWMEKYILPVAAKIGAQKHLVALRDAFIGTLPATMAGSVAVMINAIIRDLPQQFNSTYADSLAADKGIFAVLNVIIGINGFVWNGTLAIAGLIFAFSWGYNLARAYGVNDLAGGIVGLATLIQGISFGPALSAALDVNVPSNVADAINSSEIGATIADGTLSVGLWGWLKLDHLNGNAYFTVMIMGAISVIIFCKLMLANITIKMPDSVPPAVSKAFAAILPATIALYVIAIINYIVGRVADGQLIIDLVQKYIAEPFLGLSQGLGAVLIVTVFVQVFWFFGIHGPNVLAPVLEGIWGQAQLINIDIFQKGYNGKTGTPAVLDAIEDGKAYMWVRGSFDAFAWFGGSGGTIVLLIAILIFSKRADYLTVAKLSIGPGIFNINEPVMFGLPIVLNAIMFIPFLIAPVVATAIGWTATYLGLVAPVSQQVTWVVPPFLLSFLATGADWRAPIVTLVCMVVTFLIWAPFVISANKMDPAAGEQQ

SEQ ID NO: 6320 - protein, 282 aa, Enterococcus faecium
  misc_feature (B) LOCATION 1...282
  hypothetical: YES
ITDGNARFVRSLFLSKTRKTSLRVSKSSKYGKMAIENIGGMNMVTPKYQRVVLKLSGEALAGDAGFGIKPPVIKEIIQEIKEVHELGVEMAIVVGGGNIWRGQIGAQMGMERAQADYMGILDTVMNALALQDTLENVGVPTRVQTSIEMRQIAEPYIRRKAERHLEKGRIVIFAGGTGNPYFSTDTTAALRAAEIGADVILMAKNNVDGVYSADPKVDANAVKFEELTHLEVIAKGLQVMDSTASSLSMDNDIPLLVFNLNEHGNIRRAILGENIGTTVRGK

SEQ ID NO: 6321 - protein, 236 aa, Enterococcus faecium
  misc_feature (B) LOCATION 1...236
  hypothetical: YES
RKDGDADRNNSIGFIFQSYNLIGHLGIIENVELGMTLSGVSKDEKRKRAEDALHRVGLTNHMHKKPNQLSGGQMQRVAIARALANDPDILLCDEPTGALDTETSIQIMELIQELSKEKLVIMVTHNPELAHQYADRIIEFSDGKILTDSHPHIERPKDDQFNLRRTKMSFWTALKLSFNNIRTKKGRTFLTSFASSIGIIGIAIVLSLSSGFQKQIDNTQAETMAKFPITISKVTN

SEQ ID NO: 6322 - protein, 130 aa, Enterococcus faecium
  misc_feature (B) LOCATION 1...130
  hypothetical: YES
KLDGSGIKYTKKREALLTYLVKRNRYVSAKEVFDYMNQEFKGVSYDTIYRNLHDFAEIDLLEETDLNGEMKFRFHCCQGEIGHHHHFICTVCGTTKEIHMCPMNYFEEQLGGCTIEGHRFEIFGRCENCQ

SEQ ID NO: 6323 - protein, 274 aa, Enterococcus faecium
  misc_feature (B) LOCATION 1...274
  hypothetical: YES
SFCGMIVEKRRLPMQYYDQHLHTYFSFDSEEKFENYLAYQPEFFVSTDHFDLNNPSTGKDDIPDYPAYINKLDSLKETYSTKFLRGIEIGVVPGQEERIVDYLAQHPYDLKLVSIHQNGRFDYMDDVVLTKDPIQTTKEYFDQMLQVLTDFPEGDILTHFDYGLRRFTFTAEEFAEHFEAQLLTIFKKVVERELAMELNAKSFLKYGNEDLYRYAVPLYQSVGGKLFTLGSDAHVAEDYQLGFKKMSQLLADCQVEKLLVIQGKERRLTPLPIL

SEQ ID NO: 6324 - protein, 254 aa, Enterococcus faecium
  misc_feature (B) LOCATION 1...254
  hypothetical: YES
GRRGAVETLNIAGFLIHFPIMAVGADIDGAVLRKVDFPIPAVFVLLQAVRHIPPLPVFLDFHLHQRKAVPGFIGNAKLGGSTAGCPAGGRCNFDGEIGCRDWRGGFAGASGQVGSADRAVGVDRTKFTAVFADADRDGRGGFHNTVCQVQQAGGAVGVDRAGFTVGGADTDQFGRRFRLFAGTAGYILRTDGTIRVRCVCRTPRFTSTDGFRLRANAGGCLLHTDGAVCVEGVRRAANIAETGNSDLASSQRVA

SEQ ID NO: 6325 - protein, 117 aa, Enterococcus faecium
  misc_feature (B) LOCATION 1...117
  hypothetical: YES
LFSGLKLPSMINSGNGICGIEIFKLSKMPLILSLIQSIGALTVFLMPSHMLAIVLLTLLNMSETIPVRLDQPLEIAFFPSFTLELIVLVIPFQRFKAVFLIPFQIPVIHEDILFQTL

SEQ ID NO: 6326 - protein, 61 aa, Enterococcus faecium
  misc_feature (B) LOCATION 1...61
  hypothetical: YES
KHSGGRSFNLLSKRELGEQTAEFKRGGNMRDNQKKFAKRWYHGLKIQKESHYSKLLNKHYR

SEQ ID NO: 6327 - protein, 118 aa, Enterococcus faecium
  misc_feature (B) LOCATION 1...118
  hypothetical: YES
SNSGCCSIVGEWNSGRGGRKMKLKDGFYASSHGIGGLMLDMPTKNPKTRKKSKFKVGDMVRCEAEEFVYPFRGYVKKILSNSAIIRIENTMKCDRSTAKHKHYLAVARLVDMEVIKSK

SEQ ID NO: 6328 - protein, 378 aa, Enterococcus faecium
  misc_feature (B) LOCATION 1...378
  hypothetical: YES
KNGGISMNEQTKEWSRKILNVASEKIDAELDRMGNKIPYISYNGKYTDVIKDRGIDWWTNGFWSGILWQLFHKTKREKFKEAAIQQEQLLESALYHFSDVHHDVGFLFLPSAIAHYQQSQNKHSRQLGLHAATVLAGRYNISGNYLVAWNDHKPGWMIIDSMMNLPLLYWASRETGDPRFSKIARQHADTTAKYLVRKDGSTGHIAEFDAESGKYIRLLGGQGYNENSCWSRGNAWALYGFALSYRYTKNPYYLAIAEKIAVNFIQKIEKTGYIPLIDFAVKDSNIDTSAGVCAACGLLELAGYVSSVRSKMYHEAAINILQKTEKHYANWNMDEDGIIGGGAEAYHRELTYNVPLIYSDYFFIEGLLRLEQSELAIW

SEQ ID NO: 6329 - protein, 412 aa, Enterococcus faecium
  misc_feature (B) LOCATION 1...412
  hypothetical: YES
CRGGILVITLWQYTKKGRCPMNEITTEIVQTLFTKGDLNELFRSHLEKAINTLLRTELTAFLDYEKYDRTGFNSGNSRNGSYFRSIKTEYGELTLEIPRDRNGEFKQQTLPAYKRTNDTLETTIIHLFEKGVTMSEIADLIEKMYGHHYTPQTMSNMTKVLTEEVNAFKSRALNDKYVAIFMDATYIPLKRQTVSKEAIYIAIGIREDGTKEVLSYAIAPTESTYVWNELLQDINSRGVQEVLLFITDGLKGMKDTIHQIYPKAKYQHCCIHVSRNIAHKVRVKDRKEICDDFKAVYQANSKEEANTFLSGMIEKWKKNYPKVTQSLIENQDLLTFYDFPPSIRRTIYSTNLIESFNKQIKRYSRRKEQFQNEESLERFLVSIFDTYNQKFLNRSHKGFQQVTDTLVSMFTE

SEQ ID NO: 6330 - protein, 65 aa, Enterococcus faecium
  misc_feature (B) LOCATION 1...65
  hypothetical: YES
SFLGDDFIKLRVYLNKKQTCEFLGIDNNTLDKWIRIYNFPVIRIDGIVRFDIEDIKDFMNTFKTI

SEQ ID NO: 6331 - protein, 102 aa, Enterococcus faecium
  misc_feature (B) LOCATION 1...102
  hypothetical: YES
SFLGFINNCSGVSHWIISPSFINAIRSPSLIASSILCVTKTMVVPNSSCKDKTNSCNEFLEIGSNALNGSSIKITSGLAAIARMIPIRCCSPPDNSLGIRSR

SEQ ID NO: 6332 - protein, 60 aa, Enterococcus faecium
  misc_feature (B) LOCATION 1...60
  hypothetical: YES
RFLGVFSRFFVIREMFLRFFWHKNRCFLIELREMLEVSLKQGHDARKRAKVMRRSLFLGG

SEQ ID NO: 6333 - protein, 168 aa, Enterococcus faecium
  misc_feature (B) LOCATION 1...168
  hypothetical: YES
SILGGAIMHKGIYAGLLGTVILFSACGYKTKNSVKESSAAISTTEVGSTKSTSTTSITNTSTGNVDSQHSQSSIQSFSISSTSEMQESTVPSLPLENSDKALLFLIAHRSELQSDDIVISFYQKIDRDYLFTASSKQIRSQGGSGSVGFYRVSPEGSITMTDANGTPF

SEQ ID NO: 6334 - protein, 128 aa, Enterococcus faecium
  misc_feature (B) LOCATION 1...128
  hypothetical: YES
MILGGEDMYCRKCGKEITNESKYCQFCGALQETDETTGTDTVKKSTEQTINEMKEQIVHGQETGKLYLIIGWISMVVSLAFIPVVFGAVAVIMGYLYREKDEQMGTILMIAGVAGAIFGVLLGMSMSY

SEQ ID NO: 6335 - protein, 246 aa, Enterococcus faecium
  misc_feature (B) LOCATION 1...246
  hypothetical: YES
STLGGIKMKPIIGIAGNQLIRATDTFQGNQVSYTPHGFVDAVLDAQGLPLILPVMSPDSAPQLIEKIDKLILAGGQDVSPQLYMEDPHPKLTETNIQRDQFEQALILEALKQRKPIFAVCRGLQLLNVVLEGTLYQDLSLYPKWSVKHEQQPTAPQFATHEVKIVSDSLLSDLLPDSYFVNSYHHQAVKDLSPLLKAIAFSNDGLIEAVQSKDNMHKILGVQWHPELSHRVDSSEQRLFDFFVNEF

SEQ ID NO: 6336 - protein, 334 aa, Enterococcus faecium
  misc_feature (B) LOCATION 1...334
  hypothetical: YES
ENIFSFAYFIIESRRSLVMSIYTCTMNLAIDLFIETEEMHPFMVNRTKEDGIQANGKGVNVSLVLKMLDFPSTALGFSAGFTGKYIEDYLQKKQIQTEFIEVPGMTRINVFTQVNQTREEYKLVNQGPEIPQAAVHNFLNQIRALQAEDYLCVSGSLPRGMSPKVLVEISRICQEKGIHLIIDSSDQEVMDCLPYRPFLLKPNEEELSSWFGRKMVTDEDYFVYGQRLVESGAENVLLSLGEKGAILFTKDRVIRGNSPKGKVVNTACAGDAMLGTFLAGYMNRRPLDETLRKSIAAGSSTDFRKGLTDFLDVEELSKQIKIKEERFERWENIN

SEQ ID NO: 6337 - protein, 73 aa, Enterococcus faecium
  misc_feature (B) LOCATION 1...73
  hypothetical: YES
ADLGLDEYLEGDGLSVVEWGNLLEEALPEDYLELILEKSDTDLEKRYVKLISYGEQSETFKQRILEKWAENHE

SEQ ID NO: 6338 - protein, 97 aa, Enterococcus faecium
  misc_feature (B) LOCATION 1...97
  hypothetical: YES
DQLGENITSYMNRRGHILRDASVDWAIGVMNDGHVIADFDSDLAGEGAHAEVKIVAISSGRQIQGIDTRVTNKAPHTIGHILQHGVIREKGTLTFNG

SEQ ID NO: 6339 - protein, 161 aa, Enterococcus faecium
  misc_feature (B) LOCATION 1...161
  hypothetical: YES
HLLGGVKMNQEYKNILVGIDGSEQALAAFKKAVEVARRNNGKVYVANVIDQQFYNFMGYAPIDQNLVDQQTETAKEMIEECKEYGKSVDYTNIEGIIAYGSVRESMAVKLPKKYEIDLIMVGQSGLNAVERFMTGSVASYVIRHSPCDVLIVSDEEEQPSN

SEQ ID NO: 6340 - protein, 528 aa, Enterococcus faecium
  misc_feature (B) LOCATION 1...528
  hypothetical: YES
KSLGCEKKVVQENIVIEMQNITKEFGTFKANDNINLQVKAGEIHALLGENGAGKSTLMNVLSGLLEPTSGKILMRGKEVKITSPTKANQLGIGMVHQHFMLVDAFTVTENIVLGSEPSRAGMLDHKKARKEIQKVSEQYGLSVNPDAYVRDISVGMEQRVEILKTLYRGADVLIFDEPTAVLTPQEIDELIVIMKELVKEGKSIILITHKLDEIKAVADRCTVIRRGKGIGTVNVKDVTSQQLADMMVGRTVSFKTMKKEAKPQEVVLSIENLVVKENRGLEAVKNLNLEVRAGEVLGIAGIDGNGQSELIQALTGLRKAESGHIKLKGEDITNKKPRKITEHGVGHVPEDRHKYGLVLDMTLSENIALQTYHQKPYSKNGMLNYSVMNEHARELIEEYDVRTTNELVPAKALSGGNQQKAIIAREVDRDPDLLIVANPTRGLDVGAIEFIHKRLIEQRDKYKAVLLISFELEEILNVSDRIAVIHEGEIVGIVDPKETSENELGLLMAGYTLEEARKELEKGAGAHE

SEQ ID NO: 6341 - protein, 424 aa, Enterococcus faecium
  misc_feature (B) LOCATION 1...424
  hypothetical: YES
MNILVIGAGGREHAISKKLLASPKVDTVYCAPGNPGMTKDGINCVAISERDHSALIHFVKKEAIDWSIVGPEVPLLNGIVDDFMAEGLKIFGPTKAAALIEGSKSFAKQLMDTYQIPTAKSRSFECYEKAAAYIKENGAPIVVKADGLAAGKGVVVATTVKEALDAAEQMLNQHRFGDSSKKIVVEEFLAGEEFSLLAFVRNTKVYPMVISQDHKRAFDNDKGPNTGGMGAYSPVPQISKKMIEKAVEEVLKPAALGMKELGRSFTGVLYAGLIATKEGPKVIEFNARFGDPETQVVLSRLKSDFAQVIDDLLENRTVELKWQQEGYNVGVVVAAAGYPEEYETGMVLPDFLEEELSVYYAGVSSNNGKLVGAGGRLYLVEAYGETIKEAQKKIYTALMDKTTDGTFYRTDIGEKAANSELIVK

SEQ ID NO: 6342 - protein, 74 aa, Enterococcus faecium
  misc_feature (B) LOCATION 1...74
  hypothetical: YES
QSLGLDMRVLDIEDTEIELRDMDDEDDDLITVDDLTKFAEQQTAKELAKKAAEQVEDEKDDVIQNFETAEDNLD

SEQ ID NO: 6343 - protein, 823 aa, Enterococcus faecium
  misc_feature (B) LOCATION 1...823
  hypothetical: YES
SRIGGHLMENRQEVQELTLEEVMGDRFGRYSKYIIQERALPDIRDGLKPVQRRILFAMNKDGNTYDKGFRKSAKSVGNIMGNYHPHGDSSIYEAMVRMSQDWKLREVLIEMHGNNGSMDGDPPAAMRYTEARLSKLSGEMLADIEKETVDLVWNFDDTEKEPTVLPARYPNLLVNGSTGISAGYATEIPTHNLAEVIDGTIYMIDHPQASLEKLMEYIPGPDFPTGGILQGKDEIKKAYETGRGKVILRSKTKIEAMKGNKQQIVITEIPYEVNKATLVKKMDEIRLNKKIDGIAEVRDESDRTGLQIVVELKKDANAQGILNYLFKNTELQINYNFNMVAIDHMTPHQVGLKDILRSYIEHRKQVITKRSQFDLAKAQKRQHIVEGLMKALSILDEVIATIRESKDKKDAKKNLVDVFQFTEEQAEAIVTLQLYRLTNTDITELQKESESLIAQITELNKILSNDKELFSVMKKELREVKKNYSSARLTTIEDEIEEIKIDTQVLVAQEDVIVSVTREGYVKRTSLRSYSASKPEEIGMREGDYLLYSGELSTLDHVLLITNKANVIYRPVHELPDLKWKDAGEHISQTISNLSVDESILAVFPYQKIQAEKTFVFISKNGLIKQTRMTEFEPWRTYKSRPLSCMKLKAEEDELIAVYLKEDQPGLDVFLVTHQGMGLRYPLTDVPVVGAKAAGVKSMNLKDGDRIINGLLVLAEGDTPIVIVTQRGAVKRMLAQEISQTSRAKRGVTVMRELKKNPHRIIYMSEGRSKEITLMNQKGQQLTIDPTDFPIGDRTSNGSFAMDEKKGGEVIEVIDAPEIFIES

SEQ ID NO: 6344 - protein, 62 aa, Enterococcus faecium
  misc_feature (B) LOCATION 1...62
  hypothetical: YES
NNVGRSFPMNDKPKEKVYAERLDSSKKNREKITKEAIQDHKKENPKTKENKKFKFTKKEDLL

SEQ ID NO: 6345 - protein, 65 aa, Enterococcus faecium
  misc_feature (B) LOCATION 1...65
  hypothetical: YES
GIVGKIWRFNYMTEKEQVTKIVKKYNKSIADLSENATAKEFKTVIKYVADQANEKQRKLVGLNKK

SEQ ID NO: 6346 - protein, 141 aa, Enterococcus faecium
  misc_feature (B) LOCATION 1...141
  hypothetical: YES
LKVGKMMFGFFKKKEKEPKKVLAKEEKALSPEATEKIQSEITQLKQEISTTQDKHKLAKLYEQVGLKFSELYVNDQAIQYLEKSLENKQTIGDGYKKLMSLYNQKRADAARAGDDQGIDYYMGKMDEMRQIAKQVTIKGNK

SEQ ID NO: 6347 - protein, 103 aa, Enterococcus faecium
  misc_feature (B) LOCATION 1...103
  hypothetical: YES
KKVGLRTMSINTFVYSHPINVYIIKNLGITVEQFCELYAYPQGTVASWITRQRRIKSLPASFVYDLSLASSLNMSDVYEKLLSLEKEYDSFKIKHDKKIKKHI

SEQ ID NO: 6348 - protein, 804 aa, Enterococcus faecium
  misc_feature (B) LOCATION 1...804
  hypothetical: YES
VFSGNLREKEVVEMIKQSKISVRHLVEFILRRGSIDNCKKSNHTALEGARIHRKLQKDAGENYEKEVFLKTTVQLDEYYLIVEGRADGIFKRDGIYYIDEIKTSEPRFEDLEPEQVELFFHQARVYAYIYSQEHDLQEINLQLTYFQTAEEVITRKVEHQTREQLETFFKKLTEDYKEWLVFQENWRTVRNASLMALKFPHDEYRKGQRELAVAAYKTIRTKQKLFVEAPTGTGKTISTLFPALKAVGEEEGEKIFYLTAKTITRQVAEDAMTALKDTGAEVKSVTLTAKDKICFLDETTCNPDQCPYANGYYNRINEGLWDLLNHENQITREVIETYARKHTLCPFELSLDVSIWCDVIIGDYNYLFDPTVYLRRFFEDEKNEDYLFLIDEAHNLVNRSREMYSAELSYEKTKRSKEAIPKEFKKLHRRFNKLLKEFDSIREIAKEDHWDYHHQKAPAESLVKAGYQLSEKIKEWLAEFPEHPSQEQLLPYYFDLLHFLKVSEFYDDHYETTVEKTYRDLIVKEFCIDPSLFLEQSLDKGKSSILFSASFSPLSYYQETLGGQKSLAYKLPSPFPEGNQQVFIANYLETTYRKREHSLAKLVETIHAFADGKVGNYFVFFPSYQYLDLAVEAFRQQYPDSNVLIQETDMNEEERERFLTKFQTNPAETLIGFCVLGGIFSEGIDLRGDRLIGSMIVGVGLPQMNHEQELIKSYYDEKEHLGFAYAYQLPGMNKVLQAGGRVIRGMADQGIVVLADQRFSSFSYRRLFPQHWQTAREVRSVGELEEGIQRFWLSKEAVNQKNEE

SEQ ID NO: 6349 - protein, 212 aa, Enterococcus faecium
  misc_feature (B) LOCATION 1...212
  hypothetical: YES
VYSGGNKMAKKTVKDIDLKDKKVLVRVDFNVPLKDGVITDDTRIKAALPTINYVLEQGGKAILFSHLGRVKTEEDKEGKSLAPVAKRLGELLGKEVTFVPETRGEQLEEAIRNMNDGDVVVFENTRFEDIDGKKESKNDTELGKYWASLGDVFVNDAFGTAHRAHASNVGIASTGIPTVAGFLMEKEIKFIGEAVEEPKRPMIAILWWRKSF

SEQ ID NO: 6350 - protein, 717 aa, Enterococcus faecium
  misc_feature (B) LOCATION 1...717
  hypothetical: YES
TYSGDHHQGTYLAGVWYPDKTRVGWWKNGYPEYFGKVINALNFIAIDISINDQLIDLASLEPEDFYWELDMKNGVLSRTFTITTSTNKVRISFERFLSIVKKESAYIYLTIEMLEGSGTVKLVSKLDGNVQNEDSNYDEHFWNEIDRGTIEEIGYLTTKTIPNNFGIEQFTVTAAMRHFVNGKSVIPDYHEDTLALHGCLSAELSQGETWSVEKEIIVLTSRDIPEAQQAEKAVSELTNQTNNYIQAKEEQTAAWAERWKLADVVIEGDEEAQQGIRFNLFQLFSTYYGEDERLNIGPKGFTGEKYGGATYWDTEAYAVPLYLALAKPEVTKNLLKYRHNQLPQAIHNAQQQGLKGALYPMVTFTGVECHNEWEITFEEIHRNGAIAYAIYNYTNYTGDTEYLKNEGLEVLAEIARFWADRVHFSKRANKYMIHGVTGPNEYENNINNNWYTNTIAAWVLRYTRENYLTYQKEAAITISEEELAKWKDIAENMYFPVDEELGIFVQHDTFLDKDLMPVSDIPTSDLPLNQHWSWDKILRSCFIKQADVLQGIYFFNDTFTKEEKQKNFDFYEPMTVHESSLSPSIHSILAAELGMESKAVEMYQRTARLDLDNYNNDTEDGLHITSMTGSWLSIVQGFAQMKTAHDQLRFAPFLPKTWKAYSFHINYRGRLLFISVTDEQVTFELLEGSPLEIYVYEQSYSLADRLEITLRKEEANV

SEQ ID NO: 6351 - protein, 267 aa, Enterococcus faecium
  misc_feature (B) LOCATION 1...267
  hypothetical: YES
KKSGNDREWEKVWHSNKKVGDPIFDSCIDKKFQLTNDGLSQQFQELAQAIPLEYLEISCEIIEYTKEALQVQLNDSVYIALTDHLYTAIERHKMGIFVPNVLLYDIKQLFPKEYAIGKKTVKKISDKYHIKLSEDEAGFIALHLVNAQGIQSQQDNTYLFTITIQDILNIVRYYYKITFDEDSVHFFRFVTHLRFFLTRVLDGEKSEVGEVSEELFQVIQKKYKDTFGCVEKIADFLAETFNYQMSTDEKMYLTIHTARLVHENRCK

SEQ ID NO: 6352 - protein, 324 aa, Enterococcus faecium
  misc_feature (B) LOCATION 1...324
  hypothetical: YES
KRSGRIIMKKVLVTGCLGQIGSELITRLRQELGSENVIATDIRMPEVIEKNDIFEILDVMDYEKMRSIAEQYQVDTLIHLAALLSAVAEAKPQLAWNLNVTGLVNALEVAREFQLKFFTPSSIGAFGPNTPKDHTPQDTLQRPTTMYGVTKVAGELLCDYYYVKYGVDTRGVRFPGLISYATLPGGGTTDYAVDIYYSAIKEGKYTSFIDQGTSMDMMYMPDAIDAIIKLMNADPDRLVHRNAFNISAMSFDPEEIKASIQKIIPDFEMDYDVDPVRQSIAESWPNSLDVSCAQEEWGFSPKYDLDVMTKDMLEKLKEKLVETV

SEQ ID NO: 6353 - protein, 910 aa, Enterococcus faecium
  misc_feature (B) LOCATION 1...910
  hypothetical: YES
GGSGMKILRIEIAAFGKWRQKSFDFYSGNQLIYGGNEAGKSTIYQFIQAILFGFPSKGRKKKDYTPKDGSAYGGKIWLKHPVYGEFAVERYKQQNRGKSKVWLGDQVGSDELLEKLIAPLTKELFQQVFTFQQEQLMELDHLREKELHDALISLGITGSSQVFQKRQEYYQKAQQLFKKKGQKLLINQKLNEWKELQEKIHQKQEQEAYFGKLIQQEQEYESQQQQLLAQLKEANKQFSLARQQELNFSLYEEWQSLKKNSTTGLPDEQLLLDLESFSKRYQQTNERLEELEATLEKHSGMDQQSARYYFYLEQEQELKDLQQLQFTAEQLNEEWQRLQIETRETNSELKILEQRWHWQKNPLPEEFLYEEEWKHLLAEERRIADLESQISVRLQIAKEQQEMIEAEVNDLEETYPALLQNQSEIAPVSSSKPYMLMAGGAIIIAGIFVPMPLKVILLLIGAGMIGYFFYKRQPKIKTKNDFSEIKGMWQEKLGQLDLALAQLAEAEEKQKRTGEEKQILQQEVYRFADHRHLGKMDTLKLMKEYGQEVIDYQKLYGVFERKHKREQEIQEKLRQIDQKFEFVKEWLPIQDKTISEKMVLLSRFIQEMEQMKFARSYQQNTLLKQEINQLKKKQKVWIQEYSEQLTQAGLSYPSEVPVFLQKAKQAEQQMKRYNELSEMLTPLFPEELTKEKLSVRLRQLKEKQSQLQQEEKEASENRQRLQLQVEELQRDGTLDELYQQASRQKAKLQELLEEWGALEIAGTFLGDLSTEMSERQLPQLLRAAGDYLGILTKGNYQKILLKNDTLTLTDGYTEFPIYELSTGTKDQLIMAMRFAYLSLEANRSICPIIIDDGWLHYDHQRKYQLAELLAKFGEKYQIICFSSDKEMVSYYHEMNQIVKQLEGANNEKNS

SEQ ID NO: 6354 - protein, 136 aa, Enterococcus faecium
  misc_feature (B) LOCATION 1...136
  hypothetical: YES
WFTGISRLLWDWRNTMNNLEFALEMKNKRLASGLSQGELASLTHVSRYSINRFENGKANASKETQNIILRCLNYYICDKPFYLLVDYLSVRFPTTDALEIIRKVLGMKADYFIHYDYGYYGYKEHYAYGENQGHGF

SEQ ID NO: 6355 - protein, 344 aa, Enterococcus faecium
  misc_feature (B) LOCATION 1...344
  hypothetical: YES
LITGVQILMKKKSIILAATSALAVLTLAACSGDTNKDIATMKGGTITVSDFYDEAKLESSNQSLVQRMIIYKVFNNKYGDKVTDKQVDAEYDKQAKSLGDTFESQLEAAGYTKDTYKEYIRNNLAFEAGLKAHVDITDDDLKTAWKSFHPEVEAQIIKLSSEDEAKDVKKSADDGDDFSKLAKDKSTDTETKEDGGKVKFDSTTTTIPAEVKEAAFKLKDGEISDVITTTNPTSYATEYYVVKMVKNQNKGNDMDKYKDQLKDIATETKLSDNAFTTKVIGEELKDANVKIKDDAFENVLSAFTTTSSSTKDSSETTASTKSSDTKSTDSTKESSTEETTDSSK

SEQ ID NO: 6356 - protein, 296 aa, Enterococcus faecium
  misc_feature (B) LOCATION 1...296
  hypothetical: YES
RSAGSSMREKRAFYINGYAGIVGLVVLALVGLFFFYLGMWQAKVWALFLSIFLWLITLLLLSSATVVSPNQAKVILFFGQYLGTIRENGFFLTIPLAQKMTVSLKVRNFNSSVLKVNDLDGNPIEISAVVVFKVVDTAKALFDVAYYQDFVEIQSETAIRHIASQYPYDTFNENDLTLRGNTTAVSDELQKELQERLAVAGVEVIETRLNHLAYATEIASAMLQRQQAKAILSARQTIVEGAVTITQMALEQIEDGQEINFTDDRKVQLINNLLVSIITDKGTQPVINTGDMKDRK

SEQ ID NO: 6357 - protein, 71 aa, Enterococcus faecium
  misc_feature (B) LOCATION 1...71
  hypothetical: YES
RKAGSSHTYHLYTLHREHSPITSDRKTSSLYRRSLFKDRTDKKIPSLSITYTPSRYIASANAFRLLVLSKI

SEQ ID NO: 6358 - protein, 70 aa, Enterococcus faecium
  misc_feature (B) LOCATION 1...70
  hypothetical: YES
RWQGAPFIRNLGISHDYCHDLFYVNFISQICCFDRLKKATNPKPAEARRDKKPSGKQKNAGSTNIPLLLI

SEQ ID NO: 6359 - protein, 822 aa, Enterococcus faecium
  misc_feature (B) LOCATION 1...822
  hypothetical: YES
NRQGTFCRLIRKDKKRRKRTMTLTAEVIVDVPTMQTDQPFTYLVPSEMETALQVGMRVEVPFGNGNRHVQGFVMAIQKSEESANPSLKAVIRLLDLAPVVNEELLSLADYMKKITYAFKITCLQTMLPSVMKAEYDKLIYPLADTPEVQVLFDQREVISWKEAEEEGSLSQLIRWRQEQLVDIKYEVHTRNKVKTIRLVRSLLTEKQIEEEWAKLRQNAKKQKELLLCLSELSQEEPIAYFKNKGISTAVLNQGKEKGWLEFIESERYRDPYKDRVFDQTTALELNAEQKNAVEQIITAGQQQKDQVFLLEGITGSGKTEVYLQAIADVLSENKTAIMLVPEIALTPQMVERFKGRFGESVAVLHSGLSQGEKYDEWRKIEREEAQVVVGARSAIFAPLKNIGLIIIDEEHESSYKQDETPRYHARDLAIWRSKYHHCPIVLGSATPSLESRARAQKGVYQLLQLNHRAKAAAQLPAIEIVDMREEFQNHRTSTFSANLQEKIQNRLDKKEQTVLLLNRRGYSSFVMCRDCGFVLPCPNCDISLTLHMDTRSMRCHYCGHEEPIPNRCPNCGGNKIRYYGTGTQKVEEELRELYPQARILRMDVDTTRRKGAHEQILQKFGAKEADILLGTQMIAKGLDFPEVTLVGVLNADTSLNLPDFRSSEHTFQLLTQVSGRAGRAEKAGEVVIQTFNPQHYAIELAKKQNYEQFYQQEMHVRHRGGYPPYYFTVKITASHPEEQVAAKKIFQIANQLKEVLSPQSLLLGPTPSMILRVKNRYYYQLIIKYKHEPNLPHVLDEILNGSQKEQRQGLFVAIDNEPLNFI

SEQ ID NO: 6360 - protein, 283 aa, Enterococcus faecium
  misc_feature (B) LOCATION 1...283
  hypothetical: YES
FFKGKEIVLIKVDGALLKEYRKKKGLTQVQLAEGICEQATVSNIENKNMSPGINILSALCKKLNVEISDILVETEEDKIRKKINEIQSLNSVSKYQESYKILQTIDQEKVSNSDLLNQILFYQGLLDHLYAKKPDAALFYFNQVLEQTTETDIHHLQAAANVAMIYLSKGELDFAKVYVERTLKILSETDFDNLMVCIVYYDIATYYRKIEDYDKAIQLCEKGIEYNKKHKSTYALEYLLYEIASCHKQLGEDDYLERYMDAKKIARFNGNDYAVKVIENDLK

SEQ ID NO: 6361 - protein, 66 aa, Enterococcus faecium
  misc_feature (B) LOCATION 1...66
  hypothetical: YES
KNKGSSYRCSLYFLYSFYPVYPNNQTDDSSGVSLMDGSSTAPHEHRCVVSLHASIRKTKHVRDIFH

SEQ ID NO: 6362 - protein, 576 aa, Enterococcus faecium
  misc_feature (B) LOCATION 1...576
  hypothetical: YES
GNKGVYRMRQSKMLIPTLREVPNDAEVLSHQILLRAGYIRQVSAGIYSYLPLANRVLEKLKRIMREEFEKIGAVEMLMPAILPAELWEESGRYETYGPNLYRFKDRNDRKMILGPTHEETFTDLMRNEINSYKKLPLNLYQIQPKYRDEKRPRFGLLRGREFIMKDAYSFHATEESLDETYKDYEKAYTEVFKRCGLEFRSIIGDGGAMGGKDSKEFMAISEIGEDTICYSTESDYAANLEMATSYYVSKKSHETQLELEKVATPNVKSIDEVADFFSVEPQKIIKSVLFIADEQPVLVLVRGDHEVNDVKLKNFLSADFLEEATEEEAQKYLGAEFGSVGPVGVSDDVKVYADRYVQDLANAITGANETGFHYKNVNPERDFTVLSYEDLRFVQEGDPSPDNNGVLAFTRGIEIGHIFKIGTRYSESMGATVLDENGREKFVIMGCYGIGVSRLLSAIVEQHSDEQGINWPKGIAPFDLHIVQMNLKDEYQTNLTNELEEAMTKAGYEVLVDDRNERAGVKFADSDLIGCPIRITVGKKAVDGIVEVKIKKTGEMVEVRKEELVNTLPILLNQGE

SEQ ID NO: 6363 - protein, 108 aa, Enterococcus faecium
  misc_feature (B) LOCATION 1...108
  hypothetical: YES
TLKGANNFMFESITMNFLTQPKVVAAVDIFRALQTAATSLKNNLMIFAAAAAVASIVIGGLFFLFGRRGAENGKMHVGYVLMGVGVILAAASIVVSLFGLFGQTPQGL

SEQ ID NO: 6364 - protein, 167 aa, Enterococcus faecium
  misc_feature (B) LOCATION 1...167
  hypothetical: YES
SLKGDGEMTKILFVCLGNICRSPMAEGLLRKRIALEGREAEFFVDSAATSTYEVGKTPHPGTKKILNQEKVDMTNMVARQITPHDFETFDWIIGMDQENVEELKRRAPRSAQGKIHLFLSSIPGKEKENVPDPYYTNNFDETYHLITEGLNHWWNIWIDENKITNNL

SEQ ID NO: 6365 - protein, 296 aa, Enterococcus faecium
  misc_feature (B) LOCATION 1...296
  hypothetical: YES
NQKGEQISMKGIILAGGSGTRLYPLTKATSKQLMPIYDKPMIYYPMSTLMLAGIKEILIISTPQDTPRFKELFGNGNDLGLQIEYAVQESPDGLAQAFIIGEEFIGDDSVCLVLGDNIYYGGGLSKMLQRAASKDTGATVFGYHVNDPERFGVVEFDENMQALSIEEKPAQPKSNYAVTGLYFYDNEVISIAKGIKPSERGELEITDVNKAYLDKGKLSVELMGRGFAWLDTGTHESLLEASTFIETIEKRQNLKVACLEEIAYRMGYIDKEQLLALAQPLKKNQYGQYLLNLAAE

SEQ ID NO: 6366 - protein, 169 aa, Enterococcus faecium
  misc_feature (B) LOCATION 1...169
  hypothetical: YES
CKKGRGCMEKIKVTENELDELMAVIQEVWPEAFVPIIGQKQVDYMLKTYQSKKQIQKELTEGVSYFLLKSEEKTVGYTAYEEINGKIYLSKLYLLNKVRGQGLTSSVFRWYEELAAQTKEREIFLRVNQGNHQAIEVYKHEGFEITEELISDIGQGFQMVDYKMKKALA

SEQ ID NO: 6367 - protein, 131 aa, Enterococcus faecium
  misc_feature (B) LOCATION 1...131
  hypothetical: YES
KKKGRKKETTMIKLKRVYLDAEEEDGFRILVDRLWPRGLSKEKAHLDLWLKEIAPSNEARKAFDHVPERFASFAKKYQQELSFEEEKTRAVSELTQLMKEHPVITFVYGAKNEHQNHAVVLKEFIEKEVYK

SEQ ID NO: 6368 - protein, 193 aa, Enterococcus faecium
  misc_feature (B) LOCATION 1...193
  hypothetical: YES
SEKGVMTSFVNPFFSWFQIGFSYKIFLSLLNRKQKNNIMKEKEGVEMDKRQLLIEEYLDLANEIIHRNKPEMEKEFAGFTLNELEVIEHIGKIPDPNVTKLANASYMTRGAISKLTKKLIARGIINTYQSEENKKEIYFQLTPIGQKIRNRHEQLHQKWVQRDATVFENMSKEEFDTVFRFIGRYREFIRSSK

SEQ ID NO: 6369 - protein, 312 aa, Enterococcus faecium
  misc_feature (B) LOCATION 1...312
  hypothetical: YES
KLKGAKQMSKKLTVQDMILTLQKFWSSNGCMLMQAYDTEKGAGTMSPYTFLRAIGPEPWNAAYVEPSRRPADGRYGENPNRLYQHHQFQVVMKPSPENIQELYLESLRLLGIDPLEHDIRFVEDNWENPSMGCAGVGWEVWLDGMEITQFTYFQQVGGLPCKPVTSEITYGLERLASYIQEVESVYDLEWADGVKYGEIFKQPEYEHSKYSFEVSDQDLLLSNFDRFEKEAKRCIDENLVHPAYDYILKCSHTFNLLDARGAVSVTERAGYLSRIRNMARAVAKIFVAEREKLGFPLLNKNTANPENMKEAE

SEQ ID NO: 6370 - protein, 93 aa, Enterococcus faecium
  misc_feature (B) LOCATION 1...93
  hypothetical: YES
GVKGMEAVAYSNFRQNLRSYMKQVNEDAETLIVTSKDVEDTVVVLSKRDYDSMQETLRTLSNNYVMEKIRRGDEQFSKGAFKTHDLIEVESDD

SEQ ID NO: 6371 - protein, 414 aa, Enterococcus faecium
  misc_feature (B) LOCATION 1...414
  hypothetical: YES
NTKGLVLMASIKKYYLKKSKEYRYEVYISNGIDPGTKLQKKIHKKGFKSHEEAERFAKIVEGEIASEEYTQKNPKNLTIEKFMDDWINNYKMNVKEGTRIVHRANIKMYINPYIGKYKLDKYTRADHQRFINQLLTKKGLGRTKEGLSVTTAKSINATLSNAFKKAIQLGYIKNNPTSFVEFPRNPSDKKKVKYYTFDQSELFLEFAKKEKSFIWYPFFLIIFDQGLRKSEALGLQWADIDFSQNTLNINRERLGAAEKGPNKGLIITDDTKTPSGTRSLPMTKRVKKALLTLRNQVIKEFGFLPETDDHEAFIFINTYGKNKGIPIRDRTVNGASHRIEKRASLPHITVHDGRHTFAARTRQAGIPLEDIKDFLGHKDVSTTQVYAHISPEVKKRSMNQLENYIEEQIKKHSN

SEQ ID NO: 6372 - protein, 318 aa, Enterococcus faecium
  misc_feature (B) LOCATION 1...318
  hypothetical: YES
EKKGKSSVNKEEIVESLATITILFDEPLMNYTFTKTGGPADVLAFPKKQEEVKQIIDYCRIHDIPWMVLGNASNLIVQDGGIRGVVIMLTEMKQIHVKGTMVIAEAGASLIDTTYAALAESLTGFEFACGIPGSVGGAVYMNAGAYGGEIKDVFAEVDLLLEDGTLKTLTKDEMVFSYRHSKVQELRAIVLEARFSLQTGDYEAIKARMDELTELRQSKQPLEYPSCGSVFKRPVGHYTGQLIQQAGLQGLKWGGAQVSEKHAGFIVNIDHATATDYIELIAHIQEVIKEKFDVSLETEVRIIGEKQAISETSRSLAN

SEQ ID NO: 6373 - protein, 346 aa, Enterococcus faecium
  misc_feature (B) LOCATION 1...346
  hypothetical: YES
QEKGVFIMAITVKDVAKKAGVATSTVSRVINDHPSISETTKKKVRKIMDELGYVPNMTARNLGKRISSAIGVILPPLDSKERIGNPFYLEIMEAINEEARNYDMTTAIATAKNFELLLENVQRMHLQKQVDGFILVYSDSQDTVIDYLYQNHIPFTLIGQPYHHENEIVYVDNDNQLLGKQATEFLIQNGHKNILFVTNTTHESLYFERYFGYQKAMMMAGLPALSSVVLEHPEDYLSFEKTLKENEATALVVIDDIFALRTMQLAQMYGYVIPETLSVISFNNSIFSTLTHPYLTSIDIDISELGRVAMQKLRELIHEELSSGVRLVIPHRLIKRETVVPLENPY

SEQ ID NO: 6374 - protein, 152 aa, Enterococcus faecium
  misc_feature (B) LOCATION 1...152
  hypothetical: YES
RNEGEKMIQLPAEKILLDQSYQNWKEALTEIGQWMTQQGGIKPAYIQSMIERQEKASVYIGNFVALPHGTDKDEEVVEEGIYLVQVPDGVDFGTKEEPKIATLLFVVALKKEHQLAVLQDLAFFCSDIDQVMALSDAETIEEVQMIFEHGHI

SEQ ID NO: 6375 - protein, 65 aa, Enterococcus faecium
  misc_feature (B) LOCATION 1...65
  hypothetical: YES
FSEGLLVDAAAEEIGEDKALFLRLDGSDEFIDGGGVIFVDDVGVDDLEVIAFVRQNVQGALEAFG

SEQ ID NO: 6376 - protein, 285 aa, Enterococcus faecium
  misc_feature (B) LOCATION 1...285
  hypothetical: YES
DEEGVIMEPIIELEKINYKYQPDDLRPALKDVSFTIDKGEWIAIIGHNGSGKSTLAKTINGLLLPESGIVKVGNQILDEENIWTIRQMVGMVFQNPDNQFVGSTVEDDVAFGLENQGIPREEMLVRVKDALEKVRMAEFASREPARLSGGQKQRVAIAGVVALRPDIIILDEATSMLDPEGREEVISTIKKIKEESQLTVISITHDIDEAANANRILVMRQGELVREGTPKEIFSAGPELIDLGLDLPFPEKLKSALKERGVDVPSEYMTEERMVDWLWTSVLNK

SEQ ID NO: 6377 - protein, 93 aa, Enterococcus faecium
  misc_feature (B) LOCATION 1...93
  hypothetical: YES
KLEGTARSTLRTVFLTSGQDSRGWWIRMVDKFIGLASRKQPGVINVEVLTRGWSDLFSDNHKFINSNWDVWLVYVIPELELSRFGLEFENRCL

SEQ ID NO: 6378 - protein, 208 aa, Enterococcus faecium
  misc_feature (B) LOCATION 1...208
  hypothetical: YES
LIRGVFVKKFNPNKNIIITLVIVIIVVTILSVTAAQRANEGKPNFFQSIVNDSVAMVDKTISAPVRWVRNGVASVHNLFSTYAENERLKEKIDSYDDVSQQNKNYEREIEALKKELELNQTLTSYEKVTANVITRSPDSWQDMLIVDKGSKDGIEANMAVMSQKGLIGRVIEVNTASSKIELLSSSNESSNHFPVRVSSANGEALWFA

SEQ ID NO: 6379 - protein, 146 aa, Enterococcus faecium
  misc_feature (B) LOCATION 1...146
  hypothetical: YES
KIRGGQRMIPKFRAWDKRKNVMRDVAVLHFTKNGKTNFIEYWINPTELKSYHVRNIDLMQSTGMKDKNGVDIFEGDIVLVSVRNGFDYLDNKVCIVKNSIDYSGLVCATVDEDLEYQIFNTELFEEYTYEVTGNIYENSELLEEQR

SEQ ID NO: 6380 - protein, 491 aa, Enterococcus faecium
  misc_feature (B) LOCATION 1...491
  hypothetical: YES
HFRGVKSLAGHVLKYGKHRERRSFARISEVLELPNLIEIQTDSYQWFLDEGLREMSEDILPIDDFNGNLSLEFVDYELKEPKYTVAEARAHDANYSAPLHVTLRLTNRETGEIKAQEVFFGDFPLMTEQGTFIINGAERVIVSQLVRSPGVYFHGKVDKNGKEGFGSTVIPNRGAWLEMETDAKDISYVRIDRTRKIPLTVLVRALGFGSDDTIFEIFGDSETLRNTVEKDLHKNASDSRTEEGLKDVYERLRPGEPKTADSSRNLLNARFFDPKRYDLANVGRYKVNKKLDLKTRLLNLTLAETLVDPETGEIIVEKGTVLTHQVMETLAPFIDNGLNSVTYYPSEDGVVTDPMTVQVIKVFSPRDPEREVNVIGNGYPEAAVKTVRPADIIASMSYFLNLMEGIGNVDDIDHLGNRRIRSVGELLQNQFRIGLARMERVVRERMSIQDTETLTPQQLINIRPVVASIKEFFGFSPVVHSSWIKQTLLAN

SEQ ID NO: 6381 - protein, 388 aa, Enterococcus faecium
  misc_feature (B) LOCATION 1...388
  hypothetical: YES
ETRGGEIMFWHFYKYRTKILLRNKSMLFWTLAFPILLGLMFMAAFGEIDQGGNLETINTGIVIKADQTALSENFTTVLEQVEVNDKPLFEVQELSEVEANEKLNADDLAGFYLIDGSSVSLHVGQAGMSQTLMKNVMDQFLQRIGIISSKVAEVENVDLAPIMTVFEQEVSFQEVHAGRNMSFKSFYFFTLIGMAILYGTMWGVRNVQDQQANQSSNGIRLSLIPRKQSLVSIANLAASFTIVLTEIYIMLAVFRFIYQVDFGERWQWLMIVTALGSLCAILLGTLVGNLIPKMNLVQKDSILISVTIAMSFFAGMMGSEQVKYWIDLHIPIVGQLNLVNLISESLYKLYFYTDLASFYTNLLWLIGFIFLFALGNAWMERGVRYDAL

SEQ ID NO: 6382 - protein, 550 aa, Enterococcus faecium
  misc_feature (B) LOCATION 1...550
  hypothetical: YES
DCRGDTVEQNIQLLGQQRFDEEANLVYKVPVSQLPKIDMLDQQTGEVSEFINFKHEDMWKMIVGFIKHHRERQVPRLKELKRYLNADNNIKRRPNKPDGRADNRIASDFANFIVSFKQGVLLGNPISYNGDKVIVERINRFASESNEDYHNQLMSRDAFGLGRAYEWVGRDEYGKETIAKFDAEQTFVIYDNTKDRNSICGVHYFVEKFLDKSFTRIELYTNCGYNYYFTAKDDDLENAVLDEDGEVQSYFDTVQINEWINNEERTSDFEHVMDSIDAYDLSRSEMANFQQDSSEAYLVIKGNPDTADDQEGDNSKLAVFQAMMQARMLVLGDKKIYDNNVAGAEPDAYYLKKEYDVAGMEANDSRTVADILRFTSLIDFTDENIGSNQSGIGFRFKGWGSDNDRKNKERMVKKAIMRRLRLLTHSWSIKDGLDKPRGLIDTVKAFFVSDEKQQEQLYNKVNEIQIQFTPNVPQSDEEIMSVIAGMVGIVSDQTLCEMAERLTGVPFEEELKRLKKQAVSGVFDSDKETDTEVEEDESQRTDDEPVSEEG

SEQ ID NO: 6383 - protein, 193 aa, Enterococcus faecium
  misc_feature (B) LOCATION 1...193
  hypothetical: YES
ECRGDVRIMRNLSNRNKILIIIVVIAVFHLGTNAVLSRIILGPKPPRPEITRGEFDFRLEYEVDGERIVIEDTIVALFDGFSADAGSMAWYRTWRLHLASDRRSRNILLDELEDGRRIYYVPESANYSMGDVQKKREPNPNWYPFNGVTIEYPRNKTPEIGAKFISGLEDLYDRFGIRLISWEHDPPIENRFE

SEQ ID NO: 6384 - protein, 102 aa, Enterococcus faecium
  misc_feature (B) LOCATION 1...102
  hypothetical: YES
SVRGGTTIYTIALLLHLLQRAAYFYSIILMVYALLSWFPGGYQSGLGRLLAKICEPYISLFDRLPLRIGPLDFTILGAILILNLAVQGLAQIVIWITVHLVY

SEQ ID NO: 6385 - protein, 492 aa, Enterococcus faecium
  misc_feature (B) LOCATION 1...492
  hypothetical: YES
SKRGGEMNPTFVAIDIGASSGRLMKSTRDAKGSLILEEVHRFKNGFRNKDGHDRWKIDYLIKEILIGFEKLKQTGIDRLFAGIDTWAVDYCLIDEQGDRINDPIAYRDKRTNGAVEQFSEIYSLDKLYEQTGIQIQPFNTLFQLFAEEKENLAKAHKLLLIPDYLGYVFTGNMVTEKTNASTMQLLNAGTKEWEIELLEKIGVSKELFPPLTEPGTILGDLQKEQFSKYDLPDVTFITVASHDTASAVLGTPGQGERWGYISSGTWSLLGIETKIANVSRNAFSENYTNEWGAHNTVRFLKNIMGMWLIQEVARMQEYEYSYAELAELAAKEKPLQQVMEINDPRFLNPPNMIEEIQQYCFETEQPVPVSSGAIARCVYDNLALCYAQELIKVEHLTGTKLEKLHIVGGGSNNRLLNQLTADYAGIIVEAGPSEATAIGNVAMQMLSTGQFSNIEQARNVIKQSFPCETFYPDENKQNTMEWYVNKIKGVIV

SEQ ID NO: 6386 - protein, 214 aa, Enterococcus faecium
  misc_feature (B) LOCATION 1...214
  hypothetical: YES
FKRGDLMDKAEFTNFYWKYYLHLENEFINTTDFVMLDENNFKTFSIEYQKLLLAIGSECEIIFKELCGFDSSSNKSITDFKAVIKSSELMCLDNGVRVMNSLTLTSLKPFGDGWPEDTPDWWKIYNRVKHGRSSNYKEANLENVLYALASLYLLEEYLHKKVILEGEVDFISPESNLFTLSWERKHSSMQKVTFEKVDSNYVAPLIDFKEQEEI

SEQ ID NO: 6387 - protein, 173 aa, Enterococcus faecium
  misc_feature (B) LOCATION 1...173
  hypothetical: YES
EKRGKKMQKTKSKQRLSVIVVNGIIMALYLALTILVAPVSSGPIQFRISKSLNHLVVFNRKLLWGFLGGVIVYNAFFGFGIMDVVFGGGQTLLSLGLTALLQNKVKNVKMRLVLNTIFFTISMGLIAYMLVPTGGQAFWTTYGTLALSEFIVMAVSSPLMYYLDRALDFEKRV

SEQ ID NO: 6388 - protein, 146 aa, Enterococcus faecium
  misc_feature (B) LOCATION 1...146
  hypothetical: YES
VKRGDEKVDREIILASHGKFASGILDSLELIYGKNHSITVFDCYTDENFDLAETVRQLFMRYKDKEIIVLTDLFGGSVNNEFLQYINRDHVYLVAGLNLPLLIELVSRLDAEVETTVLIQQVLTDSKKMIQFCNERLNQKIEEDEF

SEQ ID NO: 6389 - protein, 679 aa, Enterococcus faecium
  misc_feature (B) LOCATION 1...679
  hypothetical: YES
QKRGILMTENLNQTIIQLVQKELSDYRPKQLTTVLNLLNEGNTVPFIARYRKEMTGSLDEVQIREIEERYAYLENLEKRKTEVIRLIDEQGKLTPELEAEITQAVKMQQVEDLYRPYKQKRRTKATIAKEKGLEPLAKWLMQLTDGEVQSEAEKYIDKEKEVSSAEEALHGAHEIIAEQVSDNAKFRTWIRSYTYNKGMYVSNVKDEQADEKGVYEMYYDFAEPVHKMVSHRILATNRGEKEDILKVFFQVDEAAILAYLDRQIVKNPASPSSSFVREAYQDSYKRFIQPAIERELRNELTEKADEQAIAIFGENLRNLLLQPPLKGKVVLGFDPAYRTGCKLAVVDATGKVLAIEVIYPHKPAAQAKREAAGPAFIQLINKYQVDMVAIGNGTASRESELFVAEQLKSADHKTYYAIVNEAGASVYSASEIARKEFPHLQVEERSAVSIARRLQDPLAELVKIDPKAVGVGQYQHDVSQKRLAEQLDFVVETAVNQVGVDVNTASPQLLQHISGLNKTTAQNIVIYREENGEFTARTQLKKVPRLGPKAYEQAIGFLRVPGGKNILDNTGIHPESYSIAKEILTSVQLSEKELGTEEAVEKLTRLSVEKLAESLSVGEETLADILAGLTQPGRDMRDEMPAPLLRTDVLSMEDLKPGMELTGTVRNVVLLQSFKSTIK

SEQ ID NO: 6390 - protein, 291 aa, Enterococcus faecium
  misc_feature (B) LOCATION 1...291
  hypothetical: YES
KKRGRNVVAKKYVIGNFKGGVGKSTCAQMLGFESAVNEGKRTLIIDLDMQGNTSDVMNLTHMNFTNEEGGGEGEPIVYENTVTDVLINNLPPKEAVYKVINNLYILPADMSFEMYDDWIKDQYNDSLSQFKYMKEKLEPLFDEFDVIYLDVPPSISVYSKSAMYIADWAIVVLQTQVKSMRNAMQYLEYMDFFVKEFDTNLYVAGVIPFMLESGDAVDQEMYKQAQEIYGEHLIKNVVLKNARLKRYDGSGITMEKTKKGLLKQWDRKSHELFISILKELEEHENWYAEVE

SEQ ID NO: 6391 - protein, 309 aa, Enterococcus faecium
  misc_feature (B) LOCATION 1...309
  hypothetical: YES
EKRGKRMKIKIERNQKEKSPKKKKERVVSVGKHRKMVLALWLLLSCSLAFGVYKNFTAIDQHTTHEKVVIKEKVVNTSGVESFTEDFAKEYFSWKNNKEAIEKRMSNLEQYLTENGLALIQDMVRADIPTSSEVQSVKILDVEKHSEEFVVSFLVEQHITEGKKTQSISSAYRVTIFEDENRNHLVTSLPTMIGKPDKAKYEAKQVENDSEIDAKTTEEITDFLETFFKLYPSASEKELEYYVENGAMRPINIDLKFSELENPVYLQNGKNFLVSTKIKYLDNVSKTTSYFQYKLVLQKNGNWKIVDVK

SEQ ID NO: 6392 - protein, 101 aa, Enterococcus faecium
  misc_feature (B) LOCATION 1...101
  hypothetical: YES
DERGSWKFITNLSKSHKRGEKTMTHFKKFLLTLLIGGIALLSEFVFHQPALAFAIVAFTGGILAFLMFLEMIKTLRSGRYGVDVLAITAILATLAVKRIMG

SEQ ID NO: 6393 - protein, 281 aa, Enterococcus faecium
  misc_feature (B) LOCATION 1...281
  hypothetical: YES
PRRGGFLSMKLADGISKDEKKLVRKMFWRSMTMYASVNPVTMGGGGFAYSMMPFINHFYKSEEDRAAALERHTQYFSTTIPCASFVMGIAASMEKENSEKAGFDVESINAIKTSLMGPLAGIGDSLFWGVWRVVTAGLAINLANAGNILAPIIFLVMFNIPNYLMRYYGGVLGYSLGSKYIEKLYANGLIEILTKAASILGLIMVGAMTISMVKFNTVLSFSMKGEELMNVQEILDSIFKGIVPLLVTLSCFKLLDKKVGVIKIIFGMVVLGILLSLLGIA

SEQ ID NO: 6394 - protein, 316 aa, Enterococcus faecium
  misc_feature (B) LOCATION 1...316
  hypothetical: YES
NRRGNYMNENPLAVKLPGLELKNPIMPASGCFGFGKEYGKYYDLNQLGSIMVKATTPNARFGNPTPRVAETPSGMLNAIGLQNPGLDVVMHKLLPELEEYNELPIIANVAGACEEDYVEVCSKIGEAPNVKAIELNISCPNVKHGGIAFGTDSDVAFQLTQAVKKVSSVPVYVKLSPNVTDIVPIAQAIEAGGADGFTMINTLLGMRIDLKTRKPILANQTGGLSGPAIKPVAIRLIHQVASISSLPIIGMGGVQTVDDVLEMFMAGASAVAIGTANFTDPYICPKLIKELPVRMSELGIESLERLIKEVREERER

SEQ ID NO: 6395 - protein, 78 aa, Enterococcus faecium
  misc_feature (B) LOCATION 1...78
  hypothetical: YES
FIGGRIIMHMESIRYFDGEKHIEYSNTQEDVDFISFEEDKITKVNFKDGTCLKIVSPYIEYKSKWEQDDSDERDRFGW

SEQ ID NO: 6396 - protein, 102 aa, Enterococcus faecium
  misc_feature (B) LOCATION 1...102
  hypothetical: YES
VCGGEKMLDMKIEDYRITSDSRNIVLSKVRRDEEGNIRYTEAKEESRADIGYFQTVSSCLKAIQRDYVLSEERTIKSIIEYKKALENITRQFEQACEIEEEK

SEQ ID NO: 6397 - protein, 124 aa, Enterococcus faecium
  misc_feature (B) LOCATION 1...124
  hypothetical: YES
VCGGEIMDLITQYSDIILKKIMMKIQKDKKSKERAELVKLEMAETGAGVRSSRHWKAAANIEFYYNEIQKGFDQMRELDRQTNWSKKLHQDRFKFVEKYKEILEEYLRRTANDKKTRSIQHGFI

SEQ ID NO: 6398 - protein, 399 aa, Enterococcus faecium
  misc_feature (B) LOCATION 1...399
  hypothetical: YES
SAGGRTVSRERFQAREKKVQKMGRDGLVEQNRATGEEKRVSQRTADTAFDRARPTEREDIRRPAARGADTGKKRKQPRTAPEMAAEQTEPLLTPEYLADSTAEPPPDAPASMRGAVDMPLLDAPIAEEPTPAPVRKQPQKRGKKGKKKQSTKFTEDAARPGSEEKTAMRGVEGAPAPKRRTSEGGSRLQFDKEEEPADPAADRAAIRKRQTAKLAEHAAKPEDKLKSDGNPKAGETRLKFEDTPKDTDISGDTAPDMPTRQQKKYNKAACRTERADRRVEQAQMKLPAKRRLHMDHQPDEASGKIKRRLRFEDEILPEYQKPSLSSRAGNAAKTAAVLKLHGKLREYERDNVALESAHKIEMVAEQGAGRVLRRGTEPPPLQTLPHFAESPAESGAGAH

SEQ ID NO: 6399 - protein, 152 aa, Enterococcus faecium
  misc_feature (B) LOCATION 1...152
  hypothetical: YES
NSGGGKMEDLYLVNQVCFPLYAASKEIIRHYTSLLKPLNLTYTQYLVMLVLWEKKKTSVKELGNDLCLDSGTLTPLLKKLAEKNYINRQRETGDERIVNVTLTPQGAALQKQAEGIPQKIKSYLPLEQEELDTLQHLTRKMLDNFHQDQKKG

SEQ ID NO: 6400 - protein, 217 aa, Enterococcus faecium
  misc_feature (B) LOCATION 1...217
  hypothetical: YES
SLGGKTVSRKDRHQSTENNETQEPWEQPIYDTDDEVSSRSSQRQQKKGNTLFLSLFLILLVLCIAIPAGAYFWIRNGSSNNATAATSSETSTSVVESSTSTTKEESTETSTVESSTIAEESTVSQDTGVTSESSIAAETTPTSSSEATYQAGDSSSNAAETTPSSSAAAGSTTTVQAGEGPKQVAERAGITTDQLFELNGLDPNNFMLYPGQELRIK

SEQ ID NO: 6401 - protein, 217 aa, Enterococcus faecium
  misc_feature (B) LOCATION 1...217
  hypothetical: YES
LIGGRNMIELKKVNKAFGEKKIIKDLNLIIPDGKTLAIVGPSGGGKTTLLRILAGLESSDSGEFYLDGVPFNPFELKMKEQVVGVVFQDFQLFPHLNIFENITLAPKMVLKQTKEEYTKKAEELAASLGISDLLNIYPYQLSGGQKQRVAIARALAMNPRVLAYDEPTSALDPELRQQVERLILSLKEDGVTQIIVTHDLVFAENVGDQLLKVSPIH

SEQ ID NO: 6402 - protein, 79 aa, Enterococcus faecium
  misc_feature (B) LOCATION 1...79
  hypothetical: YES
NVGGIDLEAIQENRKDNQETSEKNKKKRKKKVDKFTEMTDKIIEKKGLKPKDFDRQAIKEARQKLYDDFVKENISQLLD

SEQ ID NO: 6403 - protein, 682 aa, Enterococcus faecium
  misc_feature (B) LOCATION 1...682
  hypothetical: YES
RSGGKDILKKRRIVLILSSLLVTNIFPIIGYSLELNQLEHGNRRDEESKLTSTFDSLIESNQTQESSEDLSISSSGETTDNVEAEGSDKQGLEDAPISAVELPDDPNIISIDKIFQTPIGTSTSILENGKLLQLNPAERSQRGAIWSNKKISLLSDFTFKSYLYLGNQRDRAGDGMTFTLTGDPRMASNPSQVIGSPGMGIGSYSTRSGQPYIANALSIEFDTYKNSGSSDRMDREITADNRGHGHVAFVTPKPNNNNYSGEHTGVTVAPTFLSNGTWRLLIIKWDAEQRSLTYDLEGVGRSSRIIPDLIRQFGSTEVNWGFTSSTGTFFQENAVAVTRLPSNVTSTADVKVNDSDYGAIAEAGGNDKITIRNTLKVEGDFLEYKKMQTSIDLPQELTIPEHILINGNQIDAKDILITGNRVTLNLTDYFIAGDTLIIELETTLQEVIPEKVLTMHFEYLENGNLIEQSNEINLKIAKLKEIDIHVYYKDKDSQIDIAEMKTITGKIGEKYKETPIDIEGYVFDSDSANTEGIFSENTEDIYFYYRKGKLYLSTAPQYVNFGKHKISSRPLSEFGQFSGGLKIIDERAFGSWKLQLKQEKVLTNGDFELPEALSFVTSENTTVIGTSAVTIFESDQKGESDLSSLLDSTAHRGIRINIPVENQRIGTFEGKLSWILADVPGN

SEQ ID NO: 6404 - protein, 393 aa, Enterococcus faecium
  misc_feature (B) LOCATION 1...393
  hypothetical: YES
LTGGIMEGKNKKNRPVSWFWRWFLNNQVVTALLVVLLILLIVFLFTKVSYLFAPIWQFLAIVGLPIILAGILYYLMNPVVDYFEKRKVPRLYSIIGLFVLVVALIAWGSVVIIPKIQEQTVSFISNFPQYVDTIDNKLTEILRDPLFNQFREQLETAGDKFMNSAGDMIQDISKSTVQSLGSFVGAVATILVALLTMPFILFYLLKDGKQLAPYFVKFLPTRMQKPTLNVLSEMNSQVSSYIRGQLTVAFAVAIMFMIGFAVIGLEYAVTLGIIAGFLNLIPYLGSFLAMIPAIFLAIVAGPFMIIKVLIVFAVEQTIEGRLISPLVLGNQLAIHPVTILLVLLTSGKLFGIIGVILGIPVYAAAKVVITHVFEWYTTISSLYEENPLKKQKE

SEQ ID NO: 6405 - protein, 587 aa, Enterococcus faecium
  misc_feature (B) LOCATION 1...587
  hypothetical: YES
RKGGMMMAQTNPRSRLAEIIRVFINYNVVPNFVQQKNPEQVKKAFEELGPTFIKIGQMLSVREDLLSSAFTQTFKTLQDSVPSDTFSTVKKTIETELSLSLSDIFDDFSKSPFASASMGQAHRAKLKNGDAVVVKIQHPNIAEEIRLDLQLFERAIPLIKYIPETSVVDLKGVLQEVKRSLINEMDFLKESQNGEQFYQKNNGWKEIRSPKIYDAFCSKKVIVMEEMSGKNLNHLMNAENKTETFITGIQNKQLKQEVAKLLVENFMKQVFDDGFFHADPHPGNLLFHVLTKEEQTQASRKTETVHEKEFGSFAFRASTSAEDPVAPYTINYIDFGMMGHLSAGLRQKLTQAVLALYTKDAYRIEKAVLRLCQQEGSFDESRFHQELTSFLEQYYDSPIDEINLQEVFTHVVTICHQNNLQFDRDITLLLKAFGTLEGVIRVLDPEVSLMEVASPFAQHYFLTHLDVEDTLKQSGLDLLEGMKAAPKIPQQLHHLLEMWTSGQGKVNLELKKQDKLLSRIESMINRLVFGMILAALIVGSSLLVQAAPVENAEVVSLLGIFTYAIAAFVIIFLAIDALIQMYKKRKK

SEQ ID NO: 6406 - protein, 109 aa, Enterococcus faecium
  misc_feature (B) LOCATION 1...109
  hypothetical: YES
DRGGEVMDELITKVEQWAKDKRLDQADPKAQFLKVAEEFGEIASAMARSNDELFKDSVGDVIVTLIILSMQKGTNVQECLEMAYNEIKGRTGKMVDGVFVKSSDLENSE

SEQ ID NO: 6407 - protein, 159 aa, Enterococcus faecium
  misc_feature (B) LOCATION 1...159
  hypothetical: YES
KKGGSFMIKEFKEFIMRGDVLDLAVGVVIGSAFTSIVNQVVQGLITPLIGWFVAMITGTSDLEGALSILDWSPTKGVTFAFGNVISAIITFLITGFVLFLVVKAANRAKNLRSKEEQVEVEETPTAEDYLSDIRDLLAKQVAEDNTHPVEQTNLSDTSK

SEQ ID NO: 6408 - protein, 81 aa, Enterococcus faecium
  misc_feature (B) LOCATION 1...81
  hypothetical: YES
RCIFLKQEAMWKWILICRLPIRTNFLLKYTPMMTVREKRSFYQVRLDNIKVIDKRGCPLFYRPGQVVDSLTQFLASFYGVS

SEQ ID NO: 6409 - protein, 94 aa, Enterococcus faecium
  misc_feature (B) LOCATION 1...94
  hypothetical: YES
VCLGCHLENRAFQQGFHRAGQLHLQVRPVFPDWQDLRRGVLSANPRPGTDRPDAGGFPRSGKQHGGDTAYPVHRPERGNQEHQAQDYRPRPHEN

SEQ ID NO: 6410 - protein, 319 aa, Enterococcus faecium
  misc_feature (B) LOCATION 1...319
  hypothetical: YES
LLMGKVVTLGEIMLRLSTEQGTRIDSSERFAAHYGGGEANVAISLANYGHEAIFATKVPDNALGKAVKKHLQCYGVDTKQVLSGGSRLGTYYMETGSGERAASVIYDRAGSSFAEMDHLEWSLEELFQGIDIFHVSGITPALSKKWQKMTKQVIEAAKKAGCLISFDINYRGKLWTQQEASEVIHQLLPLVDICSAGKMDALYLLGIEKAPEAEEQPLIYYYQKMQEKFPNIQVFYSTKRTVHSASENELKGTLWMNHEYVESQVHRITPIVDRVCGGDAFAGGVLHGILSNMSPQEIIDFATGSFCLEAYDPWGLQPI

SEQ ID NO: 6411 - protein, 156 aa, Enterococcus faecium
  misc_feature (B) LOCATION 1...156
  hypothetical: YES
KQMGDYYDLLLQKSDSYHEKEWCTLLTLYTSPSCTSCRKARAWLQEHQIPFVERNIFSEPLNSSELKAILQMTEDGTEEIISTRSKVFQKLNMDLDDLPLQELLELVQNNPGLLRRPIMIDDKRLQVGFNEDEIRRFLPRDVRQLELRQAQLMAGL

SEQ ID NO: 6412 - protein, 342 aa, Enterococcus faecium
  misc_feature (B) LOCATION 1...342
  hypothetical: YES
TAVGIDPVTNTLAVRPLSSVLQSSLTPGEQTDRYGVYMQTYGNRQAFGNPFGFSWLGYVSSGYGWRVHPVNGEKSLHRGIDLAVAQGTPILAAQDGRVVSAGDAGSYGLCVVIEDDKGYQSRYAHCSSLNVSAGQEVKRGDVIAAVGSTGNSTGPHLHLEVMLNGEYLNPYFFVDNGDDGTGAIPGTPGGPAIPDYSGEPMGDGSFEAMLREAEKYLGYPYVWGGSHPSTSFDCSGYVSWVINHSRRGQRRAANGTGPLQPVYAGICGERTARRPDFLYRDIQLAGAGQPRWDLCGRRAVYSLRRPDFLRQYGKPLLVCPSVRVWQNTLKHFFQAFLPETEV

SEQ ID NO: 6413 - protein, 125 aa, Enterococcus faecium
  misc_feature (B) LOCATION 1...125
  hypothetical: YES
TNVGETAIRSEDRRRRGLMDENYQSEWTKSIPLKEQKKIIKRLMKFAKPFRRTFIVAILSAFALSVINGLSPTIIQTFMDDPLAKQSATTQVILFFCRYVLIWSHTKKFHLVFPMVFVFHGPFEN

SEQ ID NO: 6414 - protein, 405 aa, Enterococcus faecium
  misc_feature (B) LOCATION 1...405
  hypothetical: YES
SGVGKMKILYINTVWGYGSTGKLCVYLQNYLEKRNVNSIVAYGRRFEIPYAKRNNIYYFSSKLDNYTHAFYSFFFDLHGHASKKSTKKLIDFIKRENPTVIHLHNLHGYYLNFPMLFEYLKTTEIPVVWTLHDMWPMTGHSAFMDEELIYTKKDYYIFDSKKNYPQSLSGRFQKNFLLKEKSFGNLKNITIVTPSKWLQNIVQNTYLNKYETAVIYNGVDLTPFKRDRNIKKYTKKTILGVANIWEERKGLKYFLELSKNLDQDTQIIIVGKIPEKVKLPPNCLNITRTDNVTELAEIYQKSHVFFNPTLNDNFPTTNIEALASGIPVVTFDTGGSGEIVLNDRIGFVVKHRNIDAIKNSLKKFLYTEQSVEDDCRKAAENFSAENMGKSYYQLYERIIKFKADE

SEQ ID NO: 6415 - protein, 156 aa, Enterococcus faecium
  misc_feature (B) LOCATION 1...156
  hypothetical: YES
GNVGTLFKKSVPIGCAYYVSLKQKWVQNIRFMDSVWIVKQLYMDSIWIDSIDYPYFFRRVKMEIKEIKVRGINKKYVQEIDHRCVELTEQTGQKWSRNDYLKLLIENDFERPLMDYKKDQFDRLLEKFTDVQLHNTKVLEAYTNEVKNLIEILIAH

SEQ ID NO: 6416 - protein, 60 aa, Enterococcus faecium
  misc_feature (B) LOCATION 1...60
  hypothetical: YES
SRVGTAIDVAKNRIKTNQRRHAGQISARREVSSDGTIECESDPHGIDSIEKTVDNCHKRA

SEQ ID NO: 6417 - protein, 336 aa, Enterococcus faecium
  misc_feature (B) LOCATION 1...336
  hypothetical: YES
FVTGGIHLLKRRIKYSALMMNLLMLSTPVLISVVEVAANEQQSVNEENAHVNIEGMSTMEEIPRTSEDMDTEEGNDPMMKESENEKTKKQSEEANEEWKGVVFGESTSASRYAIEPLEDGVRLSSTNNGGKFQSSGSDGMTYYYQAIPKDINFRMRATIEIESWTYTNAQEGFALMVRDAVPKNHLFGQAFYSNSFAILGSRIEYVWDSDRQEVVNTSGSKYTMRLGLGTRAITGISSEDPQAAPAPGSVSVETTPLETSAGFLEKETGSYNIFGNGHGNLFPATNSITKLDVEMKKTNTGLEAYYYDPETGEEMASDIMYDWEKLYASDESVIYA

SEQ ID NO: 6418 - protein, 398 aa, Enterococcus faecium
  misc_feature (B) LOCATION 1...398
  hypothetical: YES
VDQGSDKTVMIHGGFRGNWNNGIVTEEYNDFYKAGYNLLFVDSRATGNSGGDYVTYGQYESDDVLYWINQEVRERPSQKILLYGGSMGAATMMSVLAKDIPVNVKGIIENCGFASIDEQLRFTYSQTVAPALPDAIKNQLDIIGDQEHEDLFMGLLKQYYFDQEMHLDTKAALPTIGMSDSLPKLIIHGTADDVVPVSNAQKLYELSGGYKDLLLVEGAGHGKAQEVDHAAYTKHVTDFLKVVFHDQINVKYVDENNKSLLKDQDEIQLYGAYGENYMTEQKTFEGYELANVEGPTEGIFNETIPTIIFYYKKIPVAPPKKQDPTENADNKGKNEPREDQSSDDTQPIQMTVKVQKKTDAKKRMLPKTGEKKHSLLIYSGGFLSVSTIITWIWRRKRG

SEQ ID NO: 6419 - protein, 62 aa, Enterococcus faecium
  misc_feature (B) LOCATION 1...62
  hypothetical: YES
NKKGKNGFVIHVFLTKKRIRLKKRLNKESKIFKRVLQHKMLSCLMLSCSVFIIISGMPLILI

SEQ ID NO: 6420 - protein, 339 aa, Enterococcus faecium
  misc_feature (B) LOCATION 1...339
  hypothetical: YES
CEKGGIFMEIYDITIIGAGPVGMFAAFYAGMRQAKTKIIDSLPQLGGQLATLYPEKYIYDIPGYPAIKASELIDQLEKQLTTFNHTFHLKEEVLSLTREDEVIEITTNKGIHYSKAVILALGNGSFQPRKLNLDNAESFENHGLDYFVNDLMKYAGKKVAIAGGGDSAIDWTLMLEPIASEVYLIHRRPEFRAHEHSVSRLKSSSVNLLTPYLIDGLSGNNGELTDIRLKKVKSDETIDLMIDSLIVNYGFSSNLKHLSSWGLDSTRNAITVKSDMSTSIPGVYAAGDICTYEGKVKLIATGLGEAPTAVNNALHYINPKERTQPGHSTSLYDKNLRPS

SEQ ID NO: 6421 - protein, 437 aa, Enterococcus faecium
  misc_feature (B) LOCATION 1...437
  hypothetical: YES
LRKGEKTMSFQRPKGTNDILPGESEKWQFVEETARLLFRDYQYNEMRTPIFEHYEVISRSVGDTTDIVSKEMYDFYDKGERHVTLRPEGTAPIVRSFVEHKLFGPEYAKPFKTFYMGPMFRYERPQKGRLRQFHQIGVEAFGSENPATDVESMVMALDFFKQLGITQIRLVINSLGDKETRQAYRQALIDYLLPFESELSEDSKRRLHENPLRVLDSKDKRDQKFVAEAPSILDYLSEPAQKHFDTVVSMLDALAVPYEIDSNMVRGLDYYTHTIFEIMSDAPKMGAQATICAGGRYDNLVEELGGPSTPGFGFAMGIERLLLTMEAEEVVIPAFNELDAYVVALGDETNIEALKVVQAIRNFGFSADRDFMNRKAKAQFKTADKANAKLVLVIGEDELASQTINVKAMASRKEKSFPLEEIYEHFDEVYDEMTLFE

SEQ ID NO: 6422 - protein, 555 aa, Enterococcus faecium
  misc_feature (B) LOCATION 1...555
  hypothetical: YES
EKKGRNKVMAYQFKLPDIGEGIAEGEIVKWFVKPGDTINEDDTLLEVQNDKSVEEIPSPVTGTVKNVIVPEGTVANVGDVLVEIDAPGHEDNEGDSGVAAESQTPAKPAAEPTVDTESAGSSSEGVFQFKLPDIGEGIAEGEIVKWFVKPGDTINEDDTLLEVQNDKSVEEIPSPVTGTVKNVIVPEGTVANVGDVLVEIDAPGHNSAPSTSAPSAEAPKEKVETSGSASVVEAADPNKRVLAMPSVRQFAREKDVDISQVTATGKGGRVTKEDIENFLAGGPSSAPAKSEAPEAAAPKEAAPAAESKPAAPAKPFKSNLGDLEERVAMTPTRKAIAKAMVNSKHTAPHVTLHDEVEVSKLWDNRKRFKEVAAANGTKLTFLPYVVKALTATVKKYPVLNASIDDANQEIVYKHYYNIGIATDTDHGLYVPNVKDADRKGMFAIADEINEKAKLAHDGKLSAEDMRNGTITISNIGSVGGGWFTPVINYPEVAIVGVGTIAQQPIVNAEGEIVVGRVMKLSLSFDHRIVDGATAQQAMNNIKRLLADPELLMMEG

SEQ ID NO: 6423 - protein, 113 aa, Enterococcus faecium
  misc_feature (B) LOCATION 1...113
  hypothetical: YES
KRKGCMSVILISGTIGAGKSSLTDMLAKEIDSKPFYENVEDNEVLPLFYSNPEQYAFLLQIFFLNKRFLAMKNALVNDDNVLDRSIYEDSLLFHLNADLGRVTDIEVQQYDSL

SEQ ID NO: 6424 - protein, 253 aa, Enterococcus faecium
  misc_feature (B) LOCATION 1...253
  hypothetical: YES
IFEGECTMKLTVLGCLGAYPYKNQGTTGYLLQSDEFNLLIDAGSATLIKLQEHLDPLDLDAVILSHYHHDHIADLGVLQYYWQLHPKRNPETLLSIYGHTKDSIHFEELTMENVSKGHPYFEAEELKIGPFLITFMETIHPVVCYAMRIVEETTGKVFVFTGDSGYLESFADFAKDADLFLADTYLFEGNEHHHAHFTSKEAGELAKSANVKKLVLTHLPQFGDLEQLKNEAQKAAGKGIDVELAAVDKVFNI

SEQ ID NO: 6425 - protein, 390 aa, Enterococcus faecium
  misc_feature (B) LOCATION 1...390
  hypothetical: YES
KLEGGTIARLGSRLTFQNEERKKMRKKLLFSLITLGISFMVLTGCSNSANKTTTESSAATKILKDPYSDEQFLLGTYVRIRVYDEGKESTLKPAFDRVKELGDKITINQKGSEIDEVNEQAGIKPVKVSDDVYTLVKRAYEYSQDSQGGFDMAIGAITQLWRIGFDDARKPSQEEIDQALKLVDYHKIELNDKEKTVYLKEKGMIIDLGAIAKGYITDEVVKVLKKQGVTTAIVDLGGNVYVLGHSPRGENQDWTVGIQDPNMARGSVLGSIKERNKTLVTSGIYERYLEVDGKKYHHLFDPKTGYPFDNDIASVTIITDKSIDGDGLCTAVFSMGVKKGLEYVESELNNGTEAIFVTKDDKVYVTDPIKDTFKLSEDSHYTMGDRSELK

SEQ ID NO: 6426 - protein, 129 aa, Enterococcus faecium
  misc_feature (B) LOCATION 1...129
  hypothetical: YES
QLWGNKMFDFNEYLSISKQIESDDKYNSKESYRRTAVSRAYYSAFKKSDEYLKENYDIIYNGSSGKGSHQTVWNLFSTVKELNTLGIHNSGYRMLEKRKCADYIPNETITKTDMALMNREAEKIINKLT

SEQ ID NO: 6427 - protein, 248 aa, Enterococcus faecium
  misc_feature (B) LOCATION 1...248
  hypothetical: YES
TSWGTRFPGFSRKKFKRYWNNKLFQTFGMTAASTGLSERTAKENELSFEVIHVSGKDHASYYPEATDILLKLIFHPETGEIYGAQGVGAKGVDKRIDILATAIKGHLTIFDLPELELTYAPPFGSAKDPVNMLGYAAMNIAEGLSETVQWHELPTELAKGKILLDVRTAEELEKGKFKEAKHIPLNELRDRLNELDSQQEYIVSCHSGLRSYLAERILKQSGYHVKNLDGAFSLYQTVRPEELIYPNK

SEQ ID NO: 6428 - protein, 263 aa, Enterococcus faecium
  misc_feature (B) LOCATION 1...263
  hypothetical: YES
SKWGDFMLNEVENRQQEIVNYLKNNQFARVIDLIELVNYSEATIKRDLVFLEKSGLIRRVRGGTMLVDNRKIDVPYLMKITKLEEETEKRKIADTASSLIRDDMVLFLDSSTTSLHLVRNLARFDGLQIITNGIVTAAMLSEYTTAKVFVLGGAIVPKRATINGSKAYNDALSYYADLAIMSCRGLDFSQGVTETHEGEAMVKKAFRKQSDRLAVLVTQQKIAHKFMHQAIAFHEIDYLVTSKELTKEQYAKVKEHHIECLYG

SEQ ID NO: 6429 - protein, 441 aa, Enterococcus faecium
  misc_feature (B) LOCATION 1...441
  hypothetical: YES
RKWGGTEMISITHTGNLFLDTCLSIMYFFLVSYPILGGFVWFIGVWCYVFLYKHKQKEWVDVPLSVEPFITIMVPAHNEEIVIEYTIEYLMTKLNYHNYEVLVTDDGSTDQTPEILARLMKKYANLRVVRIEKNKGKAHAFNIGLAFAKGKLILSNDADTVPEPDALIRYVNYFIRPGARHIAAVTANMDVQNRTKLIAKSQTVEFSSIVGIIKRTQSAVFGGLYAYSGANTMYRKEALIDVGGFRQDRATEDISIAWDHQLNDWLSVFAPEIIFFMEVPVTLKMLYRHRKRWAKGGTEVWLTNFKKVMLHPFKHIGRTIIFIDQTLSIVWSIFFCISVVLFAGLIGHYVYQGNYEQIYITFTFSFVFICFEMVAGFFQLLASLIVDDRRRKLKYLLFAPLYMLLFWIVNAITIVTTFIPAVKTILGYGSGTWKSPERTKK

SEQ ID NO: 6430 - protein, 93 aa, Enterococcus faecium
  misc_feature (B) LOCATION 1...93
  hypothetical: YES
GEWGAIAGSITAIVSLILLVIRPIVASFTKITKTLSQVSYNLELLTKDLESSKSDRLMIHEELKKHDERLDTHAEKLVEHTQQIKTLFRETSR

SEQ ID NO: 6431 - protein, 521 aa, Enterococcus faecium
  misc_feature (B) LOCATION 1...521
  hypothetical: YES
RSRGGKLYPNCTRNRLCDALVIKPKKSEKRELKGPSLTIKWAFASSFFIFVVFTIFAVITYKSSINLIVAKERNNVERTISEVASRLANSDEELTLVNTYRNLTKATNDGDEVVDHTSLVEGNLMKIDSFIAELGQPSMDLYVYDLDENLIFKTHENSRNLIQTTRKVPTIVTLEGKTGFLSIQPIYSKGTREKIGYAQSFYELSSFYDIRNKLLLTLIVLEVVSLILSSILGFFLSSYFLKPLKVLRDTMDTIRKDPQSDIHMPEIDTNDELADLAEIFNEMLDRMRLYIEQQEQFVEDVSHELRTPVAIIEGHLSLLNRWGKDDPEILEESLSASMQEISRMKSLVQEMLDLSRAEQVDVHYANETTKGKEVTYQVYNNFKILYPDYVITLDDDLTKEVTLQIYRNHFEQLIIIILDNAVKYSTTRKEVHISISSTLNEFEIAIQDFGEGIPKEDLNKIFNRFYRVDKARARTKGGNGLGLSIAKQLVENYKGRILAESVVGQGTIFRIFIPIAKAEDK

SEQ ID NO: 6432 - protein, 107 aa, Enterococcus faecium
  misc_feature (B) LOCATION 1...107
  hypothetical: YES
MIRGRTKMNKLNILFVCGAGLGSSFAAQMSAEDVLNKLGVEAKLDHCDISSAVSMKPDVIITAENFRSQFEKFAVDPKTAMIYLKNIVSKNEIEEKITPVLQDKGVI

SEQ ID NO: 6433 - protein, 413 aa, Enterococcus faecium
  misc_feature (B) LOCATION 1...413
  hypothetical: YES
PKRGNPAGAVFELQNREGETLQTGLTTGEDGKLAIDGLAPGAYQLVETQAPIGYELDATPIEFEIERSQTAVVELTKENRLTPGGVVLTKIDDQSGEILQGAVFELQNREGETLQTGLTTGEDGKLAIDGLAPGAYQLVETQAPTGYELDATPIEFEIERSQTAVVELTKANRLTPGGVVLTKIDDQSGEVLQGAVFELQDANGTVLQSGLTTGADGKLAIDGLAPGVYQLVETQAPTGYELDATPIEFEIERSQTAVVELTKENRLTPGGVVLTKIDDQSGEVLQGAVFELQDANGTVLQSGLTTGADGKLAIDGLAPGAYQLVETQAPTGYELDATPVTFKIEKEQEVAIFLTKENRKVADSSDIRGNNPTSSGNKHLPKTGETIISQFILSILGVLLVFISIKFRKKRNI

SEQ ID NO: 6434 - protein, 159 aa, Enterococcus faecium
  misc_feature (B) LOCATION 1...159
  hypothetical: YES
EKRGKNCNGRWRENSFDFNDFIEQLDQVMGMGPLEDLIKMIPGMNQVPGIENVKVDPKDVERKKAMVYSMTPAERANPDLLNPSRRRRIAAGSGNSVVEVNRMIKQFKESRKMMQQMSKGDMNIPGMDQMFGSGVKGKLGKMAMNRMIKKNKKKKKKRK

SEQ ID NO: 6435 - protein, 136 aa, Enterococcus faecium
  misc_feature (B) LOCATION 1...136
  hypothetical: YES
NERGRLMGEKELRRSMSVFPIGTVMKLTDLSARQIRYYEEQDLVHPERSEGNRRMYSLNDIDMLLEIKDYLSDGLNMAGIKRVYEMAQAKKQEAKNKKPLTDHDVRQIFRDEILAQGGLSKTGHYQSQGLQRQFFD

SEQ ID NO: 6436 - protein, 97 aa, Enterococcus faecium
  misc_feature (B) LOCATION 1...97
  hypothetical: YES
HLGGNKMKNLVISKFAMLPRMDFFDNVSKFMSNMTSKLQGISLSVIIFCIVVTGLMFLFGEGPSRTAKKWLTYIVIGAIIIFGASTIGQTIKSVGGF

SEQ ID NO: 6437 - protein, 628 aa, Enterococcus faecium
  misc_feature (B) LOCATION 1...628
  hypothetical: YES
RIGGTHMTLVNRWYQLLKLLVTHKKVSIQEVQKEIKTSNQTIKKDIGELNEEIAGIAKIIQKNKHFELEIYDFDFFDEIMQGKLKTASDFNSASKRIAYLLNRLIETEDFLRMDDLSEEVGVSRGTVVKDLKTLKEMINDFDVKITGTPNKGLRIIGDELELRLLLFYFVSPYFSETKTEQFLEEKQAIKHFQKKTNASKQEITLLTKVIGISLNRISSNYLLKKPINRYSGCFEYIQEFNELINQLEEIYELTLSQYEKDFISFPLNIINTSITMIRKANSDLRLYFDPMMMRIRRLDLIDLDESFLYQEMKQHLSLLINRVIFRYRLTDLFYGEIEKKYPFSYQIASECIQALEAILQHKISKVEISYLTLYLELAFRYQKEHFSSKKVAIVHTTGKGTALMIQRQIKRILGRDIQITHVSEEQYEKVDLNKYFAVFTTIPLKNVNEETPVIHLTNLFDDSWLRAQWQKAKKKRLAGFHSTVFFYQIWKEKKTYQEYLNKLVAPLIRGYYVDEEFEKRILKREYQQSTFVNKEFAFPHTTNQLSQHIVLSVGLITDQGLAETGGNGVIFLFAIPEEMTAEVENELFELYDILFELIKMGIDEFIELAPTQESFLKLIKSKGERLHE

SEQ ID NO: 6438 - protein, 281 aa, Enterococcus faecium
  misc_feature (B) LOCATION 1...281
  hypothetical: YES
FVFFNPSLIMKKRRRSQLNQVVDKPLYFKVDKKIKKLASTQQLQSRKSKLLFLALVFEDQSYVIIDQSGHPVEYSPAKYTYQEGLSCKKWKLINEEPIELSRWINRKEDIPVLIEEKRSGKELANCWVGLPEERFLRYKKWATPSGYLCGTYAAAVLLAYYQDYRKGWMLPNEIRKKNTADSLVLTKALRSQIQPLGLPTIPFQVSTGISSFLKKNGNHERARATLLGSWQRATKRIREGKPVMIGILKVLGSTYGNHWVTAYAYFETETGERYYNVLDRS

SEQ ID NO: 6439 - protein, 71 aa, Enterococcus faecium
  misc_feature (B) LOCATION 1...71
  hypothetical: YES
YIILYYHIFIPIHRYSYIMSFHVVYQISISNRLIQISKPKIFYWKLLEPKIYFLFDPKLQGNTNLISTQHL

SEQ ID NO: 6440 - protein, 68 aa, Enterococcus faecium
  misc_feature (B) LOCATION 1...68
  hypothetical: YES
NIIFYFSKLWYNNISIMLKVVLTRLVYDRLIYEQARVSVRTLTKKLMKQPFGICFINLNRLHYTRQKR

SEQ ID NO: 6441 - protein, 129 aa, Enterococcus faecium
  misc_feature (B) LOCATION 1...129
  hypothetical: YES
IVFLFIFSGIPWSLASVSGSGVTSGFSSGSTSSFSGFSVSLSVSGFVSGTVWFPESVSGSGVTSGFSSGATSGFSGFSVSLSVSGFVSGTVWFPESVSGSGVTSGFSSGSTSGFSPGVISGFDSLSGSG

SEQ ID NO: 6442 - protein, 109 aa, Enterococcus faecium
  misc_feature (B) LOCATION 1...109
  hypothetical: YES
VEQSVAVLLPSMNWKSNCIRSILVYYADQEYEKATDLLKFLIARTEYTRFEYIERLANIYHIMNEPVKEYQLLDTVLSVAELIALPAGLEKKLVRRLLRVKQQLSDQEK

SEQ ID NO: 6443 - protein, 269 aa, Enterococcus faecium
  misc_feature (B) LOCATION 1...269
  hypothetical: YES
IKGRMRGPQQKLNRIPVSCEYTTPPGAICSAPTSPAEMGDHVNPLWTHEGFDLEIGGFDDYVLPNQSLEQGDIDANYFQHIPYLNKEIKEKGYDFVNAGAVHIEPMGLYSKKVKDVSELKDGATIITSNSESDWGRIITILQDAGLVKVKDGVDLETATFDDIEENPKDLKFNHTIDPSLLAFTYQNDEGDLVAINANFAYGAGLNPLEDAVLLEKDNSPYVNIIATRKGDEDSDKIKKLIEVLHRKEVQEWITDKWGGSVKPVKADAK

SEQ ID NO: 6444 - protein, 451 aa, Enterococcus faecium
  misc_feature (B) LOCATION 1...451
  hypothetical: YES
RAIFMRGFIDWQIQQLNNQQLFKGNVAIIQPLEQGLGNMMNQQDNLYTVILQGLSNGEIVDTSEIITVVEQMINPYDEWDAYLSLAENDDLAYIVSNTTEAGIQFVETDNLTDTPPQSFPGKLTAFLYRRFKLNKAGFTIIPCELIDRNGERLKEIILRYAEKWDLEPAFVEWLEKENVFCCSLVDRIVPGYPREDAGVFNQRHNYEDQLMVKAEPFMLWVIEGPKELENQLPFKQAGLNVIITDDMTPYRERKVHLLNGPHTAMVPLALLAELETVEEVMKDPLFSAYVDQLFNLELIPMLSLPKDELAIYADQIKERFLNPFAHHKLEAISLNSVSKFSTRLLPVFKKYIEEQNQVPPLITVSLAALLLMYRGDQVKPHDDEKTISEFTDAWSDNGTAIPRLLQNAALWGEDLSQIPNVTDTVQEIAAKIDQKGVRSVLQEMKGTMVHA

SEQ ID NO: 6445 - protein, 210 aa, Enterococcus faecium
  misc_feature (B) LOCATION 1...210
  hypothetical: YES
VKILKIAYIRVSSIDQNEQRQIEEMKKFGAEKIFIEKQSGATITHRPIFQEALEFVRDQDIFIVEAIDRLGRNYDEIIASVNYLKKKNVQLIITSLPIMAEAIGNPHLDKFIKDLIIQILAMIAEQERTESKRRQAQVIKIAKANGVYKGRPKLYSADTKNPQRRLVYENIVKDLNEGIAISKIAKNYNITRQTIYRIKNDIEYNSNQMN

SEQ ID NO: 6446 - protein, 318 aa, Enterococcus faecium
  misc_feature (B) LOCATION 1...318
  hypothetical: YES
EFFISSLDFMDDEGFLPEIPKWFTPQTSNVHLSALKNTGLTLFAVFFGIGVCLYNMDYLTSAVQTKPVTVSHRGVSTQNGAQNTLEALEKTSRDYHPDYIEMDVQETKDGRFVVMHDANLRHLTGVNRTPQDLTLKELTNLTVTENGFQAPVCSFDSYLEKAHELNQKLLIEIKTSKKESDDLVERFVQKYRKAILENHHILQSLTYQTVSDLKEAEPNFYVGYILPFNIVGPPVTPADFLTMEYSTINRNFINSAHQDGKKVYVWTINDSDAMSRMMFYGVDGIITDEMGLLNESVKQTDEEITYSDKLLNFVLGVG

SEQ ID NO: 6447 - protein, 85 aa, Enterococcus faecium
  misc_feature (B) LOCATION 1...85
  hypothetical: YES
YTFIKGVMIMLVTKSRLQGSSVVVTLPSDNGKKPSENQEYIVVYSDDGTITLVPKIEDPFSGGEEAEYYEKDEWEDLTPEGREIL

SEQ ID NO: 6448 - protein, 376 aa, Enterococcus faecium
  misc_feature (B) LOCATION 1...376
  hypothetical: YES
RFFFLLFLFLIFIFHHIMNNVFIFCYLEVVDLTVYQRFLANEKIRRLTVLLFVVFVLFLVRSMITTILLTFIFTYLMIHLVQIIQRFVRIPTGVLAIMIYTLIVYLIYLAFTKYIPMLIHQTFDMIQSVIDFYEHQPKDADPVLQYIHTYIERNDFFEQLQNGASIALGYLQDIGKMAVAFAMSFILSFFFMIEKKKTIVFSRLFLKSEFSWFFQDIYYFADKFVNTFGLVLEAQFVIALLNTLLTTIALAVFGFHQLLSLAIMIFILSLIPVAGVIISCIPLSFIAYSQGGIRDVVYILITILIVHLIESYVLNPKLMSSKTELPIFYTFVVLLVSERFFGVWGLIVGIPIFTFFLDVLKVKKIPNHLPKETDIP

SEQ ID NO: 6449 - protein, 212 aa, Enterococcus faecium
  misc_feature (B) LOCATION 1...212
  hypothetical: YES
MKILLAAGGNPQNWPQSLLSKYDAYVGIDRGALYLLQAGYPVDLAVGDFDSLSNEEQKEVFAKAKEYTRSPAEKDDTDTQLGILKTFERYPQAEVTLIGATGGRLDHLLANLWLGMEPRFKPFAHQLIIRDCQNYLSYYLPGEHIVRQIPDMKYLAYCCLTPVSNLTLKGSKYVLENKEVEYPTSYASNEFLSDTAEFSFSDGMIAVIQSKD

SEQ ID NO: 6450 - protein, 906 aa, Enterococcus faecium
  misc_feature (B) LOCATION 1...906
  hypothetical: YES
GDFMKTRTYLKAGFREIRQSKGRFIAIILIVMLGTLLFVGVKTAGPVMQKTMDHYVGTAGLSDLQIVSTGGLTQKDIAQAEKIPDAKVETGKQIYYSNTGKNEVIQIFSYNKNNKQNKLQLTDGKLPEKPNQLVLDEKAEDEGYKIGDIYQIDSDELKEKEYTITGFVRSPLFINNLERGYANVGNGSVDYFVYLPESVFKTDIYSVLYLDFTNVKNLNTYSKAYKDKMEQNQEKAEKYLQDRPEERLEELKKSANEELEPAQQKIADGKAQTTQARTRLEDAKKQLAQQSATIQQLPEAQRTIAVQTLSQQEAQLAEQERQLVEKERELASAEEELNRNAEKIENLTKPSYLYNERSENVGFQEFGDLSDRIAAIANVFPVFFFFIAALITFTTMTRMVEENRREIGTLKALGYTKVEIAKKYAIYASLASGIGIVLGTILGTNLLPRIIFELSNERYDIGSALIFYDWPPILQAAAAFFIAAFGAAMIVLFKDLRERPAALLQPKAPKPGKRIFLEYITPLWSRLSFNQKISYRNLFRYKSRMLMAIIGIAGCAGLMVAGVGLKDSLSSVSAKQFGPIIDYQAIVTLDSSTEDSRQKAADMLQKQEKVNEILAIHTQTVELRKKGHASQSLTVIVPSKTADLDRFIHLTDLEENPRSLPKTGIAITQKVAELFDLSTGDHISLYDEDQKEWKVEVKEIVKNYLGSFIYMSPEYYASVTDQSMMDNAFLLRTDKMTTKEEEMLSEKLLATDAVTNTSFMSKQIETQEESMANLDSVVLIFVVLSGLLAFIVLYNLTNINISERVRELSTIKVLGFFDKEVTMYIVRENIIFTLLGIIGGFGVGYILTDFILQQASMENVIFPLVITWWAYVLSAGLTIVFTVIVMIVTHFKLKHIDMIDALKSNE

SEQ ID NO: 6451 - protein, 74 aa, Enterococcus faecium
  misc_feature (B) LOCATION 1...74
  hypothetical: YES
IVFIIPRVRGEIKSRFLVDMKQNKNPHLFNLFILLKDRLNVDRSRLSSLFHFEKKLTACFFYGILARKRIRIMR

SEQ ID NO: 6452 - protein, 73 aa, Enterococcus faecium
  misc_feature (B) LOCATION 1...73
  hypothetical: YES
NNFIFLHNCSFPIYYFVIFNDNKIEGKYLLKLLEFIIYFKRKRKGVDHLLCVCYNVSGYKNEKMQEEMVIWEN

SEQ ID NO: 6453 - protein, 428 aa, Enterococcus faecium
  misc_feature (B) LOCATION 1...428
  hypothetical: YES
HLFIEYALPREKKNFKKILSFSCLNTRGRPHNFLVGFWKKFPKNFLTQSPDRQPVKNNALLRIGIAPLAHLKYEQQLVFKQKQVEHVMAKIAKMPEVPVLPTVGMAEPFGYRNKAQIPVRRIDGQLATGFYKKNSHDLVPIEDFYIQDPVIDQAIKVVRDILQRFQVRRYNEEKNEGQLRHIIIRRGHYSHEMMVVLVTRKEKFFKSKEIAEAIHEELPEVVSVIQNINEEKTNVILGDKEKVLYGRDYIEDQLLGKTYRISAKSFYQVNTQQAEYLYQTAIEFAELDKKDIVIDAYSGIGTIGLSLADRVDKVYGMEVIPEAIEDAQFNALNNKIENVHYEVGKAEKVMKKWQEKGIKPSVIVVDPPRKGLDHHFIESAIEMSPERIVYISCNPATFARDAKLFAEAVYAVKKIQPVIFSRKPIIWN

SEQ ID NO: 6454 - protein, 182 aa, Enterococcus faecium
  misc_feature (B) LOCATION 1...182
  hypothetical: YES
GVFMADKTIKELAEELGVSKTAINKKVSDKNRKLWFAKNGNKFVINETGQKAIKSMFLVDNANLNRKLVGEKSKTKNHKNTNQVSELKLLSFLEKQLNRKDIQLQEKDNQIKQMQKLLDQQQQLTLQANQQIENLQEQLHLTYTEETPTTESTAFSEKKADNTQPLIEKKWWQIWKSNRTNL

SEQ ID NO: 6455 - protein, 359 aa, Enterococcus faecium
  misc_feature (B) LOCATION 1...359
  hypothetical: YES
FSFIFSIKEQEMSSKGTKTKIHLNLLLLIVIFAIIYYLINQSFADIFAELLSTSVVVLAAAVILGTVYQIAEGRSIKEIAEPFAPNFTTKDGFLTSSYIAFYRIVSFGTGTLISEIYFYNKKGMKLSQGAGVTALHMIMYKLAVITYALAGLVIQFSLFYSNGPSMIWFIIAGILLTIVIVAFLLAMSVSLNVQIFFVSLSNKLFKSERLRKWVDTCNQQIYSLRETVQTIIQDRTALLRIYLWNMLKLVFWYVLPYLILIENHPKIDFLLTISFISFAVVLSGVIPTPAGIGSFEFVYLLLFRPVVGTVDAVSSLLLYRFSSFILPFLYGFVYVIAERRRVIKEEIIEVKKENKENQG

SEQ ID NO: 6456 - protein, 389 aa, Enterococcus faecium
  misc_feature (B) LOCATION 1...389
  hypothetical: YES
SSFILDVNKSSFLLFVYFKKEMKGNHMYKLLTSGPLTTSETVKNAMLIDHCTWDQEYKEITQWIRKKLLDLAQVSEGIYTTVLMQGSSSFGVESVLSSVIRPEDTVLICSNGAYRQRMINMCECLKLNYTVYEVSEHQILQAHVITQLIEENPSISALAMVHSETTSGILNNLEEIAAVTQERDLLFIVDAMSSFGGIPICVAELGIDFLISSSNKCIQGVPGFSFVLANKAELEKRKNVSRSLSLDLYDQYRVMENENGKWRFTSPTHTVLAFQQALKELEAEGGIETRYSRYLANNHVLRQKMTEMGFQPFIQEYQGPFITSFLYPKDWRFDFNHFYQYLKQNGFVIYPGKISDHECFRIGNIGEIYPEDILELTAIIKDYKENVND

SEQ ID NO: 6457 - protein, 87 aa, Enterococcus faecium
  misc_feature (B) LOCATION 1...87
  hypothetical: YES
NTFIILVSNPANLTVDKLISSDYELSQFIIDSLEKKNLCVDLSQYLGHILVETVKPFFLLLILQIPVGLDSESSYGFDFGYKILQCS

SEQ ID NO: 6458 - protein, 69 aa, Enterococcus faecium
  misc_feature (B) LOCATION 1...69
  hypothetical: YES
AKFMQKCGKPFSQNFSSYSKLNDFFTTSDSRCSRRSFVENKPKFFEDGYFFFSNLDRGGGHYSVFFDKK

SEQ ID NO: 6459 - protein, 71 aa, Enterococcus faecium
  misc_feature (B) LOCATION 1...71
  hypothetical: YES
AKFMQKCRKPFSQNFSYYSKLSDFFTTSSLNGVQKLASAVISPTKRKIGGAIFVWLFLLLDAEQLFHNLFL

SEQ ID NO: 6460 - protein, 304 aa, Enterococcus faecium
  misc_feature (B) LOCATION 1...304
  hypothetical: YES
LTFFDNMIKRQSRRKINMLKDLNQLIDYIEEHLTEGLSYKIIAENTGISEYQLKRIFTFIAGMSLMDYIKNRRLALANRDLLDGSRVTETAFRYGYETVEGFSRAFRDWSGYLPSEISRYGIQKSFPRLTFFIDVRGGKSMEFRIEKKEQFYVAGVAKKVPVKFEGVNQEIQKLAQTITETQREEMHKLGDLYPNQVINVSYGFDGDRLEEKGSLMHMIGFATTKENPYADLEMLAIEEHTWAIFPNKGPFPQTLQDTWGKIYAEWLPSSDYGLVEAPEISFTKWGEDFSNVYSEIWIAVKAKK

SEQ ID NO: 6461 - protein, 68 aa, Enterococcus faecium
  misc_feature (B) LOCATION 1...68
  hypothetical: YES
TPFISEVVSLPFNSESQGAISKNSFSCLMNILTCDRRVGRRTPFIRGCDKSLVATSFLTKKVQIVYFK

SEQ ID NO: 6462 - protein, 62 aa, Enterococcus faecium
  misc_feature (B) LOCATION 1...62
  hypothetical: YES
SKFMVEVVDEKFFICFFIIKKHLFDKDVNDFLVYQQVYPLLTNRLSTNSGKLEDKLRQNKNV

SEQ ID NO: 6463 - protein, 63 aa, Enterococcus faecium
  misc_feature (B) LOCATION 1...63
  hypothetical: YES
IGFLNSIFENSQELPYNINKDRREREDMPKRKSSGKMGIILAVISAIPAILAIVRAMKESRDN

SEQ ID NO: 6464 - protein, 118 aa, Enterococcus faecium
  misc_feature (B) LOCATION 1...118
  hypothetical: YES
SSLIFNTRAGIPPTTVSAATSSKTTAPAATTASFPIWTPSTITAFAPTSTPSSTITGLADAGSITPAKTAPAPIWQFLPTVARPPKTAPISIIVFSPITAPILIIAPIMITALLPIDT

SEQ ID NO: 6465 - protein, 178 aa, Enterococcus faecium
  misc_feature (B) LOCATION 1...178
  hypothetical: YES
SMLMHSSLPIIYLNRSNKLMDYLRSFFMLTIYSSRTHSYHLMANWLKDHQMPYRERIFTPKQPLTRKEIFYLLSLTENGFDDLLAKRSIDYKNLKDQIDQCTTSELVDLIVSHFTLLQRPIITDGKKLLVGFNEDSMRLFIPVQWRRSQLKSVYNDFTWVSNLENSTDLDDEFLNYYI

SEQ ID NO: 6466 - protein, 115 aa, Enterococcus faecium
  misc_feature (B) LOCATION 1...115
  hypothetical: YES
EVLIMPIIKNVNELTERVKFKKTKRVKDEDGQMVDSEETVFECWANVRSQMLKDVLASVGTILEGTLTFIIRYDQDYELTNDMKVAWKNKSYKIISINEGTAFKDYTTIIAKQIS

SEQ ID NO: 6467 - protein, 87 aa, Enterococcus faecium
  misc_feature (B) LOCATION 1...87
  hypothetical: YES
EKLMANEIVKYENRLNHIPLRKFNSREMNLFFSIASRVREKGVDEIIFSFHDLKKLSGYTERGEQFIKDLSSTYDKLWFCCKVLNKE

SEQ ID NO: 6468 - protein, 263 aa, Enterococcus faecium
  misc_feature (B) LOCATION 1...263
  hypothetical: YES
KWLIIRKILEKRGRRNNKLINAQQIVEKMKNQKINYDTVLKKMIMQWEKEEVKPKILIHTCCAPCSTHTLEFMSQYAEITLFFSNSNIHPKSEYLRRLHEQKRFVDQFNEKTDHHVALIVDEYRPNEFTKMVLTNHLENEKEGGARCSACFNMRLDLVAQKAQELGYDYFGSALTISPKKNAALINQIGMDIQKIYGTQYLPSDFKKNKGYERSLQMCKEYDIYRQCYCGCVFAAKQQGCDLKEINREAKAYLKTSTVVFEEN

SEQ ID NO: 6469 - protein, 158 aa, Enterococcus faecium
  misc_feature (B) LOCATION 1...158
  hypothetical: YES
KFIIYLNCSLMKAKPIVSNYVKERKILVKKSILLISHSQKVTDGIKEMIEQMQKSEEVQIFSLGGINGEIGSDPMKIVEAVNESSDAASYFVFADIGSAVLNSELAKDMLEEEQQQRYHLVDAPLVEGAFAAAITAGITDDTQQILTEAQNAGKKGWE

SEQ ID NO: 6470 - protein, 323 aa, Enterococcus faecium
  misc_feature (B) LOCATION 1...323
  hypothetical: YES
MFIMKRIGILTSGGDAPGMNAAVRAVVRKGIYEGLEVYGINYGFAGLVAGDIRRLDVADVGDKIQRGGTFLYSARYPEFATEEGQLKGIEQLKKFGIEGLVVIGGDGSYHGAMALTKRGFPAVGIPGTIDNDIPGTDFTIGFDTAINTVLESIDRIRDTATSHVRTFVIEVMGRNAGDIALWSGVAGGADEIIIPEHDFDMASVAKKIQEGRDRGKKHCLIILAEGVMGGNEFAEKLSEFGDYHTRVSILGHVVRGGAPSARDRVWASKFGAYAVELLQEGKGGLCVGIHDNEIVASDIIDTLENNKHKPDLSLYDLNNSLSF

SEQ ID NO: 6471 - protein, 319 aa, Enterococcus faecium
  misc_feature (B) LOCATION 1...319
  hypothetical: YES
FIIIETGRIFYMNKRLLDYSASDFLKAKPMELKQAILASEGRTIMAENVPSSCPYMGKSVTNAELERAAGADLILFNALDLFNPQISGVPLTLKENPIIWIKKALGRAIGVNLEPVDKEVLMSENRTEISSGRIVSPETLKKANELGFNFICLTGNPGTGVSNRTIEKAITLSKSIFNGLIIAGKMHGAGVDEPIMNLDIAKRFIKTGVDILLVPAPYTVPYFMESDLRGIVDYIKDFNRNKSIEEKVLVLTANGTSQDSSDQETIKKIALASKACGADIQHIGDSLNGICLPENIFALGQAIRGYRHQIIMLGKSNYR

SEQ ID NO: 6472 - protein, 62 aa, Enterococcus faecium
  misc_feature (B) LOCATION 1...62
  hypothetical: YES
IIIIIKIMLKIKKNCPSLLFKSFYQNYIVNVKKQHDIIYRRLYSIYGSLLKKNGVRVNTMGH

SEQ ID NO: 6473 - protein, 455 aa, Enterococcus faecium
  misc_feature (B) LOCATION 1...455
  hypothetical: YES
IRIIFNLFVEKGYNRKRERRENMVINFIILFLMIAITSFFVASEFALVKIRRSRLEQLEKENVKNAKLALHVTHHLDNYLSASQLGITLTGLIIGWVGEGSVAALLEPVIGKLPFSSAISSTISVALGFILVTYIDVVIGELLPKSYSIVNTEKVVLFVVKPLHYFYKVMFPFIWVLNHSAAGLGKLLGVRLVSEGEETLSQEELTLVALNSYEKGELTKEEYHYLENVFEFDDTLAKDIQVDRTSMQVFEASETVKEAIKASIEQGHTRYPVILESKDNVLGYVTLPDLIKQSYKDDQLTVEQLIEEPIVTTETIPIKKLLTIMRKKGKHIAILKDEYGGTSGLVTIEDILEEIVGEIRDETDLDEALIAEQSDGSYIISGKLTLDDFQRYFHVEIPEFEETNFTTLAGFASSRYKEIKAGTIIEIASFRFTVLEYQHAHIDYFKVESTERKIE

SEQ ID NO: 6474 - protein, 65 aa, Enterococcus faecium
  misc_feature (B) LOCATION 1...65
  hypothetical: YES
SGIIINTNNRITNINVFVNRIFSKKCVSLIGKQILDKIKMTKNANGFFDNIIKKFKKSIALFRRN

SEQ ID NO: 6475 - protein, 333 aa, Enterococcus faecium
  misc_feature (B) LOCATION 1...333
  hypothetical: YES
KVIIWRVIEMKKTATVLFVILGLSIIAAMIGISTSANERANENLSFTVKTDRIVYDMTQQVITIPVKPNKSVNASDVHAVLTYGWDGNGSSEKVIGEVYLKDVQWTAGIEYTIMISAELSIDEIKSKDKVDLIVFYDGQMTITENLKPSSWTVVGPPSSTDSTSSESSTENTSGESSTESTSSESSTENTSSESSTESTSSESSTGSTSSESSTESTSSESSTGSMSSESSTGSTSSESSTGKVNNELDLVPIIPTKEQKRNAGSNLKSVLKQPDFVSRGIDHQEKAKETDNRKSDLPETGSRTLNKLITWMGVLLILIVGASYFRSLFHRVK

SEQ ID NO: 6476 - protein, 88 aa, Enterococcus faecium
  misc_feature (B) LOCATION 1...88
  hypothetical: YES
KEIMPIRILTALVNKITIRKAFYISSAFFLFSNQTYNHLFLFKNVGVIQFCCKHLFYLHIVNGRTNNGFFLVSLYRILFPKKKKQLEI

SEQ ID NO: 6477 - protein, 222 aa, Enterococcus faecium
  misc_feature (B) LOCATION 1...222
  hypothetical: YES
SLIMKKSGTTRKASFDKETYLKGASFLYKKMISYIKFLRKEWKVMSWFTRAIDAAKRNDPAARSTAEIVLTYPGFHALFWHRFSHFLYQHRLFLLAKINAQFWRFLTGVEIHPGATIGTGVFIDHGMGIVIGETAEIEDDVILFHGVTLGGTGKETGKRHPTVKQGAMLSANAQILGPVTIGKNAKIGAGAVVLKDVPDDATAVGVPAKVVRIKGEKVRRSE

SEQ ID NO: 6478 - protein, 87 aa, Enterococcus faecium
  misc_feature (B) LOCATION 1...87
  hypothetical: YES
RLIIGLSYVATIILGGKYVLECGRSTGGIGPFISYIGMXVXPMFADRSIVAPSWSPRDATEDPLEPLRLGEHSWNNWVQCRPRQKAS

SEQ ID NO: 6479 - protein, 237 aa, Enterococcus faecium
  misc_feature (B) LOCATION 1...237
  hypothetical: YES
CMIIGVLIVSLLAFALTNVFAKKTWQTFLSLIFGLIFVASLSLIVANLSNHFGMEKVTETKTEKIVSSADSQGADMLLYKALGNGKEKVYLYRTNEKQEKPKATGTDNETNKVEKTDGDAEKVTKTTYWEYKNDMYKFWFNIADNNHEYDSRVNTFKIPETWVELSTDQAAKLAELVKKQQSTMESEAKAYVQDGMVKAMTENPKMSKAEQEQRTKALAAEFQQQAFAKLVKEAKGE

SEQ ID NO: 6480 - protein, 288 aa, Enterococcus faecium
  misc_feature (B) LOCATION 1...288
  hypothetical: YES
KQIILSIMTMDIMAIRSITPTGKIKVMASDDEHMGVFLELKGAGSRNMEYVLQAQNRDWYSFLNRCLDCGGVIRRFDLAINDMCGLLDIPVLSEKYKNGGAECRCKNYENVQGGKLSGKNRNLASTLYIGSKASTKYFCLYEKQKEQAAKKKHTDIINRFEIRLRDKKAVQAVEELLLTYNPHGLVFYLITDFVQFPDYPLWEIFISHDSLPFEMNPVPVNMERTLQWLERQVMPSIVMIEEIDRLTGSNYMKMIDECTHLSEKQEMLVEQMCTDIADVIQSEGVFYE

SEQ ID NO: 6481 - protein, 283 aa, Enterococcus faecium
  misc_feature (B) LOCATION 1...283
  hypothetical: YES
EQIMTEFKTEKEKMIAGELYFANDPELVADRMFARSQSQIINQAESAELRSQLLKETFGRTGKKIYMEPVINFDYGYNIFVGENFYANFNCTFLDVSTIEIGDNCMFAPNVQLYTATHPLHPVKRNSGLEYAKPIKIGNNVWLGGGVIVTPGVTLGDNVVVGAGSVVTKSFPDNVVIAGNPARIIKTVEEELTEESLETLRHKIDMIDRELVALLEKRMDTVTKIGQVKKEENQAVYDAKREQQVLDKVVSLLKNKGYKETITDTYVDLMKHSREYQNKMKEE

SEQ ID NO: 6482 - protein, 117 aa, Enterococcus faecium
  misc_feature (B) LOCATION 1...117
  hypothetical: YES
VKIMEINVEHILDCLDQYGKGELTEEQLTNALTYDEKMFLIMHQGLLEVGNDAKEDFDIPDWLGEEESFFMVVEVNESLCRQAESVLEEIGVEMPDAIEGFLKQLVETKQLPVVVND

SEQ ID NO: 6483 - protein, 290 aa, Enterococcus faecium
  misc_feature (B) LOCATION 1...290
  hypothetical: YES
SHFFMEVIIMNVGFIGAGKVGCSFGKYFQEHKIQVTGFYSKSEDSSLAASNFTSSKQYLNLRELVDENDTIFITTPDGQIQEVWQEIKNYQIKNKLICHCSGAISSDIFSNIQDYGAYGYSVHPMFSISDKYNSYKKLKKSFITIEGDEKYAKFLCDFFKKLGNSTVIVSKENKSLYHAASVVSSNLVLGLINTSVTYLIQCGFTEKMAIEALYPLIEFNIRNIKEKGIIESLTGPVERCDISTIKGHCEVLSDEDRALYMLLSKNVLEIAMLKNINRDYSELEKYLGES

SEQ ID NO: 6484 - protein, 63 aa, Enterococcus faecium
  misc_feature (B) LOCATION 1...63
  hypothetical: YES
ECVILFLKAIKGESAMIQAKITEIGTEAINKEEPMLILFDKTATAALRKYSVIQEVSKDELFL

SEQ ID NO: 6485 - protein, 173 aa, Enterococcus faecium
  misc_feature (B) LOCATION 1...173
  hypothetical: YES
KSFFNSSSFLKAAIFIKNKHLRNQISITKNVKLIITIFNHNFCAYGYRRIHQALKNMGKKLSEKVVRRLMTEENLFVKFSRRKKYSSYAGEISPAHPNLLNRNFKAKKPNEKWLTDITEFRILAGKIYLSPLVDCYDGAIVSWTIGTKPTCFTLCLKRVIHQIIQRAKVSLDD

SEQ ID NO: 6486 - protein, 324 aa, Enterococcus faecium
  misc_feature (B) LOCATION 1...324
  hypothetical: YES
QIVMKRSCLFMKKTSRKVVIVGTGFVGTSIAYAMINQGISNELVLIDVNQEKAEGEALDLLDGMAWGDENVAVWSGGYEECKDADIVVITAGINQKPGQSRLDLVKTNASIMRQIVKEIMGSGFDGIIVVASNPVDILTYIAWNESGLPTSRVIGTGTTLDTTRFRKEIALKLKVDPRSVHGYILGEHGDSEVAAWSHTTVGGKPVFEIVEKDHRIAQDELDVIADKVRNAAYEIIDRKKATYYGIGMSTARIVKAILNNEQAVLPVSAYLTGEYDEKDIFTGVPSIVDENGVREVVELSINEEEKAMFSKSTSALREVLNTVL

SEQ ID NO: 6487 - protein, 156 aa, Enterococcus faecium
  misc_feature (B) LOCATION 1...156
  hypothetical: YES
KSVIIEGGKIMSQIYLAGPFFSEEQIDRVSRIEKALEENKTVTSFYSPRHHQESNYELFSAGWAQEVYEKDMEELTNAEFVVAILDFEHQTIDPGTAYELGVATMLKKPMIIVQEETVPTNLMITQSLHTYLKSDQAVREYDFETLPVETYVGEYL

SEQ ID NO: 6488 - protein, 76 aa, Enterococcus faecium
  misc_feature (B) LOCATION 1...76
  hypothetical: YES
SKVIKKSEDTEMEQFLNEKITEAKREVDRLTHVCQTKPFDSADFFENEFQIERLAAQIEVYELILKKVIEENIDVQ

SEQ ID NO: 6489 - protein, 313 aa, Enterococcus faecium
  misc_feature (B) LOCATION 1...313
  hypothetical: YES
KLVIQMEVKELEQLIGKNFHYYQTGQVADYIPALAEVDPKQLGMAIYDLDTKQLIEGGDADVRFAIESMSKVPVLLLAIKDNGIEKVFQTINTEPTGFAFNSIMNMEINHRKHPMNPFVNAGAIATTSLIAGKDADEKFERILSFMKEICDDPNITLNEEIYHSESRTGDINRSLAYYMKGNQMIEGDVPEILDAYFRQCSLNVTATGIAKLAAVLANKGIAPWNGKQIITEESATIVKSIMTTAGLYDESGEFSVHVGVPAKSGVGGGLMAAVPNRYGIGVFSPALDPFGNSAAGIQLLKDVVKELDADIFE

SEQ ID NO: 6490 - protein, 361 aa, Enterococcus faecium
  misc_feature (B) LOCATION 1...361
  hypothetical: YES
GGILMIELRDVSVCFKQKEKEIQAVDSVDLTIEKGDVYGIVGYSGAGKSTLVRVMNLLQKPTAGEVIVNQTNLSQLSPKELRKERKAIGMIFQHFNLMESRTIFDNVDFSLKYSGKSKQERRQKVNELLELVGLEEKASAYPKQLSGGQKQRVAIARALANEPKVLLCDEATSALDPKTTLQILALLKKLNRQLGLTIVLITHEMQVVKEICNKVAVMEDGRIVEKGSSIQIFSNPEEELTKDFIRTATHLDQALETIIAHSAFADQIANKWLVELSYIGNQTNEPLIAHLYSKYQVTANILYGNVELLQETPLGSLIVTLAGETKQRKKALDYLIKSGVKINILQKNDLDSRIKVIEGGR

SEQ ID NO: 6491 - protein, 415 aa, Enterococcus faecium
  misc_feature (B) LOCATION 1...415
  hypothetical: YES
GGIFIMLSDFNELLKKYARLIAETGVATEKGHTVVLQISVEQAPLARLITQEAYKLGAAEVIVQWTDDQIQREFLLHAATDRIENVPQSKIDQADEWLEKGASRISVVSADPDAFAGVDSHRVASYQSANGKALMNLRKATQANKVSWTVVAAAGKQWAAKVFPELPEEKQVEALWDQIFKTTRVYEEDPVLAWKKHDEKLAKKAEELNREQFSALHYTAPGTDIIIGLPKNHLWEGAGSYNARGEKFMANMPTEEVFTAPDSHRVDGYISSTKPLSYAGTIISGMKFTFKDGKVVDFSAEQGEDVLAKLLDTDEGARRLGEVALVPDPSPISQSGIIFFNTLFDENASNHLALGSAYAFSVKGGTEMSDEELAEAGLNRSQTHVDFMVGSDKMDIDGIREDGSTVPIFRNGDWA

SEQ ID NO: 6492 - protein, 206 aa, Enterococcus faecium
  misc_feature (B) LOCATION 1...206
  hypothetical: YES
GGILVMSVSLEVSKREVRPRSLRNKLRHEGKVPAVVYGYKVESTPISFDGLTLSKLLREHGANTVITMDIDGQKVNTLVHKIQTNTFTNHFEHAEFLSVNMSEETEVETEVVLVGESVGAKSGGVLAQNLYTVVVSATPDKLPERIEVDVTNLELGDSITVADLPKNDDYKFVTDSEEQIAAVVAQSEEESTGEGGEPEVIGSTEE

SEQ ID NO: 6493 - protein, 279 aa, Enterococcus faecium
  misc_feature (B) LOCATION 1...279
  hypothetical: YES
TRFFLASLTMNEPKLWTKQSKISLLQLIVKKNLASFLISLRFGNNTAICSYEGAGLTLFIALIGTVVGTTLGLLIGVFRSVPESGNALTRFFQKIGNALLSIYVEVFRGTPMMVQAMVIFYGLALAFGISLNRTIAALFIVSLNTGAYMTEIVRGGIFAVDEGQFEAAQAIGMTHGQTMRKVVIPQVLRNILPATGNEFVINIKDTAVLSVIGVADLFFQGNSASGANFQFFQTFTIVGIIYLVMTFTITRILRAVEKKIDGPSAYTKLEEIDNSNLQE

SEQ ID NO: 6494 - protein, 65 aa, Enterococcus faecium
  misc_feature (B) LOCATION 1...65
  hypothetical: YES
GGSMSRKTSVKISGDLEKIIKSEANKILKKGVDYTCPSCGKKIKISNGKNKCKYCGAEIDFKGKV

SEQ ID NO: 6495 - protein, 106 aa, Enterococcus faecium
  misc_feature (B) LOCATION 1...106
  hypothetical: YES
DKSMTHKIGVVGDKDSVLPFKLFGFDVRYGTTKQTVRQAIEEMAKNEYGVIYVTEQCAALSPETIERYKEQMIPAIVLIPNHQGSLGIGLEEIQKNVEKAVGQNIL

SEQ ID NO: 6496 - protein, 125 aa, Enterococcus faecium
  misc_feature (B) LOCATION 1...125
  hypothetical: YES
RSFLRYDFNWEKLIDKEVFMKKRLLWCLLSLSLSLTSQPVFAEETQRSLSTGAHMYKNIYAQTSAFDSAFPETEERALQPRFGYFWYCPSCDYESCWHFFHSTAAAFAVTHAQKYDGHHPVIYEV

SEQ ID NO: 6497 - protein, 295 aa, Enterococcus faecium
  misc_feature (B) LOCATION 1...295
  hypothetical: YES
KKPMEILYLLERGNNMLQNFINGLYDFHFLQNALITSVVIGIVSGTVGCFIILRGMSLMGDAISHAVLPGVAISYILGINFFIGAIVFGLLASIIITFIKSNSVIKGDTAIGITFSSFLALGVILIGVANSSTDLFHILFGNILAVQDIDKWITIGVSVLVLVTVVLFFKELLITSFDPLMAKAMGMNVSFYHYLLMILLTLVAVTAMQSVGTILIVAMLITPAATAYLYANSLKTMIFISATVGACSSLLGLFIGYSFNIAAGSSIVLTAAFLFVISFLISPKQKFLRKKERKL

SEQ ID NO: 6498 - protein, 68 aa, Enterococcus faecium
  misc_feature (B) LOCATION 1...68
  hypothetical: YES
HQFFSEFLVIYPHAALASPRVGGIEKVDGFLSQRFRNLFQGAALLAAQKQDAGAVADDSFRMVFVDSL

SEQ ID NO: 6499 - protein, 62 aa, Enterococcus faecium
  misc_feature (B) LOCATION 1...62
  hypothetical: YES
SLTIYIVYELTDIGTPIVKQHNGINEITLYYDLPLFFYFIIGLTFIGWLILFIMFIRSRIHS

SEQ ID NO: 6500 - protein, 378 aa, Enterococcus faecium
  misc_feature (B) LOCATION 1...378
  hypothetical: YES
GVTMSLLTFERNLLLKNKVNFLFPLLLVVLFAFPLFFDHKLAYTEFDELNHNYEEMQRLIETLKEDENEKEFVESLEKSNKLIEAILHAKNTGNVQQMVEATYHYEKDILDRLISGQRQGIPIIEQQKRVELLRYMKEHQIQRYSIFDLPAHLSLANYYENIFSGMISSFLILCITALFLSSIISYEKRKQVISLVNLLPDSMVKKHSIRFTIYYGAAMLSLVMPFLIVSILVIIKNGLGDFRYPVGTIIGQEIRILPMYEYLFQSFLFLLLWVLFLSTISFLLSALFEHSLVNLLGTLLCLFLAEYRLFSSIGWIESISHYLPTSYVDFQNVIIGGDIFSPLASEQVTFMNGILTLGIWSIVLLFIGMGTIYIKKSY

SEQ ID NO: 6501 - protein, 214 aa, Enterococcus faecium
  misc_feature (B) LOCATION 1...214
  hypothetical: YES
EVTMDNSNEKLTKKEYLELIVEGGIGAIPYIGGVVQSLYFGSKNEKRFKRIEKFYKNLNESLENIRDQIPEDVFNLENKDQLIGIFEGINDEVEKSKAQNKIDMYKNLYKNCLLRINNASWDNEEYYLLVLNQLTSIEIQLLACLMSRGNENFTGNISMSGYSQELIDGSLNRLSDFGLLEKTISSIVLGDVGKQNMGYKISHLGIQFINSTLT

SEQ ID NO: 6502 - protein, 133 aa, Enterococcus faecium
  misc_feature (B) LOCATION 1...133
  hypothetical: YES
IKTIRQMIFYEEETIMIKVVIADRMGKGQNVAKGVEAAGGKAVVVPGMGADMRLGDVMQQEHADMGISFCGSGGAGALTAATKYGYPERHGMRSIEEGITAIKDGKTVLGFGFMDQEELGKRLTEEFIKKHGK

SEQ ID NO: 6503 - protein, 805 aa, Enterococcus faecium
  misc_feature (B) LOCATION 1...805
  hypothetical: YES
IKTIRQMIFYEEETDMAEEKEPLDNSRLGKSKRKLVRLQNELNDQIEKMFEHQRKTNGQPMNDKRNGHSWFRQQERIENKVQSLREEIKQQEKQVEKLERQEELKEMGYNKYGGLDMTIENIPRIKEEIERFEKGESTFSAATIRKYQRKLETLEQLKEKSEKGKENILPEVQAIIDSGRVTQWKKNPTIYFLKGYRKVALELNENGGFEESKKYQATSEEEKAAVRELLEEATPTDSVKEKETDHFYRVEFNENDPAKGLKSYGGEIVTLELIDQLKTLDNQYAAEAGYYKFYFEEVKNGEVVDQIRMDLGDGVNSNHPIYLELARLCEQVPEKEQKQTVKNEPISKVQNEIKETKTKQKGYQKRTAEEIKQEVKSLSQQALDAVKKHTHSPEDVKELLNFMSRFPERSFRNQLLIEEQFPGATACLGRAALKKEGIYIKKGEQGNKIFVRKTVKGFYEKGRGFVRETEATPEDKKRIESGQIEVIKKPYYTIEKVFDITQTQLKPEDYPKIFPNRVFDFQLDQTGHTELQVGIQAVAKNIGIQIRDMTESEVYQRELGQARGAYVRNEFTGEEEIVMNTRNTPTQHLATSIHELAHARMHKFSELDTATKELQAEMTSYIVCKHFGMDTSEKAIPYIATWTKNGQTLDDKEAAERGKIMNDVSRVANEFIQTISNEINQYREREPEIQPAEVKQDEKNVVETAEQKNIVLVGSLWIDKKDGKVLEEDTGRTLHLKDAAFIEDTQHNQVILKGKSYGKEIQTALPSEEFALGNPFRFSLETVSEVAKRKNEIYYEQQLSQKERV

SEQ ID NO: 6504 - protein, 415 aa, Enterococcus faecium
  misc_feature (B) LOCATION 1...415
  hypothetical: YES
GETILDTCRCPRKLTGREEYNKIIEFQEGHRYHRLLCPTETRFCYSLLLHMIKGAIFLRPKQQLFITLLVILGALFNNISVSASAFNFSVTPITSENQIDKRKTYFDLQLDPDQEVEVKAELRNDTEKEVKIDISVNSATTNSNVMVEYGKNEIEKDMSLIFDLVDYVSYPQIVTLKPKSVQTVAFHVRMPNERFDGVLAGGITFQEIQTEKDQTETKDQSLSIENEYTYIIALLMQQTLNEVAPNLTLHEVKPDQINARNVILANVQNDQKTYINQVVIETKITKKGHSEVLYQEEKEGLQIAPNTNFSFPTALNGQPLTPGEYHLTMTVLGNENENGKFSRKKGNTTINYTNQWVFEKDFTIDGKVAKELNTTDVTIKKDNNWIYILVASLFLLFILLCILLFVLRKKEEKEK

SEQ ID NO: 6505 - protein, 102 aa, Enterococcus faecium
  misc_feature (B) LOCATION 1...102
  hypothetical: YES
GKTMDHKSNYSYKENYIWKYVVAVFLLVGGIIALVKWAIIPNALVFINWFVPNFWSFFGYILIIWFMFKVLSFFWSPVYSLLGKWSYLILIATAIYIIMQIN

SEQ ID NO: 6506 - protein, 119 aa, Enterococcus faecium
  misc_feature (B) LOCATION 1...119
  hypothetical: YES
ITFFRLNRLIWKNIWINLFYCEKKGIIEYTFNNENEGWALKQQVILNTEFMTLGQMLKEVTVIGSGGQAKWYLAENTVLVDGEPENRRGRKLYPGMMVEVPEVGTFFMVKKGNDDNEAE

SEQ ID NO: 6507 - protein, 615 aa, Enterococcus faecium
  misc_feature (B) LOCATION 1...615
  hypothetical: YES
KSAILNFVLQYEGSFFMSYSLNWNLDSIFSGGSHSDALNQRMKQLEDQMNEYYHRVTKWSPSSDNAEQLNAILQLQETITNGFTQCSSYITALLSANVNDSDAKVLSGKLYAMLPRLQSAETVLSKKFAEISDNDWNQMLSQSSFETIAFRLNEIRRDGSQLLSEAEENIINTLSLDGLNAWSSHYDTIVASISIPFEQDGQVVELSAGQAFNKMMGDPDPKVRETLFAAWEEAWKEKAPLFTDTLNHLDGFRLSDYELHGVTDFLQKPLEYNRLKKETLSVMWDTIQKNKQPLVNYLTRKANLFGKEKMEWQDQDAPIILGDLKEKTFSFDEAAAFIIENFNKFSPKMAKFAQSAFEKSWIEAEDRPGKRPGGYCTELPETKESRIFMTYSNSVNEVATLAHELGHAFHSSTMWDLPSLNREYAMNVAETASTFAELIVADATLKVAKTKEEKINLLDTKLQNALAMFMNIHSRFIFENRFYEARQEGLVSEDKITEMMVEAQKEGYQGALATYHPYFWAAKLHFFIDDVPFYNFPYTFGYLFSLGIYAYANQKGANFEEEYIHLLRDTASMTTEDLAKKHLNVDLTQPDFWQAGIDMVTEDIQTFMELTEEFI

SEQ ID NO: 6508 - protein, 95 aa, Enterococcus faecium
  misc_feature (B) LOCATION 1...95
  hypothetical: YES
NTAITTIMINILFLFDKFLIIRTSPLHSHILVRNTPLISKYLLVVIIFAMNSYYSYKKGQIISFYLLMIWLVSIYRNCFLITKIVNNRFRYFPVD

SEQ ID NO: 6509 - protein, 164 aa, Enterococcus faecium
  misc_feature (B) LOCATION 1...164
  hypothetical: YES
MKAISNENMQKSISGLEGKVLASGYTLFESLLLILLLTTILSFPVLAFSAWKNELAVYQFFGQFEKRIYSTQKIAIVNQIQTGFYWNSEENQIIFHVPNPDKINWEVLDIPDEITLKRHASITFAARTGNESSLKAYQFYWEEKERTITYQFQIGSGRYTKRIE

SEQ ID NO: 6510 - protein, 236 aa, Enterococcus faecium
  misc_feature (B) LOCATION 1...236
  hypothetical: YES
YFYIVGRKGIINMESNDSYLEYAKANKDKFISYIIKGKSPEVGRDAVFMAGSPGAGKSEVAIGLAENYDNHVIIDADYFRTQFPDYNGKNSSLFQKASSWLVEQAFRYVLDHGYSFILDATFAILSAEKNISRALKKHFRVTIFYVYQDPKIAWKFTQEREIAEGRHVPKKAFINAFFKSRENIAKVKSKHPDVLLHIIIKDYTNNISEVHYATDNLELFLPLGYSRKDLEVQLHD

SEQ ID NO: 6511 - protein, 94 aa, Enterococcus faecium
  misc_feature (B) LOCATION 1...94
  hypothetical: YES
SIYIFYELKYIILLYIIKQEGRIMKKVSNLSRYRKEKGLSQTELAKKMNVTQQCVSSWQTGRTIPKPYQMKMLSEILSVPINELFSDVFNKVNS

SEQ ID NO: 6512 - protein, 275 aa, Enterococcus faecium
  misc_feature (B) LOCATION 1...275
  hypothetical: YES
VNYILIYLSSILRSESMEKPFVKSLTAVAVGAGAIAICLFGYHINNQRQHQQRINYAESAITNQKDTLTSLSKEVDKLYSTKEKIFLNPEITEETITSLSNKLSSVKLSADDYDIKESELPKEAVAIQDEKKAIVTQLDSAESKLKIQTAVNDLFTKNVSNWQQAVDDVIIKEKVTSADVARVRENMSFFKDSPWKTVVMQYLGFADIQIAQVTQLDQLFDTMLKDGQVTATATYDQYLTVLSQIEQIRNEKISAAYATKAQTVAEQMGYSNISY

SEQ ID NO: 6513 - protein, 129 aa, Enterococcus faecium
  misc_feature (B) LOCATION 1...129
  hypothetical: YES
IDYIEKRNEMKLIETPVNSNLNIKTFYPKVVEFFFGNTAINYYKLFSLDRTQLLLVDTYDKKQVVMINTKKKITRQEIDYAIHHVLKMTREDVKVHVGVKQELERAGIQFKRPNKDIVVIEQKNTKDSI

SEQ ID NO: 6514 - protein, 164 aa, Enterococcus faecium
  misc_feature (B) LOCATION 1...164
  hypothetical: YES
FLYIGGEVMEYKFNLNLKEVLPTQGTININGQDNDDDIVIKKIEFIDSDINVFFYSKEKLADFSNIAEMIERLKDFMISVWDVAMLADESNYTSSIYRLEDSNWIEISLELKTLPNSVNYIIRDITSEAQQLVNYMHGHESIPFLLYSLKEVKIYQILEIGLFR

SEQ ID NO: 6515 - protein, 106 aa, Enterococcus faecium
  misc_feature (B) LOCATION 1...106
  hypothetical: YES
ASLFYHAILMLLYVRRHIFVVSSIITALYLLDALIALVAILIKPRDVAAIWAWLLVLFALLGVGSVLYLFFGRGLTDKKKFYFRQSDLKELVNFQSFRGVSSGLLI

SEQ ID NO: 6516 - protein, 218 aa, Enterococcus faecium
  misc_feature (B) LOCATION 1...218
  hypothetical: YES
RKYMNGGENVARKKYPEAVETGQRIRLARIEKGLSMEQLGGKLSPPASKGAVSNWENGYNLPNNTRLKQLSKVLDVSTTYLLNGSYTLRDMHMMPEIKRNVLEKQLKKTIEKNNSIIDSNLSNAINNIEEDNLTVSQKIYLTNAIKYLKTGSRIEFPDGSTPIAYLAALLNTLLRYDSLINDSEKNTDEKKEYQEFYENDLLKEFTALVTELNKHYSK

SEQ ID NO: 6517 - protein, 90 aa, Enterococcus faecium
  misc_feature (B) LOCATION 1...90
  hypothetical: YES
KMYIIFFFVIIVQKKNTRLHLVLCELQIIRSNKHSLIIFRKKSSISTINGSTALTYPYVLQGIFFYTLLMLSQYGTIVIACSNSSCKCCV

SEQ ID NO: 6518 - protein, 309 aa, Enterococcus faecium
  misc_feature (B) LOCATION 1...309
  hypothetical: YES
FRYMIYIRRCRMEINLFEAGNRIKQIREKHGYTMADLGKLVDANSPSTINNWEKGNNLPNRKRLEKIALLGGTSVEWIKYGDFSDYVYRLTQNIEEKILKEYGETTLNNYREALLDELTIEKITYEEDTKILAAAEKINTQNIFQEVKYMYSPDEDYRNIEVKPDLGLTDDNKNIKMIGQRIRKIRKKENITLEEFGKLFSPTADKAVISNWENGKNLPNSERIKKIAEIGGVSELYLMTGVDSSVAESMYFLSEVALDALERLSIEEVNRIIESFAGYLNVISKIDDPDKREISLNAICQLSLLDKMG

SEQ ID NO: 6519 - protein, 252 aa, Enterococcus faecium
  misc_feature (B) LOCATION 1...252
  hypothetical: YES
IRYIPVIIEETKGRVYVMSNQLPVYIQIHDQLKNEIEQGIWKVGDRLPSERELAVKFNVSRMTLRQAIQNLADEGILERKIGSGTYVAREKVQEKMSGATSFTEIMESQNRVPSSRTISYFLTSPSSSEMEKLNLSKDDTILRMERIRFADDVPICFEVASVPQKLIDGYSKAEITESLYRTLEEKGGKKIGPANQTITAVLASEKIADYLEVKRGDAVLRLRQISYFEDGTPFEYVRTQYVGNRFEFYLEK

SEQ ID NO: 6520 - protein, 62 aa, Enterococcus faecium
  misc_feature (B) LOCATION 1...62
  hypothetical: YES
YNHMPMVIRLKKQRYTCKNCRSHWNAQSYFIRPRHSISNHVRHKITSLLTEKVSLFFISKSC

SEQ ID NO: 6521 - protein, 205 aa, Enterococcus faecium
  misc_feature (B) LOCATION 1...205
  hypothetical: YES
LSHMLFGIMETRRDRKMLDKTLPYAEIWMTRPLQQNVPITPLAEGFEFRFYQKEDESAWAEIETSVGEFQTTDEALEYFQQNFAPYPEELERRMFFVETKKGEKVATCTAWRKKSREQVYPVFHWLAVKPDYQGKGLAKALTARVLQEFPTLHTDGPIYLHTQTWSHQAIALYKKMGFTFIAENLDGTPNPDYEKVMQVLSKLDK

SEQ ID NO: 6522 - protein, 305 aa, Enterococcus faecium
  misc_feature (B) LOCATION 1...305
  hypothetical: YES
GLHMRSSKYTEHYTDTFITFKEIMRTVSNIYHNCVPDKIKNRRNTDQLKQRDTVIIACVIWGIINGYTSQRATYRAVCSVLFPNGDFPSRSRFTRLSSNLAYTIKIIRYFFIKKLTKGELVGIIDSFPSPLCKPVRNRQAKLLNQIAKVGYNSTKKSYFYGLKIHMIVTKTGFPITYSIANPGVPDVKVLETLSEEANLPNILGDKGYISHKIHEKLALKGITISVPPRKNMDKSEKLDHSLLGKQRKTVETVFSSLEKLGCQNFNSRSVKWLESRFESILLAYSVLLSRAQRRFEGTLRYSLGY

SEQ ID NO: 6523 - protein, 234 aa, Enterococcus faecium
  misc_feature (B) LOCATION 1...234
  hypothetical: YES
GLHMRSSKYTEHFELANPVTKVVDIPDYEMYSQTIDSLNKRFGNRVLKGIEIGYIASEKDRIIDYLADKDYDLKLLSVHHNGQFDYLDDEVKDMDPAIVIPQYFAQLSEALVVIEADVFAHFDYGFRVFGLSVAEFKQYEAQFLPILDQVIKNKLAFELNAKSAYLYDNLALYEYVIDLYLSRGGTLFSVGSDGHYLEHFRFHFDDLFALLKAKGVTELAIYQKRKRIMVPLPV

SEQ ID NO: 6524 - protein, 305 aa, Enterococcus faecium
  misc_feature (B) LOCATION 1...305
  hypothetical: YES
GLHMRSSKYTEHYTDTFITFKEIMRTVSNIYHNCVPDKIKNRRNTDQLKQRDTVIIACVIWGIINGYTSQRATYRAVCYVLFPNGDFPSRSRFTRLSSNLAYTIKIIRYFFIKKLTKGELVGIIDSFPSPLCKPVRNRQAKLLNQIAKVGYNSTKKSYFYGLKIHMIVTKTGFPITYSITNPGVHDVKVLETLSEEANLPNILGDKGYISHKIHEKLALKGITISVPPRKNMDKSEKLDHSLLGKQRKTVETVFSSLEKLGCQNFNSRSVKGLESRFESILLAYSVLLSRAQRRFEGTLRYSLGY

SEQ ID NO: 6525 - protein, 305 aa, Enterococcus faecium
  misc_feature (B) LOCATION 1...305
  hypothetical: YES
GLHMRSSKYTEHYTDTFITFKEIMRTVSNIYHNCVPDKIKNRRNTDQLKQRDTVIIACVIWGIINGYTSQRATYRAVCSVLFPNGDFPSRSRFTRLSSNLAYTIKIIRYFFIKKLTKGELVGIIDSFPSPLCKPVRNRQAKLLNQIAKVGYNSTKKSYFYGLKIHMIVTKTGFPVTYSITNPGVHDVKVLETLSEEANLPNILGDKGYISHKIHEKLALKGITISVPPRKNMDKSEKLDHSLLGKQRKTVETVFSSLEKLGCQNFNSRSVKGLESRFESILLAYSVLLSRAQRRFEGTLRYSLGY

SEQ ID NO: 6526 - protein, 66 aa, Enterococcus faecium
  misc_feature (B) LOCATION 1...66
  hypothetical: YES
GLHMRSSKYTEHYTDTFITFKEIMRTVSNIYHNCVPDKIKNRRNTDQLKHRDTLFFACRQILAQNV

SEQ ID NO: 6527 - protein, 305 aa, Enterococcus faecium; identical to SEQ ID NO: 6525
  misc_feature (B) LOCATION 1...305
  hypothetical: YES

SEQ ID NO: 6528 - protein, 125 aa, Enterococcus faecium
  misc_feature (B) LOCATION 1...125
  hypothetical: YES
GLHMRSSKYTEHYTDTFITFKEIMRTVSNIYHNCVPDKIKNRRNTDQLKQRDTVIIACVIWGIINGYTSQRTTYRAVCSVLFPNGDFPSRSRFTRLSSNLAYTIKIIRYFFIKKLTKGELFGIIY

SEQ ID NO: 6529 - protein, 305 aa, Enterococcus faecium
  misc_feature (B) LOCATION 1...305
  hypothetical: YES
GLHMRSSKYTEHYTDTFITFKEIMRTVSNIYHNCVPDKIKNRRNTDQLKQRDTVIIACVIWGIINGYTSQRATYRAVCSVLFPNGDFPSRSRFTRLSSNLAYTIKIIRYFFIKKLTKGELVGIIDSFPSPLCKPVRNRQAKLLNQIAKVGYNSTKKSYFYGLKIHMIVTKTGFPITYSITNPGVHDVKVLETLSEEANLPNILGDKGYISHKIHEKLALKGITISVPPRKNMDKSEKLDHSLLGKQRKTVETVFSSLEKLGCQNFNSRSVKGLESRFESILLAYSVLLSRAQRRFEGTLRYSLGY

SEQ ID NO: 6530 - protein, 66 aa, Enterococcus faecium
  misc_feature (B) LOCATION 1...66
  hypothetical: YES
GLHMRSSKYTEHYTDTFITYKEIMRTVSNIYHNCVPYNIKNRRNTDQLKQHDTVIIACVIWGIING

SEQ ID NO: 6531 - protein, 305 aa, Enterococcus faecium
  misc_feature (B) LOCATION 1...305
  hypothetical: YES
GLHMRSSKYTEHYTDTFITFKEIMRTVSNIYHNCVPDKIKNRRNTDQLKQRDTVIIACVIWGIINGYTSQRATYRAVCSVLFPNGDFPSRSRFTRLSSNLAYTIKIIRYFFIKKLTKGELVGIIDSFPSPLCKPVRNRQAKLLNQIAKVGYNSTKKSYFYGLKIHMIVTKTGFPITYSITNPGVHDVKVLETLSEEANLPNILGDKGYISHKIHEKLALMGITISIPPRKNMDKSEKLDHSLLGKQRKTVGTVFSSLEKLGCQNFNSRSVKGLESRFESILLAYSVLLSRAQRRFEGTLRYSLGY

SEQ ID NO: 6532 - protein, 669 aa, Enterococcus faecium
  misc_feature (B) LOCATION 1...669
  hypothetical: YES
TMIFQTNSLRLGEKEYNRKMFERKGRGKMKKRASLLVLVALLFNIFSYGVAVSAETYIPKDPGNIYNDLTGNYGLLGIASQFHVFAKNKTTVNAHTDGNIATHELDAKNNFGTELHEGLLNQEINYIQKTDSFANSSGIPTGSTRMNKFVVGSNVDVALQDGHPTVNGSRLDHLTPDDFYKDRAGHEYIDFEQEFAKLNVAANDLATITPAKTYTAADFPDMNNRTIDLTDLSDTGFLLVNIDAEVLTMNTPLQIINPNDQVVVFNVINSSSALNVQSPIKYNDRSNHETEDFSDANISWNFGNEMTDLTISAPFQGTILAPNATIRITQNQDGTIIGTNVILDAATNRWDPNEIFISDNGTDTTDTSDSTDTSTTSDSSDSSTSSDSTDTTSTTSDSTDTSASSDSTDTTSTTSDSTDTSASSDSTDTTSTTSDSTDTSASSDSTDTTSTTSDSTDTSASSDSTDTTSTTSDSTDTSASSDSTDTTSTTSDSTDTSASSDSTDTTSTTSDSTDTSASSDSTDTSTTTSDSTDTSASSDSTDTTSTTSDSSDSSTTTSDSTDTSASSDSTDTSSTTSDSSDSSTSSDSTDTSSTTSDTRHASVSFSKTSSDNRTNFNLTNKTSNDNGNKSKRALPKTGSQSNNWITLAGVILLVIGLRITFMSYKKSKR

SEQ ID NO: 6533 - protein, 89 aa, Enterococcus faecium
  misc_feature (B) LOCATION 1...89
  hypothetical: YES
QINIVKINTKRIILVISEWSAEINQKVVKNLYFVIREATNGQYYFVIKSNNNEVVATSETYLTKYSAEQTINSIKNGITEDSQVIDMTK

SEQ ID NO: 6534 - protein, 450 aa, Enterococcus faecium
  misc_feature (B) LOCATION 1...450
  hypothetical: YES
EDNIMKKFVTEQHHEQALESLSELIRIPSVLDEADSGQGHPFGKKVIEALDKVLEISEKLGFRTFKDPEGYYGYSEIGSGDELFGILCHMDVVPAGDENNWETKPFDPTIKDGWLVGRGSQDDKGPSIAAMYAVKALIDAGVEFKTRIRFIFGTDEENLWRCLEKYNEKEEGITQGFAPDAEFPLIYAEKGLLQAYLTGPGTNEFSVKAGGALNVVPDAAPYSGEKLSEVKEALKKHEFDFEEQGEGIVVLGKSIHAKDAAQGVNAISRLAIALSEVFDFGPINFLGKLVQENATGEAVVGKTEDEQSGELTMNFASLEITPEQTKIGVDMRIPVTFKKDDLVAKLTKTAEKYGLTYEEFDFLDSLYVPLDSELVKNLLGTYRDITGDMTEPFVSGGATFARTMNQCVAFGAMFPDTPDFMHQANERWELSSMYKAMEIYAEAVYRLCAK

SEQ ID NO: 6535 - protein, 135 aa, Enterococcus faecium
  misc_feature (B) LOCATION 1...135
  hypothetical: YES
MLNIISTNKAPNFQYTDEMDRFLMNTLAFSVGLVTEDYSTFDPEVLKIMEEEPDWLQESVAWCQSLVVGSLVDSGNYDDTGELMDEFNCLLNLYDRARQRELTSNEDNLFLNIHDKFLALLLTDDELITNLLEVE

SEQ ID NO: 6536 - protein, 228 aa, Enterococcus faecium
  misc_feature (B) LOCATION 1...228
  hypothetical: YES
MSNILIIEDEKNLARFVELELKHEGYNAEVHYNGRTGLDAALNNEWDAILLDLMLPELNGLEVCRRVRQVKNTPIIMMTARDSVIDRVSGLDHGADDYIVKPFAIEELLARLRALLRRIDIEGDKNVAKQTTITYRDLTIEKENRVVRRGNEVIELTKREYELLLTLMENVNVVLARDVLLNKVWGYETEVETNVVDVYIRYLRNKIDVPGEESYIQTVRGTGYVMRS

SEQ ID NO: 6537 - protein, 206 aa, Enterococcus faecium
  misc_feature (B) LOCATION 1...206
  hypothetical: YES
VLNMLVGYARVSSDDQNLERQLEEFRKIGVEKVFAEKKSGRNTVERPEFNKMLSFVREGDTLVFESLERLGRNSDEILETVSFIDKNGMGLMVLNLPILDTKFGDPNLEKLVRSLVINIFSWTAQNEREEIKRKQKQGIAIAKKKGVYKGKPYEYSSTAKNPQKRFIYNEIVRMLGEGVPIKRIAEKTGTNRNLVYRIKKRISESD

SEQ ID NO: 6538 - protein, 788 aa, Enterococcus faecium
  misc_feature (B) LOCATION 1...788
  hypothetical: YES
GINMTKETIKEKILFFMESSRKRSFSMEEIAEGLGFQKSDDFKLLVQTIAQMEREQSIVFNKKGKVKLPLKPILIEGTFRANERGFGFVTIDPEEDDIYIPKETTGFAMDGDTVAIDIMKRANTDMDRGAEGKVVEIRDRATTQLAGEFVAYSEEEIQETDLYGVVIPKDRKLNQFKVYAAAEGVRPVDGSIVLIELTHYPEKGYATSLEGIIKQVIGHKNDPGMDILSIVVANGIPTKFPDDVLSEADEVPDQISEKDITGRRDLRNQLIVTIDGEDAKDLDDAVTVKKLDNGNYFLGVHIADVSYYVTQGSQLDREAYERGTSVYLTDRVIPMIPQRLSNGICSLNPHVPRLTMSCEMEIDPNGQVVSHDIFPSVIQTTERMTYTAVNQILEDQDEETMQRYAQLVPMFQEMGELHRILETMRIKRGAISFEDREAKILVDAEGHPNDIQLRSRGIGERLIESFMLAANETVAEHYNKLNLPFIYRIHEQPKEEKMQRFFDFASALGILVRGTKGTITPKDLQHVIEGVEDKPEAAVINTMLLRSMQQARYSEDNFGHYGLAADYYTHFTSPIRRYPDLIVHRLIRSYSEDKSESNQSSWATELPEIADHSSKMERRAVETEREVDSMKKAEFMMDKVGEEFDGIISSVVKFGLFIELPNTVEGLIHINELKQDYFHFVENHLALVGERTGLTFKIGQKVRVKVVKADPDERAVDFELVSAEEVTALERPKTRNGKSGKREGKQAGKRPERNGKKNKRYSDSKQTFGKKKGKKPFYKGVKKKKKKK

SEQ ID NO: 6539 - protein, 335 aa, Enterococcus faecium
  misc_feature (B) LOCATION 1...335
  hypothetical: YES
MANIAELFSQRNVLDYVNNRQAPPLLGETLFPARKVQGLEFDILKAGTRIPTIASVHAFDTEAEIASRVASRSAQELAFIKRKIQLKEKDLIALRNPRTAEEQAFLENEVYNDVFSMVSSVNARVEKMRMEVLANGTVTLDENGLDLVVDYGVPSEHKATVDFAASSTDVIGLLTTWAGTLDTTPTRILTSTKVRNAILQNAGIKAYFKDAGLLPTAGTLNQLLQQFGLPIIATYDAKYYKENAQGVLVKERYFPENKLVMFGDENPGESIFGVTPEESRLLSGGTNDYQVGNIFAMVYESNLDPVGTWTKASGTALPSFPEADNVFQATVLAEG

SEQ ID NO: 6540 - protein, 107 aa, Enterococcus faecium
  misc_feature (B) LOCATION 1...107
  hypothetical: YES
NKNIPANLESFPSFGIIIPEILLRGVVREVKTTMKDVAALAGVGVGTVSRVINGVKVKEVTKEKVMAAISELNYEPDEYARGMKTNSSNTIAVILHTMWHPFFSEFA

SEQ ID NO: 6541 - protein, 117 aa, Enterococcus faecium
  misc_feature (B) LOCATION 1...117
  hypothetical: YES
QKNMICRFGATLNEKMKFVMSIILTLVLMFLGRKLMXXKRQINTSVEEYLASLLMILREDKTIEVMCHAAYLDLQELLNGSSFVYPRTHQVEFLIHSAFAQKVKNDPLIELVTYEDI

SEQ ID NO: 6542 - protein, 325 aa, Enterococcus faecium
  misc_feature (B) LOCATION 1...325
  hypothetical: YES
RRNIIQERGNKMDFFTNPDILLGDKLLEILYIVMGLVLIYTGVRNLTNKTNPHRYGSAFFWTVLGVVIAGGRWLPAIVNGGLIFAMTIPAIAKKVSKGESRLPSKEYMEKMSDKLGMKIFIPALSIGVFAILFALFTNLGALXGVGVGVFAAMLILMFFSRDNRPSTFLDDAADMLGTVGPLSMLPMLLASLGAVFTSAGVGTVISNAVGTIVPEGNVNIGIIIYALGMVIFTVIMGNAFAAITVMTVGIGAPFVFSHGANPALIGMVALTCGFCGTLLTPMAANFNIVPVAMLEMKDKYGVIKNQLFIALFMLVFQIAYMILFK

SEQ ID NO: 6543 - protein, 71 aa, Enterococcus faecium
  misc_feature (B) LOCATION 1...71
  hypothetical: YES
GGNIVMPKQKTHRGSAKRFKRTGKGGLKRFRAFTSHRFHGKTKKQRRQLRKASMVSNGDFKRIRQQLAKMK

SEQ ID NO: 6544 - protein, 81 aa, Enterococcus faecium
  misc_feature (B) LOCATION 1...81
  hypothetical: YES
TMNMWNPKSIESPQSWIEYVAEMLLQVACSMGFYPICLRKKSLILLRAASALKHTIHGDCNQFSQDEVAQFLACGSGKIIR

SEQ ID NO: 6545 - protein, 199 aa, Enterococcus faecium
  misc_feature (B) LOCATION 1...199
  hypothetical: YES
IMNIAASRKLINFISIIGLGLSIALTIYFINLGVFKDLNALRGLVGDSIILGPVIFIFIQILQVVIPIIPGGISTAAGVLIFGPYAGFIYNYVGICIGSIIIFLLGRRYGKPFILSMISDKTYNKYIGWLDNQNRFEKLFALAIFLPVAPDDALCLMAGLTNISMKRYTLIILIAKPLSIFLYSMALIYGGQYLSGLLG

SEQ ID NO: 6546 - protein, 301 aa, Enterococcus faecium
  misc_feature (B) LOCATION 1...301
  hypothetical: YES
AMNIQQMKYVVAVANNGSFREAAKKMFVSQPSLSAGIKELETELGITLFTRTNRGAYLTEEGQDFLNRAEKILVQLDTLETHYLTSEKRDNFSIAAQHYDFLGPLTAQLLEEFKDEIKQFRIMETTTARVIEEVKEQHSEIGIIYMNEHNQAGIRRYLQQGELSGRSIGKFKTHIFLRQGHPLAEHAEITKEELLSYPQVRFTQDGNNFPYFYEDLIEIPDQETVIYTSDRGTLMNIVLETDAYASGSGIVIGGIREHLRLIPLAEGELNEFYIIYSAKRPLSEIAQRFIKELTRLLDQQS

SEQ ID NO: 6547 - protein, 314 aa, Enterococcus faecium
  misc_feature (B) LOCATION 1...314
  hypothetical: YES
RMNIIKIRHPYQSEQIPEDDVVLVLGFFDGVHIGHQKVIKTGMEIAQKEGLKLALMTFNQHPSIVFKKIDPSSVKYLTSLKQKEEKMAALGIDYLYEVDFTSSFAHLAPQEFVDQYIVGLHAKYAVSGFDYTYGPKDIADVAHFPEYAKGRFKIVTVSKEEEQGEKISSTRIRGLLDSGQVKEAAKLLGCTYEVEGVVVHGDARGRLLGFPTANVKVKSTVHLPKEGVYVSEIKIGETWYPAMGSIGHNDTFGEGRELTVELYILDFNQDIYGEHVAVRWNQFLRDQVKFSSVEELIEQLKEDEQATAEYFSQQ

SEQ ID NO: 6548 - protein, 164 aa, Enterococcus faecium
  misc_feature (B) LOCATION 1...164
  hypothetical: YES
TKNIHVLIWSWMDERKIPKEMGDKIRRGIVEEVLNFNFGEHGQYIVDIAISLLNDDRRRFMLIVPNQGAIPNLRSDAVVEIPAYVGATGVEPITLRKPISDFHKGLMEAQVAVEKLLVDAYFEGSYQKALQAFTLNQTVPNARVAKKILDEMIKVNKKYWPALK

SEQ ID NO: 6549 - protein, 534 aa, Enterococcus faecium
  misc_feature (B) LOCATION 1...534
  hypothetical: YES
KGNMMNKSPAVILTCQFTLPNKKSFSTYIDYMTREKALEEMERRTPEEEQELQRIKNALEDFYIPEGETFSESKTDKEFSETSNEAQSLMGNGINFDKLEEQDFTKYLSYMTRHYALEQKKELTQSEQKEYQRLNQAIKKYQTEPHKKASGNLPGVFSMASDEVKGSDLKEIKQIFQRGQQKGSIIYQDVVSHDNSYLEKIGLYDPKTDTLDEEGLKAAGRKMMETLFEKEQLNETGYWMATIHRNTKHIHIHFAVVEKENTRKPYTEVENGVSYIVPKGKRRQATLDAMKTNYVHELERFSYEKDRMIGMEKRNLLTRKSDLRNTLTKVVKEPARYDRHAMNLLNEVYKTLPDKRSEWHYGDEKRTKLSPYTREKLDELTKYVLTKEPEYQEYIQISKALKEEAKSLYGESKRESKDAEKNALFDLKKRTGNAILTELKKQDSQIKPLIESMDQMQSIYNERSFRTLKQLPTNEYKYSYEEFMKRRKQFQQRVVTQRSLRQLNRTINAHEEKYHASKAYEEQQRRIQIEQERQ

SEQ ID NO: 6550 - protein, 368 aa, Enterococcus faecium
  misc_feature (B) LOCATION 1...368
  hypothetical: YES
MFDILIKNGRLVDGSKIEVAIEKGMIKAVAAEINQPAQEVVDLEGKYYLSAGWIDDHVHCYEKMNLYYDYPDQIGVEKGVTTVIDAGTTGAENIREFYQLTKSVKTNVYALMNISKWGIVKQDELADLTKIQEDLVSTALAELPEFIVGIKARMSKTVVGENGIKPLELAKKIQTENNDLPLMVHIGSAPPELEEVLSRMERGDVLTHCFNGKPNGILDPKTDQIKNFVWDAYNNGVVFDIGHGTDSFNFHVAETALKAGMKATSISTDIYIRNRTNGPVFDLATTLEKLRVVGYSWEEIIEKVTAVPARNFHLKNKGQLAVNYDADLTIFEIVENEKELKDSNGFTRIAKEQILPIKTIIGGVIYDN

SEQ ID NO: 6551 - protein, 142 aa, Enterococcus faecium
  misc_feature (B) LOCATION 1...142
  hypothetical: YES
TNDILRGGTEMTIFETVVTDVGIEAEVFRKEKIMILFGDEAPETLTDYCYKIELNQVRKEITCDMKLCFDKQMYVITAVGDVVQTNLNELGHITIKFDGSHEPELPGTMYVEDKEMPHLRKGTIIKIDQEDQNGGKLYGNHA

SEQ ID NO: 6552 - protein, 90 aa, Enterococcus faecium
  misc_feature (B) LOCATION 1...90
  hypothetical: YES
GNDMIDFRTVMDKLSNGDFRVLIELYLNVTSTVKEFLYSNPKTALVLVAVLIVFAVISFIKKMIPLLIIGAVLILGLYFPEVLDQIKNIF

SEQ ID NO: 6553 - protein, 237 aa, Enterococcus faecium
  misc_feature (B) LOCATION 1...237
  hypothetical: YES
MNDMVLTIPEIILRLGIAMLFGGAIGFERQYKNRPAGMRTHILVCMGACIIALIQVEIASGALRDALEYPQLAGTIRSDEARLIAQVVSGVGFLGAGTIIVTKQSVTGLTTAASLWAIAGLGIAIGMGYYSIAIISFIGIAIALTVVKRVIHVPTTKKLEIQFIHRKETKDFLTDYFEEKNIVIEDVNFDVKFVDDYRVYKNIYTIDLPKGLTYADVIEELSVHKNITKLHLVSIAQ

SEQ ID NO: 6554 - protein, 722 aa, Enterococcus faecium
  misc_feature (B) LOCATION 1...722
  hypothetical: YES
RNDIIEVKHTPRKDYAPEGEKRVELHVHSNMSRMDATNSISDLVAQAGKWGHRAIAITDHGGAQAFPEAHSAGKKAGVKILYGVEANVVDDGVPIAYNDAHEALSEATYVVFDVETTGLSAVYDTIIELAAVKMYKGNVIESFDEFIDPGHPLSRTTVDLTGITDGMVRGSKSEEEVLRMFLEFSKDTILVAHNAAFDMGFLNTSYARYGIPEAANPVIDTLELARYLYPQFKRFGLGVLSKKFGVSLEQHHRAIYDAEATGHLAWIFVKEAMDNHNMLYHDQLNEHIGEGDSYKRARPFHVTILAKNQAGLKDLFKLISMSNVEYFERVPRIPRSQLKKMRENLLIGSACDKGEIFEAMMQKGVEEARNRAKFYDYIEVMPKAVYAPLIEQELVKNEHDLEEIIQNLVEIGKSLDKIVVATGNVHYLNEEDAIYRKILINSMGGANPLNRHSLPDVHFRTTDEMLTAFHFLGEETAKEIVVENTNKIADICEEVIPVKDELYTPKIPGSEDEISELSYTKAKQMYGDPLPEIIQKRLKKELNSINGNGFSVIYLIAQKLVHKSNEDGYLVGSRGSVGSSFVATMTGITEVNPLAPHYYCPECQYSEFFEDGTYGSGFDMPEKQCPKCGARLNKDGHDIPFETFLGFHGDKVPDIDLNFSGDYQAEAHNYTEVLFGEDYVYRAGTIGTVADKTAYGYVKGYERDNNLQFRSAEVDKLAKGAT

SEQ ID NO: 6555 - protein, 175 aa, Enterococcus faecium
  misc_feature (B) LOCATION 1...175
  hypothetical: YES
NDDMNVGGKKMLVIIDMQNHILDPNSEFYIPESDQLAERIAQRLAKARQNNEYILFTRDIPVELKDKEEEREDLQLIPLLSPQENERVIKKYYFTIPPETLAEIQETLFESKEEQKEIEVVGIETNLCVLSNLIGLQSAFPEADFFVDPMLVSSRKHGESALELLKDFNVSIVES

SEQ ID NO: 6556 - protein, 89 aa, Enterococcus faecium
  misc_feature (B) LOCATION 1...89
  hypothetical: YES
RDDIFWEGGCDMYNLILGIVIVLSIVMVIAIMMQPSKQNSAASAFTGGADQLFGKQKARGFEAVMQRSTAVMGAIWMILLFVLAYLSSK

SEQ ID NO: 6557 - protein, 269 aa, Enterococcus faecium
  misc_feature (B) LOCATION 1...269
  hypothetical: YES
GKDIHASTAMRVFGIEKAEDVTPNMRRQAKAVNFGIVYGISDYGLSQNLGISRKAAQQYIDTYFEKYPGVKEYMERIVREAKDQGYVETLYHRRRYLPDINSRNYNIRSFAERTAINTPIQGSAADILKIAMIELDKRLKETGLQAWLSVFAPEIIFFMEVPVTLKMLYRHRKRWAKGGTEVWLTNFKKVMLHPFKHIGRTIIFIDQTLSIVWSIFFCISVILFAGLIGHYVYQGNYEQIYITFTFSFVCIWLEMVPRIFQLLPSLIGG

SEQ ID NO: 6558 - protein, 214 aa, Enterococcus faecium
  misc_feature (B) LOCATION 1...214
  hypothetical: YES
FGDIMEIQRRTTNFLHLGSFFATLTILFFLCYSYLKTSHAPSSALGWLLLDHSDITEAEENPFFLILSSLCGLLFSVYFGAYFFHRHPGTLNEASSVLIAFKTFSFLAILFYSFNHNTLFFFIMNGLVVILSIFTYFIFSLIFSQLKCPLFFRLVPVTCFIYSLFSFFVLALMPLTNPSTIQVAGNLLDMLFIVSLGVFMWQRKNKQNKKHFEA

SEQ ID NO: 6559 - protein, 512 aa, Enterococcus faecium
  misc_feature (B) LOCATION 1...512
  hypothetical: YES
VVDMLDKETKQNLEQYLALIESPIVFSVSLDNSENSQKLAEFTKEIAEMSPKISWEKRDSMRTPSFSINPVGKESGIVFAGIPLGHEFSSFLLAMLQISGRAPKISESLSLKIKKITQTLHFDSYVSLTCHNCPDVVQALNILAVLNPNITHTMIEGGMFQKEIDDKKIMAVPTVFLNGEEFSSGRMTIEQIVEKITGPLIEEELFEKEPYDVLVIGGGPAASSAAIYAARKGIRTGLVADSFGGQVVETLGIENMIGTSYTEGPKLMQQVESHVRSYPIDIMMNQQAVSLNKEQHFINIGLANGISLKAKTAIIATGAHWRSINVPGEKEFKNKGIAYCPHCDGPLFKGKEIAVIGGGNSGVEAAIDLAGLAKHVYVLEFLPELKADQILQDKLVSLANVTVIKHAATKEISGTNQVESLSYIDRRTMEMHTLAVSGVFILVGLLPNTDWLDRTIEMNPRNEIVTEKNGATNIPGVFAAGDCTDSPYKQIIVSMGSGATAALGAFDYLMRT

SEQ ID NO: 6560 - protein, 172 aa, Enterococcus faecium
  misc_feature (B) LOCATION 1...172
  hypothetical: YES
GEDMKKVTREEVASILVKDKYFSKGNYWLKIWQTLVALLGWMIVVLPFIWVFFPLTRPERAKDFSLYAFLSEKKMLYFLIGFFVLIFFSFLITSFVLTRWNNRNLYKKVNKSFEYEDEKLKKRQELLEEVYTERFGTKEERETVRFYSVSEEKNLDTTFIADLYKENGVELK

SEQ ID NO: 6561 - protein, 267 aa, Enterococcus faecium
  misc_feature (B) LOCATION 1...267
  hypothetical: YES
MGDILMARILSVANQKGGVSKTTTSVNLAACLKFVYGKNVLLVDIDPQGNATDNVGFDIDGTNQPTIYEVLKGEADITDAILDYKGIDVLPADIALSSAEREFTQVGSEHRLKRVLQPIKDNYDYIIIDCPPSLGMLTVNAFTVSDEIIIPVEAAYFSLKGLIKLSETIETVKEYTNDKLEVRGVLFTKYNKRYNISKEMTSAATEISRVIGAKIFKTYIRRTITVDEAQAAGSDLINFNKPSTAEDDYKAFTEEYLKEVGDFDGRR

SEQ ID NO: 6562 - protein, 527 aa, Enterococcus faecium
  misc_feature (B) LOCATION 1...527
  hypothetical: YES
FICITIKIFKEELLSITNFRRKSMEIKTIIEAIDDWGINEPDRVAYQADETHTFGELKQASDALAYYLEKKVEGDGPIVVFGNLEFEMIVSFLGVVKSGHAYLPIEEHTPKERILSIFRVAKPSMVISIGDWIEDIPSVPVITKKEFQEIKKIPVGFYPRNSVKGTENFYIIFTSGTTGEPKGVQISHDNLVSFVQWTMEDFGIKPGMHFLAQAPFSFDLSVFSIYPALVSGGMLKPLNKAVVQDFRQLFATLPALKLNVWVSTPSFMDICLMEPTFNGENVPELDMFLFCGEELTKKTAESLLDRFPNARIYNTYGPTEATVAISSIQIDQHVLDSYDRLPIGYVKKDTKVSIVQEGKPVSKGETGEIIIAGPSVSKGYLNNPEKTAAAFFCQNDLASYHTGDAGRLDEDGLLFYEGRMDQQVKLHGYRIELGDIEHYLLQDNRIKQAVVVPKYQGTKVQQLVAFVVLENKTKQPDFQLTKSIKEQLLEVVMDYMIPQKFHYVDLLPQTVNGKINRKKLTAEVNPE

SEQ ID NO: 6563 - protein, 408 aa, Enterococcus faecium
  misc_feature (B) LOCATION 1...408
  hypothetical: YES
GECITYMEKKLFNKYFIGITLINFIVYLIYYLLMVIMAVIAQDTLHASLSQAGFASGIYIIGTLLARLFMGKQLELFGRKFTLRGGAIFYLLSTLAYLYTPTIGALYLVRFLNGFGYGTVSTATNAIVTAYIPASKKGEGINYYGLSTSLAAAVGPFLGMILLNMTDFRFIIWFSIVLVFFVTIACLVFPVKNIPLSEEQKISLRSWNINSFIEKKALFITGIAFLMGLSYSSVLSFLSSYTKVIHLVAAGSFFFVVYALVITFTRPLTGRIFDVKGEQYVMYPSYLFLTAGLFLLSVTTNSVTLLISGALVGLGYGTFMSNGQAVCLKIVREHRISIALSTYFIGLDLGLGVGPYLMGMLKSLTSFRGLYVIAGVIPLICTALYLVNGRKHSHEAEGELIESLKNEI

SEQ ID NO: 6564 - protein, 178 aa, Enterococcus faecium
  misc_feature (B) LOCATION 1...178
  hypothetical: YES
DRCMVNIYMYIRRVPMAKDASFDIVSEVNTEEVKNAIQQTTKELSNRFDFKDSTVEIKLENSNLVVLSDDDFKIEQIKDVLFGKLIKRNVPIKNIHFSESEHALGGKARQTADLVNGIDRENAKKITTAIKNEKLKVKAQIQEDQIRVTGKNRDDLQAVIALLRKLDLPIELQFTNYR

SEQ ID NO: 6565 - protein, 85 aa, Enterococcus faecium
  misc_feature (B) LOCATION 1...85
  hypothetical: YES
QRCIDSFILIVPKIVEYDQKEMKIKIEILTVINRMRILIKYEKDMICFLRLTENSFLAENRIVTNQIAPFFYFGRNTDAAQRYRV

SEQ ID NO: 6566 - protein, 71 aa, Enterococcus faecium
  misc_feature (B) LOCATION 1...71
  hypothetical: YES
YPRIYGSKKRKSERVDSRVREENDILDMISQKKNSHLVMDNKSSKMRVFCPKKSCTNIFWHSSNRGQFMEV

SEQ ID NO: 6567 - protein, 178 aa, Enterococcus faecium
  misc_feature (B) LOCATION 1...178
  hypothetical: YES
VSRIGNKVVVIPEGVTVTQDGNNVTVKGPKGELTRTFSADIKMNIEGNEVTFTRPNDSKEMKTIHGTTRANFNNMVVGVSEGFQKALELIGVGYRAQLQGSKLVLNVGYSHPVEITPPAGVTVEVPANTQVIVKGANKEEVGELAANIRGTRPPEPYKGKGIRYVGEYVRRKEGKTGK

SEQ ID NO: 6568 - protein, 194 aa, Enterococcus faecium
  misc_feature (B) LOCATION 1...194
  hypothetical: YES
AQSITQVRMTQNLKVQKEEKLRSQLALTVGRSKQTVETEALKKAILAGQDFTRSPIVQGGTTADHPLIEDTYIEVDLENQHMWYYKDGKVALETDIVSGKPTTPTPAGVFYVWNKEEDATLKGTNDDGTPYESPVNYWMPIDWTGVGIHDSDWQPEYGGDLWKTRGSHGCINTPPSVMKELFGMVEKGTPVLVF

SEQ ID NO: 6569 - protein, 390 aa, Enterococcus faecium
  misc_feature (B) LOCATION 1...390
  hypothetical: YES
NRSIKGPWRRCMQSRFKQSKLFFWTVELVLTIIGVYFILQMPNIFSPILKMLSAIFLPLLVAGFIYYMFDPIVVFLEKHRIPRVFGFLLTFLVVIILVVLTVMNVVPQLMEQTIQLTQSLPMYADETSKWLNELAQREEFKNFNLEEQLASANLSLSNLFNIILVSLSASVSKIISFMMQFFILLFTVPFILLFMFKDGHKFIDALSHFFPKAIRKELRQTVKELNETLSAYISSTILDALIIGVMSFLAMRIFDQPYSLLLAVICGITNIIPYVGPFIGAVPAIIVGLFISPFQALYMALSILVIQQLDGNLIKPLLFGKSMNIHPLTIILVLIGAGSVAGILGMLICIPVYAVIKTIILNIRKIYLLRRMEHVSEKLDSPKVLEETSE

SEQ ID NO: 6570 - protein, 202 aa, Enterococcus faecium
  misc_feature (B) LOCATION 1...202
  hypothetical: YES
EQSIMQTFPLNYFSALRTPTQVFAGRKLLSWPKFFLIFVFLVSLMVMPVTLFYANQIQAIPLEQFLSVHSLIDEQGTQKFSELELSETGLQASQQTIAVTPEILVGVSLSEKQQSDHGTFIDFEKEQWVIQQKDKSGIRRYTMNYSPSFQPDSVRTPEDFQRFLEREFYASNRPTIILSYSLSLGLVLFVMTSLILFGVPFS

SEQ ID NO: 6571 - protein, 129 aa, Enterococcus faecium
  misc_feature (B) LOCATION 1...129
  hypothetical: YES
KKSMINKNRVKECRTMSEANQERSGQEIELIKERILAALEMVIDPELGIDIVNLGLIYDIEFNPENGETVIKMTLTTMGCPLADILTESIHDALKEVPEVTKAEVKLVWYPAWTTDKMSRYARIALGIR

SEQ ID NO: 6572 - protein, 65 aa, Enterococcus faecium
  misc_feature (B) LOCATION 1...65
  hypothetical: YES
RWSIIDAKIVLPRSAAREESMYANIVVEDVMEKSNGLRQKEKTLMKHKKSDERIEGLWKKVSRGI

SEQ ID NO: 6573 - protein, 105 aa, Enterococcus faecium
  misc_feature (B) LOCATION 1...105
  hypothetical: YES
IRSIRPAGMRPFFEASAPSENRRAHPGIPLPGLSPFFHSAPRIVPGHLTAGGIPFLPRQHPSRGGLSCWHRWGRNIGTYINSEQAAFFQIPADMPFPRGSNNEPV

SEQ ID NO: 6574 - protein, 425 aa, Enterococcus faecium
  misc_feature (B) LOCATION 1...425
  hypothetical: YES
GVGIVFGGLLQLIFGVDDKVVTQSMEWIGIVGQGYVSFLQMLVMPLVFISIIGAFTKMKVFEKLGKISATVLTSLLGTTAIAALIGIGSTMLFGLQGAKLTQGAAETARISELATRQETVENLSIPQQILSFIPKNVFADLAGSRATSTIGVVIFAAFVGIAYLGVKRKAPKEAAFFSDLVDSLYKIIMRIVTLVLRLTPYGVFALMTNVLATSDFAAIVNLGKFVVASYVALLAVLIVHSLILIGAKVNPINYFKKAFPVWSSAFTSRSSAGALPLNIETQTKALGVDDATANFSASFGLSIGQNGCAGVYPAMLATIVAPAAGVNVFSLEFILMLVAIVTISSFGVTGVGGGATFASLIVLGAMNLPAAIVGLVISVEPLIDMARTAVNVSGSMVAGIVTSARIKDLDRDVINDDSKVIDVNA

SEQ ID NO: 6575 - protein, 195 aa, Enterococcus faecium
  misc_feature (B) LOCATION 1...195
  hypothetical: YES
FYGILLLLTDKGENILNTLIAKDVFRLPEMNARLLSTSALLLALDVILYKIAIGPAYFQITFGFLSMALMGYLYGPIWAGLLEMLSNTLNFTIFGSGTFQAAFLITAFLGGFINGLFLYHKKINLPSVIAAQLLIMIPVSLFINSWLMSVLFGADFKVIFLGRFIRNMIQIPIQIMVVYSFIKTLEARKVFKRAV

SEQ ID NO: 6576 - protein, 64 aa, Enterococcus faecium
  misc_feature (B) LOCATION 1...64
  hypothetical: YES
SNGMKILMYVLKYKWMGDKFDFVENPEDAKKVIRQIQEKLAELEGKPAGKYFTDNQHAKGQELG

SEQ ID NO: 6577 - protein, 631 aa, Enterococcus faecium
  misc_feature (B) LOCATION 1...631
  hypothetical: YES
MCGIVGFVNDKDNKKTIINTMMDRIVHRGPNSSGEYIDKHVALGFRRLSIIDLEGGTQPIYNEDRTKIIIFNGEIYNYQPLREELITAGHVFQTHADTEVLLHGYEEWGTELLQKIRGMFAFAIWDNEKNELFGARDHFGIKPYYYAEMNGTFMFGSEIKSFLPHPDFNKELNKEALKPYMTFQYSPLNGETFFKGVYRLPEGHYYTYKDGKLDIQQYWDADFETKETHSRQEWIEKIDETVQASIEAHTISDVEVGSFLSSGVDSSYVTSVLKPDHSFSIGFDDKTYNEAIEARKLTELLDLDNTAAVIDGDMSFKAFPLIQYHLDEPDSNPSCVPLYFLANLASQSVRVVQSGEGADELFAGYQTYGFHTNSKFIRVIAQGLKKLPKGTRYNLGRKIGKMKNFHGRIHLYESLAPAKEYFIGHARVFEESEASEVLTPKYQTAPSVNEIMTVHYEKTEGIKDEVNKMQYVDLHQWMPKDILLKADKLSMASSLEVRVPLLDIEVMKLAQQIPSKFLLNQNNTKDIFRQAANKHLPEEWSNRVKLGFPVPIKAWLKEEHGYEQVKALFEADFAKEFFDQEKIMKLLDDHHEGRKEEQRKIWTIFSFLTWYKVYFVDETIPQAEAIDYVTV

SEQ ID NO: 6578 - protein, 158 aa, Enterococcus faecium
  misc_feature (B) LOCATION 1...158
  hypothetical: YES
PTGITLPVFLFFAATGKLQIDYRESTDTLAIITIVPATNRSFIAKEAFNQMEKSNYHSNVNHHKRHMKQSGEKRAFLWAFIISFTVCTLFLGWRLVSVLEATQLPPIPATHTGSGTGVAENPEENTLATAKEQGDEQEWSLILVNRQNPHPRPVRCGT

SEQ ID NO: 6579 - protein, 67 aa, Enterococcus faecium
  misc_feature (B) LOCATION 1...67
  hypothetical: YES
NQGIIGNPSLNHRYCKGFYSLFKTLQQNQHVYHTISSIFSFTSIHSQVESTHHLTFYARLASFLVGI

SEQ ID NO: 6580 - protein, 119 aa, Enterococcus faecium
  misc_feature (B) LOCATION 1...119
  hypothetical: YES
NQGIIGNPSLNHRYRKGFYSLFKTLQQNRHYHLHLAGRGYQHKDMDFKYLLKKTGGLRYAPALTKKQIKMEYYRCQDCSATICRKRRIDVRKYRCGRCHGEIKWIETKREDFNEAQKIR

SEQ ID NO: 6581 - protein, 151 aa, Enterococcus faecium
  misc_feature (B) LOCATION 1...151
  hypothetical: YES
NQGIIGNPSLNHRYRKGFYSLFKTLQQNHISNEDGGEIAFEGLEDGDYLLMETKALPGYQLPSGYWIISVNNSEELPVDKIAIQGYGTHAPPAFYRDSRSALHLPNFNQYTLPAAGGKGMIASIILGIMVMGCGVLYYLHPKTRRKSSQSN

SEQ ID NO: 6582 - protein, 82 aa, Enterococcus faecium
  misc_feature (B) LOCATION 1...82
  hypothetical: YES
NQGIIGNPSLNHRYRKGLYSLFKTLQQNLFILQKHSKLHLLQFHRVCWRWLLHLFFHHEQMHLKPHLHFQQVVDPFVVNTTQ

SEQ ID NO: 6583 - protein, 237 aa, Enterococcus faecium
  misc_feature (B) LOCATION 1...237
  hypothetical: YES
KQGIIKKIGGERMSAKQNEQQNVEHKTEIAKKKSSAEQETTVTEELTAALEEIVEEPKAEKVKGELVTLLDDSNFLIGERHYRLVSDYREGFNAEKLGERYSDVLARYDYIVGDWGYEQLRLKGFFQADNRRAHPDQRIDSLEDYLYEYCNFGCAYFVIERIGGKKEKTTQRRKKKKNHNRAYIDEKKGPVASNRKKPVIKNRKTESAKTSEKVKKQEQPKQVEKTKTAFTIRKREE

SEQ ID NO: 6584 - protein, 204 aa, Enterococcus faecium
  misc_feature (B) LOCATION 1...204
  hypothetical: YES
QEGMKGAFLMSKRVIILNFQVESQAYQAFSEIKKLHAVRSIKGEQMAVVSHDPNGTHQFKIEDFIDFTGNNKSSTGGLIGMLVGVLGGPLGILLGWFAGGMIGATQDAKEIKDAQTVFDFVGNKIGEGATGLILIADEEDNRPLNQLVMMELGGEITRLDYEDVEKDVHDAKEAENHAKEAAQKTWKDKHPQTSNDNESSGSSN

SEQ ID NO: 6585 - protein, 305 aa, Enterococcus faecium
  misc_feature (B) LOCATION 1...305
  hypothetical: YES
EEGIYMLLREKIKEISFSPSENEVIQFLLSDSPALGEMTIQAIAERCYVHPCTLIRVAKKMGFDGWVSFRNAFLAETAYLEGNFQDVDANLPFSTTDGIMTIANKMASLEQMTIHDTLSLIHHDQLQKAKQLMLQAKKIVIFASNSNTLISQDFMLKMKRIKMDVTIVTTFGESFYEAYNCTSDMCGILISYTGENNVILRTAEILKQNHVPILALTSIGDSTLSAMSTAALRLTTRERLYSKIGNFTINTSICYLLDVLYSCVFAENYQQNLVHLISVGQKFDKRPISSAIMKEPFNFENKEVE

SEQ ID NO: 6586 - protein, 334 aa, Enterococcus faecium
  misc_feature (B) LOCATION 1...334
  hypothetical: YES
IGGINMVGIILASHGQFAEGILQSGSMIFGEQENVKAVILKPSEGPDDLRAKLEEAVASFDNQDEVLFLVDLWGGTPFNQSNTLFEEHKDKWAIVSGLNLPMLIEAYASRFSMESAHEIAAHIIETAKDGVKVKPEELEPAEAPKAAVEDAQPKGALPEGTVVGDGKIKYVLARVDSRLLHGQVATAWTKAVQPNRIIVVSDAVSKDDLRKRLIEQAAPPGVKANVIPISKMIEVAKDPRFGNTKALLLFENPEDVLTAVEGGVDIKELNVGSMAHSVGKVVVSKVLSMGQEDVEAFEKLEQKGVKFDVRKVPNDSRDNMDDILKKAKAELAKA

SEQ ID NO: 6587 - protein, 592 aa, Enterococcus faecium
  misc_feature (B) LOCATION 1...592
  hypothetical: YES
KFILGGTPLETTLRKYIEVASKKKPADLVIKHAKIVNVFTKEIMEKDVAICEGMIVGIGEYEGKSVHNANGQYLVPGFIDGHVHIESSLLSPSEFSKVSLLHGVTTVVTDPHEIGNIAGSTGLEFMIEDARQTLMNIFFMLPSCVPVTPFETNGANLNAKKLAPFLQKPEVLGLAEVMNYQAVANNETDILEKIQLMHQHKKKIDGHAAGIGMEELNVYPAAGIRTDHEATTAKEAKERLDLGMYLMVREGTVAKDLASLLPAITPENSRRCFFVTDDKLINDLVKEGSIDHIVRQAIALGIDPLQAIQMATLNAAECFDLKTLGAIAPGYQADFFLTDDLTKLPIHEVFYKGTLVVQSGQLQDHLFADHSNSYTCCLPKLNAQPLNPHSLELLLSSSQAHVIEIIPNSLVTKDLVEKVDRQGERFIPSIEKDQLKIAVIERHHQTGNIGLGIVKGFQLKQGAIATTIAHDSHNLVVVGTNDEDMLYAANLLIQKGGGMTVVNKQQEIACVSLPIGGIMTQEPFSIVYEQLNELITKAHQLGAAKTFDPFLTLSFLTLSVIPELKITDKGLFSFSRFQLIPPCGKTDEINTF

SEQ ID NO: 6588 - protein, 62 aa, Enterococcus faecium
  misc_feature (B) LOCATION 1...62
  hypothetical: YES
LSILFYVGDIAFYDDQFCMVCIFDHVFHADHQLPDCLFFNKTEAQAIMADADYFAYMGESAA

SEQ ID NO: 6589 - protein, 140 aa, Enterococcus faecium
  misc_feature (B) LOCATION 1...140
  hypothetical: YES
HEIFLYRLNAKSERRIHNVIQAESRLKVADNSGAREILTIKVLGGSGRKTANIGDVIVATVKQATPGGVVKKGDVVKAVIVRTKSGARRTDGSYIKFDENAAVIIRDDKSPRGTRIFGPVARELRENNFMKIVSLAPEVL

SEQ ID NO: 6590 - protein, 365 aa, Enterococcus faecium
  misc_feature (B) LOCATION 1...365
  hypothetical: YES
REIFMIEVSAPGKLYIAGEYAVVETGHPAVIAAVDQFVTVTVESARKVGSIQSAQYSGMPVRWTRRNGELVLDIRENPFHYILAAIRLTEKYAQEKNILLSFYDLKVTSELDSSNGRKYGLGSSGAVTVATVKALNVFYALNLSQLEIFKIAALANLAVQDNGSCGDIAASCYGGWIAFSTFDHPWLQEQETQHSISELLALDWPGLSIEPLIAPEDLRLLIGWTGSPASTSDLVDQVHRSREDKMVAYQLFLKNSTECVNEMIKGFKENNVTLIQQMIRKNRQLLHDLSAITGVVIETPALNKLCNLAEQYEGAAKSSGAGGGDCGIVIVDQKSGILPLMSAWEKAEITPLPLHVYSDQRKENR

SEQ ID NO: 6591 - protein, 131 aa, Enterococcus faecium
  misc_feature (B) LOCATION 1...131
  hypothetical: YES
ENIFTTIPKKNSKSFREAVKGIFKFTDINLAREAKNRLIHDYIDQPKYSKACASLDDGFEDAFQYTVQGNSHNRLKSTNLIERLNQEVRRREKIIRIFPNQTSANRLIGAVLMDLHDEWIYSSRKYINFDK

SEQ ID NO: 6592 - protein, 534 aa, Enterococcus faecium
  misc_feature (B) LOCATION 1...534
  hypothetical: YES
ECIFLGAELNQKLFSAADNLRSKMDASEYKNYLLGLIFYKYLSDRLLEQVVLLADESLEEYDTVSKQTMLYRELLSDEESKEDLIATIVDILGYAISPEYLFNVLADQAKQATFQLNDLNKAFVQLASTYNQFNGLFDDVDLQSKKLGTDEQQRNVTITEVIKKLNDVEVLGHDGDVIGDAYEFLISQFASEAGKKAGEFYTPHMVSDMMAQIVTLDQKERRFFSVFDPTMGSGSLMLNVRNYLTHPDNVKYHGQELNTTTYNLAKMNLILHGVDAEEMNLRNGDTLNKDWPTDEPYTFDAVVMNPPYSANWSADTTFLDDSRFNRYGKLAPKSKADFAFLLHGFYHLKETGTMAIVLPHGVLFRGAAEGVIRQKLLEDGSIYAVIGMPANLFFGTSIPTTVIVLKKNRQTRDVLFIDASREFVKGKNQNKLSEENIQKILETYAERKDVEKYAHLANFDEIKENDYNLNIPRYVDTFEEEEPIDMVHVGNDIKKIRQEQQVLEKELLEAISSLQTTPENEAWLQGALEVFKHE

SEQ ID NO: 6593 - protein, 535 aa, Enterococcus faecium
  misc_feature (B) LOCATION 1...535
  hypothetical: YES
ECIFLGAELNQKLFSAADNLRSKMDASEYKNYLLGLIFYKYLSDRLLEQVVLLADESLEEYDTVSKQTMLYRELLSDEESKEDLIATIVDILGYAIAPEYLFNVLADQAKQATFQLNDLNKAFVQLASTYNQFNGLFDDVDLQSKKLGTDEQQRNVTITEVIKKLNDVEVLGHDGDVIGDAYEFLISQFASEAGKKAGEFYTPHMVSDMMAQIVTLDQKERRFFSVFDPTMGSGSLMLNVRNYLTHPDNVKYHGQELNTTTYNLAKMNLILHGVDAEEMNLRNGDTLNKDWPTDEPYTFDAVVMNPPYSANWSADTTFLDDSRFNRYGKLAPKSKADFAFLLHGFYHLKETGTMAIVLPHGVLFRGAAEGGIRQKLLEDGSIYAVIGMPANLFFGTSIPTTVIVLKKNRQTRDVLFIDASREFVKGKNQNKLSEENIQKILETYAERKDVEKYAHLATFDEIKENDYNLNIPRYVDTFEEEEPIDMVHVGNDIKKIRQEQHVLEKELLEAISSLQTTPENEAWLQGALEVFKHEQ

SEQ ID NO: 6594 - protein, 96 aa, Enterococcus faecium
  misc_feature (B) LOCATION 1...96
  hypothetical: YES
RSIFTKPTLLGGMNGVGEAGPEAVLPLKRSVLQEIGDRILSSTSVSFRAQTIQPVNNYEFNFTIDGNADEVTMKQTTQQIIDSITKIQNDNASAWR

SEQ ID NO: 6595 - protein, 179 aa, Enterococcus faecium
  misc_feature (B) LOCATION 1...179
  hypothetical: YES
AIIFSIDQKGAVFIMWTEKQKKDAYEILLLQQQGLLEAEDNWLANLANSSALLNETLPETVFAGYYLFDGNELILGPFQGRVSCTRIKMGKGVCGESAEKQATLIVDDVKKHENYISCDSAAQSEIVVPMVKEGHLIGVLDIDCGVTKGYNEIDQAFLEKYVDLLLANFNINAFSFINN

SEQ ID NO: 6596 - protein, 110 aa, Enterococcus faecium
  misc_feature (B) LOCATION 1...110
  hypothetical: YES
QFFIMDNTQASSFAATSTTVISFFVNVPVLSEQITVIEPNVSTEGSPLMIAFSFAISCTPTDRIMVKTAGNPSGTIDTTKAIVAERRICQSIPYRNVVKITKNRLKQRMP

SEQ ID NO: 6597 - protein, 260 aa, Enterococcus faecium
  misc_feature (B) LOCATION 1...260
  hypothetical: YES
RNFILYSYSFFILFIEVKSMKMIRYATARLIYYKKQTILYCLFSSFSAFLLIACLTLYHLQSALANQVQDRLSFIGASASTALLPALELASRFYLKGIFSLFFLFAFFFIFFFYYSLRQNQQELMNWRLTGLSKAKLFLFIFWQLFFPLFLCCILVLLWIVSFQSVYETLLQRINFLVLKTAELPDIRDILTSVSGLTIPMDQQTFFTIDFQNDLFFTDILRGFAQTLVGLSGCCLILGLLPFTFFIHHLQSRRSKRNET

SEQ ID NO: 6598 - protein, 82 aa, Enterococcus faecium
  misc_feature (B) LOCATION 1...82
  hypothetical: YES
CFFMDVFESRRSVANLFGNERGGGRMSRHLMLHIPDGTKAIAISIVAERKDGGLALTTKGIDTKQILEGRDVEIEIDEEEVE

SEQ ID NO: 6599 - protein, 248 aa, Enterococcus faecium
  misc_feature (B) LOCATION 1...248
  hypothetical: YES
FGIFSIGNSGFSKGGRRKMTLLVKQELFKLIKKKSTAVLSVLLVVLLIGTALLAKKYTTIIDPVEMTAQLFSATSWIVFIMIAAASTIISMEAQYGTLKNLLYRKYSRGEILVSKWITLVIYSVYLYLLAIIVTVLMKLILFPSISFTEKVSTGQTLIQSLFTYTLGSYIGLWLILSLVLMIACFINSSGASIFSRNRLLFCFVNHIWYPYCTHPKMGVDQMESDQYVESAKPNWKRRDHEAIDSSFY

SEQ ID NO: 6600 - protein, 114 aa, Enterococcus faecium
  misc_feature (B) LOCATION 1...114
  hypothetical: YES
IPFIGGEKNVAETLAPLTTKKIDTLILGCTHYPLLRPIIQNVMGENVQLIDSGAETVGEVSMLLDYFNLSNSPQNGRTLCQFYTTGSAKLFEEIAEDWLGIGHLNVEHIELGGK

SEQ ID NO: 6601 - protein, 337 aa, Enterococcus faecium
  misc_feature (B) LOCATION 1...337
  hypothetical: YES
KPFIMMSNSSVIDAMCYNNSVKSKMKWRKDMDGLLPLWKERGMTSHDCVFKLRKILHTKKIGHGGTLDPDVDGVLPICIGKATKVIEYLTDSGKIYVGEITLGFSTTTEDRSGERVETKPVDMSLSEKKIDEVMASFIGEITQIPPMYSAVKVNGKRLYEYARNNETVERPVRKAQIYRFIRTSELTRDEVTGTISWRFEVECGKGTYVRTLAVDTGKKLGYPAHMSDLTRTASAGMSQKDALTLEEVAQAVKNGTIDDCLLPIEKGVERFKRVDITDEVWQKVKNGMRLDYTVFALPEMPSEEIALFYKGKVVSIYQPNPKEKNKLKPSKVLRNEE

SEQ ID NO: 6602 - protein, 285 aa, Enterococcus faecium
  misc_feature (B) LOCATION 1...285
  hypothetical: YES
GILMSVSIRLQIKTMYNDFSPKEQAIADYILENPSKVSHSPISNLASELGIADSTFFQFTKKLGYNGFKDFKMAMLIQENDLSAISIHENIQKTDTELTMAQKVFESSISTLNDTKKLLQQKDLKKAATIINESKRVYFFGVGGSEIVATDAYHKFLRSPIATSHSTDYHIQLMEASLLTEKDCAVLISHTGQSKETIHIAETVRKTGAKTIVITSQANSSLAKLGDVVFISISEETEFRSEALASRISQLSILDSLYVILMFYNEKESRRSIAKVRHTISEIKE

SEQ ID NO: 6603 - protein, 60 aa, Enterococcus faecium
  misc_feature (B) LOCATION 1...60
  hypothetical: YES
NYLMNKKILAVIISIIVLITMFFIFRLIFNISLQKSILYLIPIAFILAIFRSIYGNKNSK

SEQ ID NO: 6604 - protein, 76 aa, Enterococcus faecium
  misc_feature (B) LOCATION 1...76
  hypothetical: YES
HHLIVRVLALYNVKKTFLAIGKSLNPTVSVLPIGDFRRFWATAYVCIGASPNKVITIFYLRVHDRLFLMIRQWNLK

SEQ ID NO: 6605 - protein, 156 aa, Enterococcus faecium
  misc_feature (B) LOCATION 1...156
  hypothetical: YES
LFIIYGRRRKRMRLFIDGDGSPVKEDVIKLGESYGLDVVIVTSVDHYTTKEYANHVQIVYVDRGADSADYKIVGMVKKNDFLITQDYGLASLVLPKGVRVFHHSGKEFDEANIGTLLEQRYHSGKLRKAGIRTKGPKPFTEKDHMSFRQALKKAID

SEQ ID NO: 6606 - protein, 66 aa, Enterococcus faecium
  misc_feature (B) LOCATION 1...66
  hypothetical: YES
LAIITLEVEHTHNVAQFEIDTGKGHNLQKSNHEKWIGCRNIEKHRGDAKCSRNHQSNTRSHHNRIE

SEQ ID NO: 6607 - protein, 348 aa, Enterococcus faecium
  misc_feature (B) LOCATION 1...348
  hypothetical: YES
ERILKMKITEKDFGQGYHLITLENKNKLALSISDLGARIVSLKSNDRELVLGFDTAEEYIEKDPYIGASIGRTAGRIENGRFSLNGKTYQLATDPKTGHNLHGGAPGFELKKWSYVILNGENEASVIFTTTSPDGEHGFPGTMDVEIRYTLTKDNIWRVTSRGTSDQDTLFNPTNHVYFNLTGDASQSIDQHELWLNSEAYAPLRTDSIPIGVKENAAGSAFDFQIPKKLASVFASDLDQKNLVDGIDHPFFLKETGLGKEAARLTSPDKRIQVDIATDASSVVIFTANFGTETPEMRNRKLAHHGGITFETQTAPGAERFSAFGSIHLKAGSVFETVTEFKIKTRKE

SEQ ID NO: 6608 - protein, 119 aa, Enterococcus faecium
  misc_feature (B) LOCATION 1...119
  hypothetical: YES
EKIILEIGDKKLNKVNMNKKFVIIGIVVLAIIGIIFSRMTGSSGLEKSSVPLVTQILQEQYNLNRTCDDVTITHDNGDNTYRAKATLDNGSAININVEYYPKKDRVYVEIPYTEVLMLN

SEQ ID NO: 6609 - protein, 363 aa, Enterococcus faecium
  misc_feature (B) LOCATION 1...363
  hypothetical: YES
TEIILSQSDRRCDHYEQKVKNGDDEMNEELILAIESSCDETSVAVVRNGTEILSNIVASQINSHKRFGGVVPEVASRHHVEQITLCLEDALVEAGVSAEDLSAVAVTYGPGLVGSLLIGISAAKAFAWAHQLPLIPVNHMAGHIYAARLVKPFQFPLMALLVSGGHTELVYMQEDGSYEIIGETRDDAAGEAYDKVGRVLGLSYPSGKEIDQLAHQGKDNYHFPRAMIHEDNYDFSFSGLKSAFINLVHNAQQRGEDLDKNDLAASFQASVIDVLITKTLRACQNYPVKQLVVAGGVAANQGLREGLQAALSAKLPEVELVIPPLRLCGDNAAMIGAAAHVEMQKRNFASYQLNADPSLVLSE

SEQ ID NO: 6610 - protein, 121 aa, Enterococcus faecium
  misc_feature (B) LOCATION 1...121
  hypothetical: YES
EEIIIDSKEQLKIAIEAADSKRAEDIIALDVRNVSLLADYFMICSANSERQINAITEEIIDKEEENKYEVKRIEGKEGGKWVLIDLGDVIVHVFHAPERNFYNLEKLWSDAPLVDLSEWLD

SEQ ID NO: 6611 - protein, 208 aa, Enterococcus faecium
  misc_feature (B) LOCATION 1...208
  hypothetical: YES
ELIMAKKKWKKQKRKNIRWPAVVAGVAVILLAFVFSLKNLSSPFTDNQQENEAQSHQQFIERLVPHAQELQDGYGVLPSIILGQAILESNWGKSTLASKYNNLFGIKAYGDQKKVSLETKEFVNEEWITIQGDFKVYDSWEQSMDDHTQLFVQGVDWNPALYEKVITATNYQEAAQALQDAGYATDPGYAQKIIQVIETYQLNQYDRR

SEQ ID NO: 6612 - protein, 220 aa, Enterococcus faecium
  misc_feature (B) LOCATION 1...220
  hypothetical: YES
EEIMKYNAVIFDMDGLLFDTELVYYEATQVVADKMGFPYDKDLYLKFLGVSDEEVWANYHMIFSEFGKTSVQRFIDDSYQETLERFSQGAVQMKPGVLELLSFLEEHQIPKVVASSNQRAVIELLLKKNNLFERFETIVSAENVQRAKPDPEIFLLANQKLGTAKKETLILEDSQNGILAASAAEIPVVMVPDLLPPSQELIKKTAGVVSSLHEIPALLK

SEQ ID NO: 6613 - protein, 227 aa, Enterococcus faecium
  misc_feature (B) LOCATION 1...227
  hypothetical: YES
QCVILKERRIHMPTQTFFHLPKEKQKRLIEAARIEFSRVPLKEASIANIVKLADIPRGSFYQYFEDKEDLYFYYFETMRRDSSKDMLQLMKESDGDLFKGFESYFSKMIYEILEGENASFYRNLFMNMDYRASRKVAPHTSRQKTPHDPHKEHKQDAKELLELIDRTKLKVKNDHELELLIQLVMNTVFTTIAHSYRLFSTSEDYSVEQAISEFNLKLSWLKNGVYK

SEQ ID NO: 6614 - protein, 114 aa, Enterococcus faecium
  misc_feature (B) LOCATION 1...114
  hypothetical: YES
LSVMKFANSAAKKLGKIASVRTFPIVNTSNPNNVPAKGVPNTELKPALIPLIIKISRSALSNRNKCAILSANAPPIWTAVPSRPTDPPNKWVVMVPNKVNGMSRKGIFSSPPFP

SEQ ID NO: 6615 - protein, 390 aa, Enterococcus faecium
  misc_feature (B) LOCATION 1...390
  hypothetical: YES
TQVISRLFPTRKGADTMREKRRDNKGRILHTGESQRTDGKYLYKYVDAFGNTKYVYAWRLTPTDPTPKGKREKPSLRELEQQIRRDIEDGIDSAGKKMTLSRLYAKQNAQRANVKKSTQKQREQLMRLLKEDKLGARSIDTIKPSDAKEWALRMKDKGFSYNTINNHKRSLKASFYIAIQDDCVRKNPFDFKLSEVLENDTKEKVALTEEQEQALLSFIKTDNVYHKYYDDMLILLKTGLRISELCGLTVADIDFKNEVVIIDHQLLKNKEQGYYIETPKTKSGIRQVPLSRETIQAFQRVMKKRPKAEPFVIDGRSNFLFVNHKGKPKVAIDYNALFVRMVKKYNKHHKDNPLPHITPHTLRHTFCTRGASRXMIXERSXTSPMVAKRX

SEQ ID NO: 6616 - protein, 197 aa, Enterococcus faecium
  misc_feature (B) LOCATION 1...197
  hypothetical: YES
QLSMRNIANRIHVQAPALYWYFKNKQQLLQKMAETMEEELALPDPTLPWNEQLLQYMENYYDLYTRFPCGAELEINTVPAFPSRLEHLEQMIQLLVREGFSVTQSHQAIASLHNLLIGQLMDQQHEQQLRQKIMDGNEFLKETVLFMRNYVVENQLEGIKESMQSHAELNEKALFLTSAQTYIEGLCQPNKRRENEQ

SEQ ID NO: 6617 - protein, 146 aa, Enterococcus faecium
  misc_feature (B) LOCATION 1...146
  hypothetical: YES
RYSIRCHQYARLWHDERRKSSCTSRKSNEINQVCSWGYNNVEDQQNLEAIMGLIMFGGNAKSDAMEAIAAAKIGDFELADRKIADAEESLIQAHHAQTDMLTQEAQGNHMQVTLLTVHSQDHLMTSIAFTDLAKEIIELYRRVYSE

SEQ ID NO: 6618 - protein, 133 aa, Enterococcus faecium
  misc_feature (B) LOCATION 1...133
  hypothetical: YES
SYFFIQGKGVQKMKHVKALVVKAIMIWAILWVVLTGLYGVSFMDSTIVGVIIVVMIYVLGDLLILRKVGNIAATIADAGSAAVILWLYLYFMNDTVDIWMKVLIPALLIGVAEWFFHKWLLSQGIVPDERKME

SEQ ID NO: 6619 - protein, 301 aa, Enterococcus faecium
  misc_feature (B) LOCATION 1...301
  hypothetical: YES
ANPIPMRKPLSHWNVAALSFPQKAKRKPPQAGRLWSRAFHATLKKKPKQPEPSPPLPALTKGQKLTAGGASIKEGATSPPAHFTEDTLLSAMEHASAKEFAKLEDVEHKGLGTPATRAGVIEKLVRSGFVERKKKQLFPTEKGTELIKVMPDTLKSVKLTAEWEERLGAVERGELSPEDFMAGITAMLTELVKSYQGVTVASAALSASGRTVIGICPRCGKNVVEGKKSFFCEGWNAAPACDFALWKNDRFFTSKHKELTRKAAAALLKKGRVAMTGLFSEKKGVLYDAIVVMEDTGEKFV

SEQ ID NO: 6620 - protein, 73 aa, Enterococcus faecium
  misc_feature (B) LOCATION 1...73
  hypothetical: YES
SEPMVKRFAWFLTAGFLDHFQQSVHLARTRNRKKKPEFSSLSSASYGMYSFWLIIAGILIALSAIFMLFSLLG

SEQ ID NO: 6621 - protein, 312 aa, Enterococcus faecium
  misc_feature (B) LOCATION 1...312
  hypothetical: YES
MKTINLIKVFIASPGDIAAKRNEVEETIYRWNIENTDNTKVILMPIRWETNAIPTYINNSSGQSVINKQIVENSDILLAIFGHKLGSPVDNYRSGTIAEIDYFYKNSKGEVGVFFLDEPVPQVLAEEYIEVKKYRDSLEDKGFYGTYSKDNIRRFLTKKVNYLIEKAQNNLESKRFDLDSISYKTPSVINKKVTGTDKDFDDNLDIFDPIEFDNDERLLLIYAFMDENSIFSTDNSTYRKVVQWESDNNLRSYLSDRVFDVLEKLSKSGILKEEYDSSFDEYPSRYILISEDYKKFKRYFLKNADCKIKLDN

SEQ ID NO: 6622 - protein, 176 aa, Enterococcus faecium
  misc_feature (B) LOCATION 1...176
  hypothetical: YES
QRTIKLYLRKGQIMRYPILIHPNDKLKRTAQPIDVITDETIALLDNLYETMIANDGIGIAAPQVGQNKRIAVIEVDEGEKFELINPEIIEAKGESLDVEGCLSIPHVYGTVKRADEVTVRYYDRDGEEIEVTAFGYLARAFQHEIDHLDGILFIEKMIQQIPEEELEEYMEEHLDD

SEQ ID NO: 6623 - protein, 80 aa, Enterococcus faecium
  misc_feature (B) LOCATION 1...80
  hypothetical: YES
GMTMMTQTKLPLIGIGVTLIGIPVYYSKKRKHAQKSKIFQQQTEKVRTRSSRSSCFFYFNKTSSSILIFATSASSAYVLK

SEQ ID NO: 6624 - protein, 122 aa, Enterococcus faecium
  misc_feature (B) LOCATION 1...122
  hypothetical: YES
GVTMMNTQAKTFVRSQLFPEEMPQFLEKKKQVGILGGTFNPVHLAHLVMAEQAGRNLGLDRVFLMPSYQPPHVDEKQTIDAKHRLNMLELAVEDNPFLQIETIELARGGKSYTYDTMKELTR

SEQ ID NO: 6625 - protein, 155 aa, Enterococcus faecium
  misc_feature (B) LOCATION 1...155
  hypothetical: YES
SNAIAESNSISDINLIYSGQQLTIPTEGSAQAAAEPQAAVQEAPVQAEQPVVQETVQTEKQAAPVAETQPAPAVTETAATPASTSSAKEWIAQKESSGSYTATNGRYIGRYQLDSSYLNGDYSAANQERVAEQYVTSRYGSWEAAKAFWEANGWY

SEQ ID NO: 6626 - protein, 89 aa, Enterococcus faecium
  misc_feature (B) LOCATION 1...89
  hypothetical: YES
ISAMIAEQERTESKRRQAQGIKIAKANGVYKGRPKLYSADTKDPQRRLVYRSIVQDLENGVAISKIATDYNVTRQTIYRIKKEIDQLIV

SEQ ID NO: 6627 - protein, 548 aa, Enterococcus faecium
  misc_feature (B) LOCATION 1...548
  hypothetical: YES
GGAMSTKESLELNEITSGNPLLSSIRSIVETTFYGNNVHEVFDRKTAYQLAKGSPGTIITDLTISHAEELDLPADVRTLVFNDGSIVGRTASARRIFEDLDKEQSKYEKILREAVYQSRKRQFYHTKVIVGLSEEFSVQSHLLIPEGFENNLYSYLLNFQPANSKILETYQKSVSFDEGDLYIFCDPEWTHETFPNGLILFDALHNTAAVLGLRYFGELKKATLTLAWALGNRNGFIACHGGMKQYASNDQTYTMAVFGLSGSGKSTITLAKHTEGHSVSILHDDAFVISRKNGFATALEPSYFDKTQDYPSDDPAISSFLTCQNVGVTCTSKGEKVLVTGDIRNGNGRTVKSRYATPDRVDHLSEKIDAVFWIMKDDSLPPIIKINDPVLAASFGATLATKRSDAENITTKRQLDELVIEPFANPFRVYPLREDYQAFRELFLKQQTACYVLNTGYFDDKKIKPETTLSIVERIVQQTAEFKSFGPFEDIHYLPIPDFPVSFEDTSYKNLVKQRLDIRLRFIEAQIGKDLLPDEAKESLENLIQKLN

SEQ ID NO: 6628 - protein, 213 aa, Enterococcus faecium
  misc_feature (B) LOCATION 1...213
  hypothetical: YES
KKYIRRKKSKIIKCDTHTKIGVSSDGKYDCYLSTNSGAESNLLDELKRTEIQIIDKKERPKNGFVLSEKTDLENTEAFNKESVKDLRKLPTKDINGKDFTSKDFEKYDLTMVNVFATWCTACVKEIPDLVEVQNEMKSKGVNIVGVVTDPVDDNGENKEAIEKSKLIHEKTKASYPFLMPDGMATLFLTKIIRCCECCGVMAPIALDNEHPRI

SEQ ID NO: 6629 - protein, 308 aa, Enterococcus faecium
  misc_feature (B) LOCATION 1...308
  hypothetical: YES
EAHMIISTITEAIGSTPLYRFDNQHYSMPKGSAIYAKLEYLNPGGSIKDRLGSYLIKEGFAQGKINEKTTIIEPTAGNTGIGIALAALTYKLRTVFVVPEKFSLEKQQLMKALGAKIIHSPSEQGIIGAISKSKKLAEEISNSYLPLQFENKDNPAAYYHTLGPEIFHEIKENIHSFVAGIGSGGTFAGTSTFLKEKYPDIRIIGVQPEGSVLNGGDPAPHEIEGIGVEFIPPFLSPLSINQIETISDVEGFNYTRQLAREQGILVGSSIGAAFAAALREIRRLPPGHRVVTIFPDAADRYLSKNIYL

SEQ ID NO: 6630 - protein, 102 aa, Enterococcus faecium
  misc_feature (B) LOCATION 1...102
  hypothetical: YES
IRHIQRNSSCLSAENCSAFSFFIDLFFFYFPSISFVMYAITCYLLLYESLRSPLHDYVGESFVLGACGRTGRKYCLSYELEQRTVLFSYFDSSGYLLYVESF

SEQ ID NO: 6631 - protein, 315 aa, Enterococcus faecium
  misc_feature (B) LOCATION 1...315
  hypothetical: YES
QRHMLCIFIRCGEWGLDLIKWLLLLVVIFMGSFIFFLQREIKRLTKKIATLSERQEYGGRLSVEFREKNLMDLVDALNTWVDENEQKGQAFQEMEENIRLSIVGLSHDLRTPLTAINGYVQLLEQVEDTEKREKYLTIIKQSVARLLSMTDQFYDLARIETKQKEMDLHTLSFSKEVEEVFFSFYEQFSEKNIEVAFAEHSINTTVLADPLMLLRVLQNIIQNLLRYADGQAKVTFSKEDSFIRLTVANPIKPGAQTSVEKVFQRFYTENTSRTNTESSGIGLYLSKKLVEGMGGEMTARLDGGIFSISVKLRRV

SEQ ID NO: 6632 - protein, 448 aa, Enterococcus faecium
  misc_feature (B) LOCATION 1...448
  hypothetical: YES
EDNMANDKITIHGARAHNLKNIDVTIPRDKFVVVTGLSGSGKSSLAFDTLYAEGQRRYVESLSAYARQFLGQMDKPDVDSIDGLSPAISIDQKTTSKNPRSTVGTVTEINDYLRLLFARVGHPICPNDHIEITSQSVDQMADQVMALPERTKIQVLAPIVVKKKGQHKKIFERIQKEGYVRVRVDGEIYDLSEVPELEKNKKHDIAIVIDRIIVKEGIRSRLFDSLEAALRLADGYALVDVIGEEEMLFSEHYACPYCGFTVGELEPRLFSFNAPFGACPDCDGLGVKLEVDQDLVIPDRTKTLSQGAIVPWNPISSQYYPQMLAQACESFGIDLDTPFEELPEEHQEIILNGTDDLFHFHYENDFGGVRDVKTTFEGVLKNIERRYHDTNSDFTREQMRLYMTELTCQTCKGYRLNPQALSVQINGTNIGQTNELSIPKSSRFLLQT

SEQ ID NO: 6633 - protein, 427 aa, Enterococcus faecium
  misc_feature (B) LOCATION 1...427
  hypothetical: YES
WLNIECINNWSLIMRMQMIGGLTMKNFYKKKFALTDQGAEALTKASISSFFVYCINMVPAFIIMMLIDELVLENAKPRWLYFAVSFVTLLFMYWLLDREYENLYNSTYKESAHLRVQIADDLSNLPLSYFSKHNLSDLSQTIMSDVEGIEHAMSHAIPKAGGMALFFPFISVMLLVGNVKMGLAVILPTLFSFVLILLSKKSQTKANTKYYDTLRENSEEFQETIELQQEINSFNLSKKVQDRLFKKMEESERIHLKVELSTFSVMALSSIFSYVSLAVVILVGVHLLLTGEVTILYVVGYLLAAIKIKDSFDSMKEAVLEIFYLAPKIQRIRAMKETSIQEGSDSPLKSFDIELRDVSFSYDNNTPILDHISFTAKQGEVTALVGASGSGKTSILKLVSRLYDYDEGCILIDGYDIKRVSPASLFS

SEQ ID NO: 6634 - protein, 240 aa, Enterococcus faecium
  misc_feature (B) LOCATION 1...240
  hypothetical: YES
SINMKTRSDVSSNKTKKTNYWKFAFLILLGVVLGSTVFLGSRIFANREPELPEIPALTERQGDPVLTINSNKEKVNQIISFFLSEYQKDSDIEYKFYLENEALLNGTFEVLGFPIDFYLYFDPYVMENGNVQLKARSLSIGTLSLPIKDVMNMIKRNYKLPDWIEVNTDDLTIMLRLDQFRMQNGMYIKADKIDLVNDDIRFSLYLPKDTSDASNNSNTNKTSTSSTESKTKENKKSSDE

SEQ ID NO: 6635 - protein, 335 aa, Enterococcus faecium
  misc_feature (B) LOCATION 1...335
  hypothetical: YES
AANIHKTKEGLMESVKKQEPFQLTLSKKEEKLRRRKKIIAGIKTNKFLYVMILPGVLYFLIFRYLPMGGLVIAFQDYQPFLGIMGSPWVGFKHFIRLFTEPTFFTLLRNTLILFGLNIFVFFPMPIILSLLLNEVTNKRLKNGIQTIIYIPHFMSWVIIVSITYVFLNVDGGVLNEFLATMGFEKISFLTSPEWTRTVYIGQVIWKELGWSTIIYLSAITAVDTQLYEAAEMDGAGRLRKTWHVTLPAIRPVIITLLILKIGQTLDLGFEHMYLLLNSLNRSVAEIFDTYIYTAGLKNGQLSFSTAMGLFKGVVGLFMVILANKIAKKLGEDGVY

SEQ ID NO: 6636 - protein, 148 aa, Enterococcus faecium
  misc_feature (B) LOCATION 1...148
  hypothetical: YES
MKNIWKYGRTGGEYAGKVLDDMLVSVPYTDQPPLEGIRADGEPLTIADQMFDPKLNQWIILANALDHNDLNNLKAMYESLENENGDLKQINAKLMLSDVAIKQENTALKEKADSLAQINSKMMLASLQNSKDISEIKEQLNPASKGGE

SEQ ID NO: 6637 - protein, 312 aa, Enterococcus faecium
  misc_feature (B) LOCATION 1...312
  hypothetical: YES
GGNIMIIKSERISLKHLLTVEALTDQEVMGLIRRGQEFKQGANWTPQKRQYFATNLFFENSTRTHKSFDVAEKKLGLEVIEFEASTSSVQKGETLYDTVLTMSALGVDVAVIRHGDENYYDELIQSKTIQCSIINGGDGSGQHPTQCLLDLMTIYEEFGHFEGLKVAIVGDITHSRVAKSNMQMLKRLGAQVFFSGPREWYDDEFEVYGHYMPLDELLDQVDVMMMLRVQHERHDGKESFSKEGYHQEHGLTVERAKKLQKHAIIMHPAPVNRDVELADSLVEGLQSRIVQQMSNGVFVRMAILEAVLNGKA

SEQ ID NO: 6638 - protein, 149 aa, Enterococcus faecium
  misc_feature (B) LOCATION 1...149
  hypothetical: YES
SMNILYISISGNTRAFAKHLAEYAEKMHAEDPVNPEVTLKEIHENSDFTKETEPFFTFVPTYLDGGNGLDNGDTEILTETMREYLEHEDNHKLCLGVVGSGNKNFNNQYCLTAKQYAQTFGFPFLADYELRGTPSDVTRIYQILAENNK

SEQ ID NO: 6639 - protein, 775 aa, Enterococcus faecium
  misc_feature (B) LOCATION 1...775
  hypothetical: YES
KANISVKKRITARILGQLSNRYLSRFPFYRKKKGGSIPVTKEEILTGPGVIKLVSQYMGPEHVAFVEKACEYATAAHDGQFRKSGEPYIIHPIQVAGILADLKMDPHTVATGFLHDVVEDTEITLEDLREEFGDDVAMLVDGVTKLGKIKYKSHEEQLAENHRKMLLAMAQDLRVIMVKLADRLHNMRTLKHLREDKQRRIAQETLEIYAPLAHRLGISRIKWELEDTALRYLNPKQYYRIVHLMQTKREEREKYVSGTVEDIRIATEELGIFAEIYGRPKHIYSIYRKMKDQKKQFNEIYDLLAIRVIVDSIKDCYAVLGAIHTKWKPMPGRFKDYIAMPKANMYQSLHTTVIGPAGNPVEIQIRTQEMHEIAEFGVAAHWAYKEGKNEKVEPDGMTKQLSWFHEILELQDESYDASEFMEGVKGDIFSDKVYVFTPKGDVTELPKGSGPLDFAYSIHTDIGNKTTGAKVNGKMVQLDYKLKNGDIIEIMTSPNSFGPSRDWLKLVATSKARNKIKRFFKAQDREENVIKGHESVVKCITDLGFTPKDILTKNKLQEALDRFNYQTEDDLYAAVGYGEVSPLTMANRLTEKERKEQKIEQQKQEAEEIMNQPKKEPDKMKVRHEGGVVIQGVENLLIRISRCCNPIPGDDIVGYITKGRGISIHRRDCPNVQPDKPNVAERLIEVEWEDTSNTRKEYDADLEIYGYNRSGLLNDVLQTVNALTKNLNSVEARTNKDKMATIHLTVGIQNLSHLKSIVDKIKAVPDVYSVRRTNG

SEQ ID NO: 6640 - protein, 631 aa, Enterococcus faecium
  misc_feature (B) LOCATION 1...631
  hypothetical: YES
GGNMLKELKVTDLKKTYGEKDLFDQISFLVHEKDRIGLIGTNGTGKTSLLNIIAGIDSSDGDRQTVFYPTDYRIGYLSQAAEFSDELTVLQAVFQGNSPLIQTVRAYEEALIELGENGEDPDVQKRYAKAEEQMNKEDAWTTDTNAKIILQKLGISELDKKISTLSGGQKKRVSLAQVLIDEPDLLLLDEPTNHLDYEAIEWLENYLKQYRGALLMVTHDRYFLDRVANRIFELSFGKLYEYKGNYEAYVLEKAERDRVEVEQEEKRKRLYKQELAWMRAGVQARGTKQQARINRFEDLKENLYQVNQEDDLELNLATQRLGKKVLEIKDGSYRINDQTLLEHLDLLIQSRERLGITGKNGAGKSTLLNILAGRIPLDSGTMSIGETVHLAYYTQENEEMAPDKRMIAYLQEAAEEAKTADGSQIGVAELLERFLFPRFMHGTLIGKLSGGEKRRLFLLKLLIQQPNVLLLDEPTNDLDIATLTILEDYFRSFPGAVITVSHDRYFLDKVADKLLVFQGNGKQELYYGNMSSYLLKQKETQQPAEKAKPKIQSKEPAEKKKLSYMEQKEWETIEDEIAELEEKISLLQEEMNHQGDNFTRLQELQNDVSETEAQLEEKMARWEYLSEWVED

SEQ ID NO: 6641 - protein, 182 aa, Enterococcus faecium
  misc_feature (B) LOCATION 1...182
  hypothetical: YES
LADIKGLDIFGNNKGLAKIKKEAEAKKKQQAITPSENKQLEVHQVQEIKTSSNVERQSRGRTKKVGAPIRKFDKVYSTKHPLKLSTLLNATSRVLVEKYETNMTRDELLRKALDEYIKQNLTQEDKQDLFNDVVKELDLFREKYPIVPELDDRGEIIRTTSQIKQDTEDSLRKGWGMNNKVR

SEQ ID NO: 6642 - protein, 416 aa, Enterococcus faecium
  misc_feature (B) LOCATION 1...416
  hypothetical: YES
SRDIHVRIENRFNKEEFFMDHKPTETKDVTPVNDTLEDLLNNPFSTPTDTLTTSQQAEIDQLQEQQTAARLIDKLPAERQEQAKQLAAKIDANDAQSVISYGSAAQAKLSEFSQSMLNHVQAQDIGPVGDSLTELMYRLQEANPDELRAGEGNIFQRVFGKVKQSIYEVTAKYQKIGAQIDKISVKLDKEKDGLLKDNLMLEQLYQKNKDYFDALNIYIAAGELKMEELQTTIIPEAMKRAEETGDQMDVQIANDYTQFLDRLDKRTHDLRLARQITIQQAPQIRLIQNTNQALAEKIQASIATAIPLWKNQVVIALTLLRQKDAVTAQRQVSETTNDLLKKNSEMLKISAIETAKENERGIVDIETLQTTQNDLIETIQETLRIQKEGKEKRRHAEVELGHMEEDLKQKLLDLTQ

SEQ ID NO: 6643 - protein, 316 aa, Enterococcus faecium
  misc_feature (B) LOCATION 1...316
  hypothetical: YES
RFCIILRRKKMKKKKVERVQVRSFNKTANFFSNIMIALFAISCILPFIFVIAISFTDESILSTHGYSFWPEKFSIFGYTYLFDQMQDKIFQALFVTVLVTVLGTLINSTATSLYAYAISRSNFPFRRFFTVFCLITMLFSPGMVANYLVMTNLLQLKDTIWALILPMAVSPFNIIVMRTFFKRSVSDSIIESARIDGASELRIFVQIVLPLAVPGIATISLFAALGYWNDWFNALLYIQDDKLVPLQYLLMKIQSNIQYLTQNSGAGSQLTGGLASVPGESARMAIVVISTLPIAISYPFFQKHFVKGLTIGGVKE

SEQ ID NO: 6644 - protein, 482 aa, Enterococcus faecium
  misc_feature (B) LOCATION 1...482
  hypothetical: YES
LSCIYSYRRNEHLRQYYISEWSGLLMETTMNPEQMVLSEQMHMLIEQLGGKENIDSVLPCATRLRIKLKKQPVANAEKLKQQIPSIKYFILLDRYAEIIMDQGLAPAYKELTRQIDHSAPKEKLNPIEKLFGLISEIFTPIIPLFAGSGILKGLVVLATTIGWLSETSGTYHILSAASNAVFYFLPIFLAFSAAKTFKVNGYIAAVIAAALIEPNLTSLLSDSGKAATDFLGIPVVLMQYTSTVMPAILGIFFYSFVEKFLKKYIRENMQLVFVPLLSLVITVPLTLMVFGPAGVYLGEGLAAAITWMMDINGPISGAIIAGGWNILVIFGIQWAVNPVMISNISAYGFDRIVPLTGAANFGMAGAALGVFLRSKRSKTRSISGSAFASILLAGVTEPTVYGIAIPLKKPFVAACIGAAAGGAVMGFAQVKAIAFVFGSLTTLPAFISGTFFWYLAGLAVSLVVAMITTLVSGFDEDLMSYE

SEQ ID NO: 6645 - protein, 359 aa, Enterococcus faecium
  misc_feature (B) LOCATION 1...359
  hypothetical: YES
PGRITEAKLPVLLVGMRGSXEKDTLAIRQLVEKTALPVVETFQAAGVISRELEAHFFGRVGLFRNQPGDMLLKRSDLVIAIGYDPIEYEARNWNAEKDARIIVIDEAPAEIDPFMQPERELIGDISATLDLLTGSLEPQQVSEDAKEYLASLQAKLTERDIVQSKGEAGILHPLEVINTLQSKLTDDMTVTVDVGSHYIWMARHFRSYEPRHLLFSNGMQTLGVALPWAISAALVRPNTQIVSVSGDGGFLFSAQDLETAVRKKLNIVHLIWNDGRYNMVEFQEKMKYQRASGVDFGPVDFVKYAEAFGAKGIRATSVEELEKALEEGFATEGPVIIDIPIDYRDNEKLGETILPDQFY

SEQ ID NO: 6646 - protein, 178 aa, Enterococcus faecium
  misc_feature (B) LOCATION 1...178
  hypothetical: YES
GDSMFSNYKPTWMVEAIYQITPAQLKNLGIKAVLTDLDNTLIAWNNPDGTEELLTWILEMKNAGIPVVVVSNNNSKRVARAIEKFDLLYVARAMKPLARGINIAKKQLDLADDEIVMVGDQIMTDIRGANRAGIRSILVKPIIATDSWKTQFNRFWEKRIMAYLLAKHPDMGWRGGIE

SEQ ID NO: 6647 - protein, 91 aa, Enterococcus faecium
  misc_feature (B) LOCATION 1...91
  hypothetical: YES
KPGMGTGFIDRVLVQVKEERKITMKYNLLDHKRMWVEKLEEDLEQLELLGHNKTSTVYKEGLKRTKKAQKELATLESRVQKKEVDLTHTYL

SEQ ID NO: 6648 - protein, 80 aa, Enterococcus faecium
  misc_feature (B) LOCATION 1...80
  hypothetical: YES
MNGIRSLSEFGNPRWAPSPNSALPPSFSIPRLALKLFRREPAISKFVWNFSATHTSSPHFSTYVGSVLQCVLPHLQPGHG

SEQ ID NO: 6649 - protein, 80 aa, Enterococcus faecium; identical to SEQ ID NO: 6648
  misc_feature (B) LOCATION 1...80
  hypothetical: YES

SEQ ID NO: 6650 - protein, 77 aa, Enterococcus faecium
  misc_feature (B) LOCATION 1...77
  hypothetical: YES
KIGINSFNSVTTRYLLNHYTVSHTLLSINYYKNAKNALSIYFVIGHNIIEIIPCIDFSYESRLFVIDEKEARQTLEW

SEQ ID NO: 6651 - protein, 372 aa, Enterococcus faecium
  misc_feature (B) LOCATION 1...372
  hypothetical: YES
REGIEMEKTYQAGTNEGIVDFINMEDLEIAASQVIPAGGYGYISSGAGDLFTYQENERAFNHRLIIPHVLRDVELPDTTTHFDEEMLTAPIIMAPVAAHGLAHVKAEKASAKGVADFGTIYTASSYASCTLEEIREAGGEKAPQWFQFYMSKDNGINLDILEVAKRNGAKAIVLTADATVGGNRETDRRNGFTFPLPMPIVQAYQSGVGQTMDAVYKSSKQKLSPKDVEFIAAHSDLPVYVKGVQSEEDVYRSLESGAGGIWVSNHGGRQLDGGPAAFDSLQYVAEAVDKRVPIVFDSGVRRGQHVFKAIASGADLVAIGRPVIYGLSLGGSTGVHQVFDFFKTELEMVMQLAGTQTVEDIKKIKLRENRFI

SEQ ID NO: 6652 - protein, 451 aa, Enterococcus faecium
  misc_feature (B) LOCATION 1...451
  hypothetical: YES
SGGIINMYDILTFGASIDELNTEAIQQAIDAAASDGGGTVVVPAGEFLTGALFLKSNVELHLSAGAVLKFSDDPKDYPVVHSRWEGVHRKVYASCIYAQNVENISVTGFGTLDGNGKKWWHTFRNEPDNLAYPRPKLMSFHNCHRITVKDIKLIQSPSWTINPILCSNATFDNLTILNPADSPNTDGIDPESCKNVRISNCHIDVGDDCIAIKAGTEDTYERIACENITITNCTMVHGHGGVVLGSEMSGSIRNITISNCIFQETDRGIRLKSRRGRGGIVEDIRVSNIVMDNVMCPFILNLYYFCGPRGKEPYVWEKKAYPIDERTPAFRRIHFSNITARNVHASAGFIYGLAEQFIQEITFDNIDVSMAQDAVPGVPAMMTGIEEMSRQGFYIGFAGKVSFNQMSIENHEGPAFLLENTKEISIEKFQSNQSENMDELVVRKNFAYAVE

SEQ ID NO: 6653 - protein, 175 aa, Enterococcus faecium
  misc_feature (B) LOCATION 1...175
  hypothetical: YES
EGGIVMTDILTIKNGRKVVNNGMNEEKVLLDEINLTIREGDFITVLGGNGAGKSTLFNTIAGTLQLSQGSISFKDQLITKDSEEKRARFLSRVFQDPKMGTAPRMTVAENLLLAQKRGQKRKFRLRNLKNQKEDFFRLCQEVGNGLEQHLDTPPGELFWWSTPSIKLADGDDHSS

SEQ ID NO: 6654 - protein, 66 aa, Enterococcus faecium
  misc_feature (B) LOCATION 1...66
  hypothetical: YES
IFLIFGIVPFLPVLEKSYFNSTALVLFIPQLECEKDVQLLGMAPHQLGDYYKNQYLQSLQDMPCSL

SEQ ID NO: 6655 - protein, 171 aa, Enterococcus faecium
  misc_feature (B) LOCATION 1...171
  hypothetical: YES
MILIHDLFHKRGINMQTLAQAKQNFVYQVERIETEEKTKRHLQNIGIVAGSKIVVVNLSGNNAILLVKSHRVAVSREILGQIFVNKKTASSESWTSLDQLKAGETGIVVAIHGQGAVKRRLMDMGLTRNVKIVIRKLAPLGDPIELTVRGYELTLRKSEAELILIQREEKE

SEQ ID NO: 6656 - protein, 629 aa, Enterococcus faecium
  misc_feature (B) LOCATION 1...629
  hypothetical: YES
VYLITMNVETDEVQGSGKNVGKSVMEVPRLNTKIRYWEYYDLQETFDQLFTQSRNGKKFYQLYELIISENNILLAYRTIKANKGSSTPGTDSFTIDNYKEMNQAEFIHLILSHLENYKPKSIKRVMIPKPNGEKRPLGIPCMIDRMIQQMFKQILEPICEAKFYEHSYGFRPLRSAKHALGRIMYLINISKMHYAVDIDIKGFFDNVNHRLLIKQLWNIGICDKQVLAILSKSLKSPIQGEGIPSKGTIQGGIISPLLSNVVLNDLDHWVSKQWHTFETKYPYTKGYNKFRALRDTNLKQGYIVRYADDFKIMTNDYPTALKWFHAVKLYLKDRLKLDISNEKSKIVNLRKCKSEFLGFAICVKQKGKKWVCNSRISNKKKDQIKEEIKQRIKDIQKSPTAQNALLFNALVLGVHNYFRYATHINLDLNRMNYVLSFTTYNRLSNCSTRCYPNKASPTYKKFYSTTMKTYKVAGVYLYPLCDVSTKTIYGFNTEDTPFTPFGRQRLEHKSLQSLVFQELRKLMESKIPNRTVEYLDSRISRYSMKSGKCEITKQFLPAKAVHCHHYLPKSLGGDDKFDNLRIIHKDIHLLIHTTNKMIIDHYVHELKLVPEQIAKINLYRKMCNLQNIQ

SEQ ID NO: 6657 - protein, 199 aa, Enterococcus faecium
  misc_feature (B) LOCATION 1...199
  hypothetical: YES
GYLMEQFGMITATASVLPEKIITNNDLSKMMDTSDEWISSRTGIRERRCVTNQETSDLCILVAEKLIKQKNLNPKDLDFILVATMSPDYTTPSVAAQVQGKLGATHAIAFDISAACSGFVYALSMAEKMIRCGSTKGLVIGGETLSKLIDWSDRTTAVLFGDGTGGILLEANPQKKLLKEKLAADGTRSSSLTAGLPAK

SEQ ID NO: 6658 - protein, 441 aa, Enterococcus faecium
  misc_feature (B) LOCATION 1...441
  hypothetical: YES
EDLIMSMFLDQVTIDVKAGKGGDGMVAFRREKYVPDGGPAGGDGGRGGDVILIVDEGLRTLMDFRFNRHFKAQPGENGMSKGMHGRGSEHTYVKVPQGTTVRDAETGALLGDLIENGQTLVVAKGGRGGRGNIRFASPRNPAPEIAENGEPGQERKIELELKVLADVGLVGFPSVGKSTLLSVISSARPKIGAYHFTTLVPNLGMVTTSDGRSFAAADLPGLIEGASQGVGLGTQFLRHIERTRVILHVIDMSGMEGRDPYEDYLAINKELSTYNLRLLERPQIIVANKMDMPDAPENLVKFKEQLNKEKEDEFADDIPVFPISGVTRQGLDALLNATADLLEVTPEFPLYEEELEEETVHYGFNPEGPEFQIDRDSDATWILSGEKIEKLFQMTNFDHDETVMRFARQLRGMGVDEALRARGAKDGDLVRIGEFEFEFVE

SEQ ID NO: 6659 - protein, 142 aa, Enterococcus faecium
  misc_feature (B) LOCATION 1...142
  hypothetical: YES
RLLIFSKEKLMAELKQEWINTAIEALDKAYVPYSHFPVGACLVTESGKIYQGINIENASFGLTNCAERTAFFKAVSEGEKTFTHLVVAGHTPDPISPCGACRQVMAEFCSPDMPVTLVGDNGVTKATTVRALLPYAFTEKDL

SEQ ID NO: 6660 - protein, 373 aa, Enterococcus faecium
  misc_feature (B) LOCATION 1...373
  hypothetical: YES
YTLIFTCKLEQRYGGSKQMSKTVNEVTKEKWLVETFPEWGTYLNEEIETEVVDPGTFAMWWLGCTGIWLKSHEGTNILCDLWCGTGKRSHGNGMMKKGHQMMRMSGVQNMQPNLRTQPFVIDPFAIKNVDALIVTHIHSDHLDIHTAAAVHQNCPEATFIGPKEVVRTWQKWGIPEEKTITVKPGDAVKIKDINVVALEAFDRTALVTCEDPEEVLKGKMPQEMDQIAVNYLFETSGGNLYHAGDSHYSNLFAKHGNEHKIDVCLGAYGENPRGITDKVTSVDMLRMAESLNAKVVIPVHYDIWSNFMADPKEITEIWKFKKDRLKYGFKPYIWQVGGKFIYPTNKDDLEFNFYRGFEDVFSIENDTPFPSFL

SEQ ID NO: 6661 - protein, 150 aa, Enterococcus faecium
  misc_feature (B) LOCATION 1...150
  hypothetical: YES
HLLIHNGGNQMKKIYFLCTGNSCRSQIAEGYARKYLSPSMFEIRSAGIETHGLNPRAIKIMAEDGIDISKQTSDLIDRDYFTQADLIITLCGDAKDKCPAVPNNHEHLHWDLKDPAQAVGSEEEILTEFRKVREGIKRKVLDLNQRTSIV

SEQ ID NO: 6662 - protein, 255 aa, Enterococcus faecium
  misc_feature (B) LOCATION 1...255
  hypothetical: YES
GILILGGVVNMIKRPPINYLERKKILGTKIKAIRESKNIFTQPAFGLMINNGQLIDKKTIYEWEKGTYLPIPERFSRIADLGNMSIEELVCGNVEEYILGIILYRDSIVLDGITFPDKNLFQHLRQQFPPVHSNLDTWLDRYSKLEPEMQEFIANKTCNKVKNEKISLFNILKIEELFINAIVEEFDNNILFLTSSIEELLERMVDEWLPIQLKDMSYPEEAVREITDNINKLEQTISSIGKKYTKKKMKGGDTI

SEQ ID NO: 6663 - protein, 61 aa, Enterococcus faecium
  misc_feature (B) LOCATION 1...61
  hypothetical: YES
MKLIFVLYAMHTIIPRQPMKDKDEKRVPFELRGHSVKLTDNRCLLILVQITVVKRHKGNYK

SEQ ID NO: 6664 - protein, 298 aa, Enterococcus faecium
  misc_feature (B) LOCATION 1...298
  hypothetical: YES
DKLILNQSFQSVPAGETSKSLEQAAELYDFLADNDFTRSDGILALGGGMVGDLAAFVASTFMRGIHFVQIPTTLLAQVDSSIGGKTAVNTNKAKNLVGTFSQPAGVLIDPEVLKTLPVRRLREGIAEIIKSAAIADATLWKQLNELKDEKDLLEHAVPIITATLEIKRKVVEEDVFDQGNRLILNFGHTIGHAIENTAGYGVVSHGEGVAIGMVAITSHAEKIGLSPTGSTAALERILQKFHLPITYDLSHPDELFHAITHDKKARGSQLNIILLEKIGQAKIVPVPTETFKDYLGGL

SEQ ID NO: 6665 - protein, 163 aa, Enterococcus faecium
  misc_feature (B) LOCATION 1...163
  hypothetical: YES
IVIINLRINLNYIYYKSLKLREALQMNGFEKRAQEKKKEILQAAFDLMNTDIGTAGVTMDKVAENAQVSKATIFKYFGSKEGLIYEVFFAFMNDLGQEAKALIAENLPFEETLIAMSENKIRYLNRVNKQFYIDLMTYYTKKEKKEFSDPRWMRIPRKFQYHA

SEQ ID NO: 6666 - protein, 360 aa, Enterococcus faecium
  misc_feature (B) LOCATION 1...360
  hypothetical: YES
MNIIRRRKMNLFDIFRSTLTDMSIVSAITSTVFIILLGFVCRKKGIFSESVGKILSKVVLTVALPALAFRAFMQDINTELLMQGINVLIWGLVIYIILILVSKPFFLSYKGDKQTTLRVLTIFGSTTFFGTPIVSAIYGPVGVMYSSIFNIGYRIFLYSYGYIKMSGLKMEAKNIKAMFVNPIIIATFAGLFIWLFQGYLPQVSVTGAEGEISQVAFLRIDQTAPWLFQPMDYLAGLSSPLAWLAIGATLGEVSFKKAASEKTSWYYSLVKVVFVPALNIVILAVLTATNILPVNFEALATIVIMMATPAATVAAAYAISFDREALLASNASLLSTIFAVVLTPVWIVVLQMIHGIALFS

SEQ ID NO: 6667 - protein, 221 aa, Enterococcus faecium
  misc_feature (B) LOCATION 1...221
  hypothetical: YES
EKIMDILEIKNVAYSYANSKEKVLSGVNQKFELGKFYAIVGKSGTGKSTLLSLLAGLDKPQTGKILFKNEDIQNKGYSNHRKNNISLVFQNYNLIDYLSPIENIRLVNKSADESILFELGLDKKQIKRNVMKLSGGQQQRVAIARALVSDAPIILADEPTGNLDSVTAGEIINILKTLAKDRNKCVIVVTHSKEVADSADIILELSGKKLKKVNKMNLEVE

SEQ ID NO: 6668 - protein, 872 aa, Enterococcus faecium
  misc_feature (B) LOCATION 1...872
  hypothetical: YES
GEIMRVRETTRRKDKRFNLEKNRYLSHFYRYTPSGEELPEKHDKRISQKIFYSGLAYLPLNYVVTRIPEAFHRFEIIPGSLQGVNIFQLQEMPQLFHFDSTGFWNPLTPTTSLGTRLVVSTICVVPAVLMGLKMDMWFRPLADGQKGDNRLKTLKEIQQIYPQIPESKGGFPGYGGIPITHYKKYWYIQTDTVNTCIVGTSRSGKGQIEVLATIDNLSRAERQSSMVVNDPKTELYVASKDELEARGYDVYAFNITDPLQSMSDNPLALIVKYWKRGDIDTATQLTNTFTNTIYYDANASDNKYFNENAQKAVNALIFALLEQADQTGDYSKLTPNNLVELLSEIGGFNYQDPDNEFKQLNALDEFMNQLPPGNIAKKQYGATKIGSDKAKGNILSTAITGLNPFTLTKIAKMTSQSTIDYKSIGFPKYLDLKLHESLLNQRIVVEFYHQGKKFHEERVKVGYRGFCEINFDCHLEQGDHVCLKYDHRGKEYVAWYEFSQRVLKDEEGNIVYRKKRGETHLPELEKEAVLTLDEDKSNLLVESIRMHYTDKPMAIFMLTPDYDPSNHIIVSIFLSQLYKELSTQCVKTKGDKCHRRIHFILDEFGNMPPMDNMEGIMTVTAGRNMLWDLFIQSYQQLYAKYGEQNAAIIKENCQTHIYIMSTDDNTIEEFSKKVGNKTVEQENSTINSLGMNTHINRNVDSDRILTPERISTFLEGETIVLAPLKRQDLKGHKIRPYPIFNHGETNLPYAYQYIEDFNPSWDINDIDIHCTHADLDLKALQIDYDYFLPDIYARRLYHNMHDQIEEEAKENIFIKIVQSLDNSTAQKLLIQFYEEKQIDRLQEYLEKLRQNEEITEVIRKRLLLEAEKAVKE

SEQ ID NO: 6669 - protein, 107 aa, Enterococcus faecium
  misc_feature (B) LOCATION 1...107
  hypothetical: YES
EEIIMESTQNKAIEKVLSTILTEDTAAELANLEGKALEETFECLYEQMDYQKLLPQEPTVSGVLRGLNDLVQAEFKERLSIEEYQEILYQQVELLASLLGLELEDVE

SEQ ID NO: 6670 - protein, 234 aa, Enterococcus faecium
  misc_feature (B) LOCATION 1...234
  hypothetical: YES
RRIIVMERLQKVIAHAGIISRRKAEEFILAGRVKVNGQVVRELGIKVGKHDTVEVDEVPIYQEEYGYYLLYKPKGVISAVADDKGRKVVTDLLPMVKERIYPVGRLDYDTSGILLLTNDGDFAQRLTHPKHEVDKVYVAKVKGIATKSMLAPLTKGIKIEGRKTSPAKFQILSVDPKTNHSIVELTIHEGRNHQVKNMLQAVGLPVQKLKREKYGDLTLQGLRPGDYRELNKKE

SEQ ID NO: 6671 - protein, 105 aa, Enterococcus faecium
  misc_feature (B) LOCATION 1...105
  hypothetical: YES
GVIIMNDFSKDAKIFKALCDTKRLTILDYLKSGEKCACVLIENMNIGQSALSYHMKILCDSGIVNARQEGKWTHYSLSKSGSEYASKRLLELTTPNAENQSICCK

SEQ ID NO: 6672 - protein, 186 aa, Enterococcus faecium
  misc_feature (B) LOCATION 1...186
  hypothetical: YES
MRIISGNYGGRRLKSLAGANTRPTTDKVKESIFNMIGPYFDGETVLDLFAGSGGLAIEAVSRGCSHAVCVDKNYQALKIIKENIEITKEPEKFTTIKLDADKAIERLAAEKQQFDYLFLDPPYAKQKIIDQIHKMEELGLFSKTAVIVCETDKTVELPETVAGFHQIRKQIYGITAVTIYRKEGNQ

SEQ ID NO: 6673 - protein, 278 aa, Enterococcus faecium
  misc_feature (B) LOCATION 1...278
  hypothetical: YES
IGVIFSVCYNLSCSESNNYRNFSDFFRFVEKERSFLMPTGVLINVGSVLFGGLIGGLVGNKLSEHFKAQLTMVFGVCSMGMGIYSIAPMKNMPAVIFALVIGTAIGLIVHLGNGINKGAALMQVPISKIFPSEKLGMTHDEFISTLVTVIVLFCASGTGIYGSLDSGMTGDSTILISKSVLDFFTAAIFACNLGYVVSVIAIPQFIIFYILFLLAKFIYPLTTPDMILDFKACGGFLMVATGFRMINVKMFPVADMIPAMIVIMPLSWMWTNWIMPLL

SEQ ID NO: 6674 - protein, 65 aa, Enterococcus faecium
  misc_feature (B) LOCATION 1...65
  hypothetical: YES
AIVIPYLFETLQTESPALTVYFVPEAVLEELELDELEPLVFPVFEPVFAPALEEPPFDTISCCPG

SEQ ID NO: 6675 - protein, 1027 aa, Enterococcus faecium
  misc_feature (B) LOCATION 1...1027
  hypothetical: YES
GGVIVRNKFHKLLSMFLVMLIVINQFGNITVLAESLAEQPERSLTIEVDQEEAALGEQFQLRVRGTPDLLNALVIDKSEDLIEGEVKQLNDYERLITYSSQHSGKYELTARSGDIQSNTVSIEISVPEESTSESFNVPEESTSESFNIPEESLSESFNEARSSEPSITQESQIERQEELLNYDIGISAERPTLPSRHTQTLKGYIQGGAGDILEEYGEMVVRVPRASIGLIEFIRVEVADDSPLKPLAFYQEGTDVVFPFTFDYEGLNEAAQSYTFSITFEVAFFQSGGTEPNNDFQVSLTYAERAANTEFSITPIPSSRPIFSKLYYGSREIDSQGNLGNLLIDGQDVTNSNKFILQVNYEGSRKDGVVVTDVLPQGTTLAPNPTTWSSTGNREPISGGVRIAEVTNPGEANVRTHYVSEEFVDKVSFNKETNTLVVDFGNLAEGQSYFIEYALEVTDVDLFNEGRQEDGFSRNRASMTYNNQVMSRDYRLRIPESNLPAISLRKSVDKNVINLNENELTYTLHVSMFSGTRNTLVIEDVLEEGMEFVSFLSDIPSFIDAEVNNGIVRFSANNTIGGPTSFTLSFKVNVEAYAVGDQILNFATLVNSDNRLNTSTVRTRKIDGRIKVIKTDENGQRLAGAKFEILSSDSQVIQEGITAENGEFLSEPLPVGSYQVRETEAPEGYLLDATVHDVFINEYSIEEVTLTIENILDTGGVELIKHAEGSGEVLQGAVFELQNREGETLQTGLTTGEDGKLAIDGLAPGAYQLVETQAPIGYELDATPIEFEIERSQTAVVELTKENRLTPGGVVLTKIDDQSGEILQGAVFELQNREGETLQTGLTTGEDGKLAIDGLAPGTYQLVETQAPIGYELDATPIEFEIERSQTAVVELTKENRLTPGGVVLTKIDDQSGEILQGAVFELQNREGETLQTGLTTGEDGKLAIDGLAPGAYQLVETQAPIGYELDATPIEFEIERSQTAVVELTKENRLTPGGVVLTKIDDQSGEILQELFLSYRTEKEKRYKPV

SEQ ID NO: 6676 - protein, 62 aa, Enterococcus faecium
  misc_feature (B) LOCATION 1...62
  hypothetical: YES
EVVINQEVVIFLSLHNNIIDNSKKQNATDFSVAFRLYYSNQIWIGKPNANSEASMTISPRDG

SEQ ID NO: 6677 - protein, 84 aa, Enterococcus faecium
  misc_feature (B) LOCATION 1...84
  hypothetical: YES
LPVMLVHRKPSVNWKMRAQMQQKSGLVQEKYVLQKSRQALGLEAGNWQLLDGVRKQLASRSSLTVGSEHMAILQNLSVLVRQWS

SEQ ID NO: 6678 - protein, 201 aa, Enterococcus faecium
  misc_feature (B) LOCATION 1...201
  hypothetical: YES
LQSFGGAKVSDKIGVIENLIPKADKILIGGGMTYTFYEAKGIKIGNSLVEADKVELAKELIEKAGDKLVLPIDNVCAPEFSNDVETQVIEGDIPDGLMALDIGPASVKLFADTLQGAKTVVWNGPMGVFEMSNFAKGTIGVCEAIANLEGATTIIGGGDSAAAAEQLGFADKFTHISTGGGASLELLEGKELPGLAAINDK

SEQ ID NO: 6679 - protein, 104 aa, Enterococcus faecium
  misc_feature (B) LOCATION 1...104
  hypothetical: YES
KNSIATRVTKIFDSIVISSSSFLMSFIFLLLIIVLDKDVFLFYLPLKTNNIGTKNKEKPLETSVSNGFLASQEGFEPPTVRLEGGCSIQLSYYDKNQRNINNYR

SEQ ID NO: 6680 - protein, 1183 aa, Enterococcus faecium
  misc_feature (B) LOCATION 1...1183
  hypothetical: YES
IDSIEEGGKGMDIIQLVGKDPQVKEWVSNLEEKMPRQLITGLAGSAKTLLFARAFKKTNKNMIILMPNLYYANQLAEDLQHVIPQDQIHLFPVDEVLSAEMAFSSPEARGERVATLNALQEKKAGIYLLPVASLHKRLPNKKTWLQAQLNWHIGDEIDVENLPRQLTLMGYVREEMVAKPGEFSIRGSIIDIYPLTTTYPVRVELFDVEIDSMRYFEAETQRSIEKTEEIWVSPTSEQVYGPEDLEHGIEQMQKMLEKRLAATTEEADREFLQDYFGQLTSSWQAGVPTEEAKFYSDLLYQESVTILDYFPSNSLLVVDDYQRIMETNREIEREAAEWQTQKISELRVFSEQTFSADIQKIVQKEKFTTTFFSLFQKGMGNLRFQAIHNFQYRTMQQFFGQMPLLKTEMDRWRKQKQTVVIFIPTKDRIRKAEQMLRDEDILVVETEKNALIRGQVQLVEGALQAGFELPQEKIVAITEKEIFQKTTKKQTRRQTVTNAERLKSYNELKAGDYVVHANHGIGKYIGMETLEVDGVHQDYMTILYQNDDKLFIPVTQLNLIQKYVASEAKAPRINKLGGSEWTKTKRKVSSKIEDIADDLIKLYAARESEKGYAFGPDDAYQKEFENAFPYSETDDQLRSAAEIKRDMEKEKPMDRLLVGDVGYGKTEVALRAAFKAIKESKQVAFLVPTTILAQQHYETMLERFEGFPVNIGLLSRFRTRKQQKETIEQLRTGQVDIVVGTHRILSKDIEFSDLGLLIIDEEQRFGVKHKERLKQLRAQVDVLTLTATPIPRTLHMSMLGVRDLSVIETPPANRYPIQTYVMEKNPGAIREAIHREMGRGGQVFYLYNRVETIEQKVEEIQELVPEARIGYAHGQMTEAQLENTLFEFIEGQYDVLVTTTIIETGVDIPNANTLFVENADYMGLSTLYQLRGRVGRSSRVAYAYFMYEQQKILNEVSEKRLQAIKDFTELGSGFKIAMRDLSIRGAGNLLGAQQHGFIDAVGFDMYSQMLSEAVSRKQGKNSQVEKTTVEIDLGVDAYLPETYVADQRQKIEIYKRIRELDSQEMLDELEDDLLDRFGEYPEEVAHLLTIGQIKMDGDRALLETIRKQEAHIVFTLSKVGTKRYSVEQLFEALTATKLKASLGVEKEQMVIRLTIPNQMEEAVWLQEIQKFVKALREQKYLSA

SEQ ID NO: 6681 - protein, 199 aa, Enterococcus faecium
  misc_feature (B) LOCATION 1...199
  hypothetical: YES
EISMTQEIKKLPVIFLGLFFITVGLNWFLLPHDIASAGVGAIGHLVETAFSIQRSVTVWSINLMMLLLAAVLLGKSVFFKTVAGSLLFPVVLEIVPKVEMISSHFFSLISGSLLFSLGVYTLYTVGASNGGITIPPIIFHKFFRLPMPQGLLLTNSLIVFLNYYVFGLLETLFVLLSITVSSLFMKILIRLSPVSRKFE

SEQ ID NO: 6682 - protein, 77 aa, Enterococcus faecium
  misc_feature (B) LOCATION 1...77
  hypothetical: YES
YVSIIRIVHTFEIIKKNEGIYKCKLPRKDCINDNQRSILGWVSKLECCNSISLFQGKNLLNSNQLLWPKSNFSYLFE

SEQ ID NO: 6683 - protein, 138 aa, Enterococcus faecium
  misc_feature (B) LOCATION 1...138
  hypothetical: YES
EKSMSYRVQLIISEDVESQQFGTNVINKVINPALSINAPLIPTALSFSVTAVVSEIEDTEKIKIVEIEVLNKNEKQIFSTGEVSVSLPPQVNDINFNINARNVLVEEAGEHYAVVKFNGTEIGRQIFDIKVNKPVEKN

SEQ ID NO: 6684 - protein, 349 aa, Enterococcus faecium
  misc_feature (B) LOCATION 1...349
  hypothetical: YES
GESIMAKELKFAEDARAAMLRGVDKLADTVKVTLGPKGRNVVLEKSYGSPLITNDGVTIAKEIELEDHFENMGAKLVSEVASKTNDIAGDGTTTATVLTQAIVREGLKNVTAGANPLGIRRGIELATKAAVEELHNISTVVDSKEAIAQVAAVSSGSDKVGHLIADAMEKVGNDGVITIEESKGIETELDVVEGMQFDRGYLSQYMVTDNDKMEAVLENPYILITDKKISNIQDILPLLEQILQQSRPLLIIADDVDGEALPTLVLNKIRGTFNVVAVKAPGFGDRRKAMLEDIAILTGGTVITDDLGLELKDVTIENLGNASKVVVDKDNTTIVEGSGEKEQSKLVCN

SEQ ID NO: 6685 - protein, 130 aa, Enterococcus faecium
  misc_feature (B) LOCATION 1...130
  hypothetical: YES
SESIRKRWKQMLTKKELIDHINETYNLSPEYIFKKFPDYCVFRHQKSKKWFGVLMSVPEEKIYDDASDHRIINILDLKVDPELGGILRGKEGYFPAYHMNKEHWISIDLRKIEKLDELADLIDGSFKSTQ

SEQ ID NO: 6686 - protein, 303 aa, Enterococcus faecium
  misc_feature (B) LOCATION 1...303
  hypothetical: YES
ARSMNKKEIAVVASCNTKFVPHLAALFVSVLDNCNPSKFVRFYVIDDDIDFESKQLLRFSVKNARMNSDVEFLKINKEFFTNVVISDRIPETAYYRIAIPELFRGTEVERILYMDCDMIALQDISKLWRLDFGDSIVAAVEDAGFHQRLEKMKISAKSMRYFNSGLMLINVKKWLDENITQKVLDFIEHNPEKLRFHDQDALNAILHDRWLPLHPRWNAQGYIMAKAKKHPTAAGEREYEETRNNPYIIHFSGHVKPWSKDFEGPTKKYYEKYAGMTAFRCVAKFPKYPKYAKVQPKTDVVVK

SEQ ID NO: 6687 - protein, 495 aa, Enterococcus faecium
  misc_feature (B) LOCATION 1...495
  hypothetical: YES
DMSISQTICDFATLAIEAGGWMEMDRLYLQNRLLGMIGEDALESVEVRPVKEESVDLLDRFVAKARENGVLSELPAEQEIFEAQLMDFLTPPPSVVNAFFAQHYSKSPEEATDYFFDLSKKNDYIKTRAIAKNIKFPAESAYGELEITINLSKPEKDPKQIAAEREAAKVDYPTCMLCMENEGYRGRLNYPARTNHRIIRMNLDGESWGFQYSPYAYYNEHSIILSEQHRPMKISKETFVRLLRITEVLPHYFVGSNADLPIVGGSILSHDHYQAGRHEFPMAKAPIEKLIKLADYPQVIAGVVKWPMSVIRLQSTDKELLIEAANSVLEKWKEYSDETVEIRAFSADGTPHHTITPIARRRDNYFELDLVLRDNNVSDEHPDGIFHPHKDVQHIKKENIGLIEVMGLAVLPPRLKPELAEVERFLLGEENQMAEYHRPWAEQLKKEHPDLTKDAVTDVVQKAVGQVFARVLEDAGVFKRDEKGQAAFERFTAIL

SEQ ID NO: 6688 - protein, 120 aa, Enterococcus faecium
  misc_feature (B) LOCATION 1...120
  hypothetical: YES
SRSIRLRLKSNYCHPLMKAPIIFQYGYLRLMAKRCGLLKNYDEKLHALVVTQLTGDTDIKEGDVVQTSGLGGNSPDNLPIGTVIKTKPDSYGLDREVYVKPYAEMYDVSVVTIVQRLAED

SEQ ID NO: 6689 - protein, 569 aa, Enterococcus faecium
  misc_feature (B) LOCATION 1...569
  hypothetical: YES
TMSFDGVFTHAMVNELRETLLSGRISKIHQPYENEIVLVIRSRGKNHRLLLSAHPSYARVQITQIDYQNPDNPPNFVMMLRKYLDGAILEDIEQIENDRVIHFHFAKRNELGDLQNIILIVELMGRHSTIVLVNRETGKILDAIKHIGSSQNTYRSLLPGVEYVAPPKQEVLNPFSSEKEKIFQRLSQTELDPKAIQRQFQGIGFDIAQELTKRLLERPNEKMVVWDEFFSAISHQPIPTFYETENKDFFTPIAYQVLSEQASAVTAYPTLSQLLDSYYHEKAEKDRAKQQGGELIRKIENELKRNKNKLKKREQTLKESENAENYRRNGELLTTFLTQVPRGAKEVVLPNYYEEDRPIKIALDPALTPNQNAQKYFHRYQKLKNAVKLIGEQIQEAKDEIQYLESVLSQLEIAGPMDIEAIKEELTSEGYLKKKNLKKQKRKKPSQPDQYFSSDGTLILVGKNNLQNDQLTMKTAKKTDYWLHAKNIPGSHVIIKSDKPSDETITEAAELAAYFSKYRYSAQVPVDLVQVKHIRKPNGAKPGYVIYENQKTIIVTPEEEKITAMKQNR

SEQ ID NO: 6690 - protein, 122 aa, Enterococcus faecium
  misc_feature (B) LOCATION 1...122
  hypothetical: YES
FPPICGPIMAIPWTTFAQYAASKGGVKLFTETVAMEYAPKGIRINSIGPGAIRTPINAAKFDDPEQKELLESMIPLGRVGEPKEIAATAAWLASDESSYVTGITLFADGGMTLYPSFQGGKG

SEQ ID NO: 6691 - protein, 403 aa, Enterococcus faecium
  misc_feature (B) LOCATION 1...403
  hypothetical: YES
RQPIHRKEDFPMNDFTTEIVQTLVTKGDLNELFRSHLEKAINTLLRTELTAFLDYEKYDRTGFNSGNSRNGSYFRSIKTEYGELTLEIPRDRNGEFKQQTLPAYKRTNDTLETTIIHLFEKGVTMSEIADLIEKMYGHHYTPQTMSNMTKVLTEEVNAFKSRALNDKYVAIFMDATYIPLKRQTVSKEAIYIAIGIREDGTKEVLSYAIAPTESTYVWNELLQDINSRGVQEVLLFITDGLKGMKDTIHQIYPKAKYQHCCIHVSRNIAHKVRVKDRKEICDDFKAVYQANSKEEANTFLSGMIEKWKKNYPKVTQSLIENQDLLTFYDFPPSIRRTIYSTNLIESFNKQIKRYSRRKEQFQNEESLERFLVSIFDTYNQKFLNRSHKGFQQVTDTLVSMFTE

SEQ ID NO: 6692 - protein, 377 aa, Enterococcus faecium
  misc_feature (B) LOCATION 1...377
  hypothetical: YES
RQPIHRKEDFPMNDFTTEIVQTLVTKGGLNELFRSHLEKAINTLLRTELTAFLDYEKYDRTGFNSGNSRNGSYFRSIKTEYGELTLEIPRDRNGEFKQQTLPAYKRTNDTLETTIIHLFEKGVTMSEIADLIEKMYGHHYTPQTMSNMTKVLTEEVNAFKSRALNDKYVAIFMDATYIPLKRQTVSKEAIYIAIGIREDGTKEVLSYAIAPTESTYVWNELLQDINSRGVQEVLLFITDGLKGMKDTIHQIYPKAKYQHCCIHVSRNIAHKVRVKDRKEICDDFKAVYQANSKEEANTFLSGMIEKWKKNYPKVTQSLIENQDLLTFYDFPPSIRRTIYSTNLIESFNKQIKRYSRRKEQFQNEESLERFLVSIFDT

SEQ ID NO: 6693 - protein, 202 aa, Enterococcus faecium
  misc_feature (B) LOCATION 1...202
  hypothetical: YES
RQPIHRKKDFPTNRKSLRNCATLVTKGDLNELFRSHLEKAINTLLRTELTAFLDYEKYDRTGFNSGNSRNGSYFRSIKTEYGELTLEIPKDRNGEFKQQTLPAYKRTNDTLETTIIHLFEKGVTMSEIADLIEKMYGHHYTPQTMSNMTTVLTEEVNAFKSRALNDKYVAIFMDATYIPLKRQTVSKEPIYICLLCYTRRRH

SEQ ID NO: 6694 - protein, 132 aa, Enterococcus faecium
  misc_feature (B) LOCATION 1...132
  hypothetical: YES
RQPIHRKEDFPMNDFTTEIVQTLVTKGDLNELFRSHLEKAINTLLRTELTAFLDYEKYDRTGFNSGNSRNGSYFRSIKTEYGELTLEIPRDRNGEFKQQTLPAYKRTNDTLETTIIHLFEKGVTMSEIADLI

SEQ ID NO: 6695 - protein, 403 aa, Enterococcus faecium; identical to SEQ ID NO: 6691
  misc_feature (B) LOCATION 1...403
  hypothetical: YES

SEQ ID NO: 6696 - protein, 403 aa, Enterococcus faecium
  misc_feature (B) LOCATION 1...403
  hypothetical: YES
RQPIHRKEDFPMNDFTTEIVQTLVTKGDLNELFRSHLEKAINTLLRTELTAFLDYEKYDRTGFNSGNSRNGSYFRSIKTEYGELTLEIPRDRNGEFKQQTLPAYKRTNDTLETTIIHLFEKGVTMSEIADLIEKMYGHHYTPQTMSNMTKVLTEEVNAFKSRALNDKYVAIFMDDTYIPLKRQTVSKEAIYIAIGIREDGTKEVLSYAIAPTESTYVWNELLQNINSRGVQEVLLFITDGLKGMKDTIHQIYPKAKYQHCCIHVSRNIAHKVRVKDRKEICDDFKAVYQANSKEEANTFLSGMIEKWKKNYPKVTQSLIENQDLLTFYDFPPSIRRTIYSTNLIESFNKQIKRYSRRKEQFQNEESLERFLVSIFDTYNQKFLNRSHKGFQQVTDTLVSMFTE

SEQ ID NO: 6697 - protein, 403 aa, Enterococcus faecium; identical to SEQ ID NO: 6691
  misc_feature (B) LOCATION 1...403
  hypothetical: YES

SEQ ID NO: 6698 - protein, 403 aa, Enterococcus faecium; identical to SEQ ID NO: 6691
  misc_feature (B) LOCATION 1...403
  hypothetical: YES

SEQ ID NO: 6699 - protein, 79 aa, Enterococcus faecium
  misc_feature (B) LOCATION 1...79
  hypothetical: YES
RQPIHRKEDFPMNDFTTEIVQTLLTKGDLNELFRSHLEQAINTLLRTELTAFLHYEKYDRTGFNSGNSRNCSYFRSIKT

SEQ ID NO: 6700 - protein, 403 aa, Enterococcus faecium; identical to SEQ ID NO: 6691
  misc_feature (B) LOCATION 1...403
  hypothetical: YES

SEQ ID NO: 6701 - protein, 122 aa, Enterococcus faecium
  misc_feature (B) LOCATION 1...122
  hypothetical: YES
RQPIHRKEDFPMNDFTTEIVQTLVTKGDLNELFRSHLEKAINTLLRTELTAFLDYEKYDRTGFNSGNSRNGSYFRSIKTEYGELTLEIPRDRNGEFKQQTLPAYNRTNDTLKANVFTKVRXH

SEQ ID NO: 6702 - protein, 153 aa, Enterococcus faecium
  misc_feature (B) LOCATION 1...153
  hypothetical: YES
RQPIHRKEDFPMNDFTTEIVQTLVTKGDLNELFRSHLEKAINTLLRTELTAFLDYEKYDRTGFNSGNSRNGSYFRSIKTEYGELTLEIPRDRNGEFKQQTLPAYKRTNDTLETTIIHLFEKGVTMSEIADLIEKMYGHHYTPLTMFNNDKSSD

SEQ ID NO: 6703 - protein, 352 aa, Enterococcus faecium
  misc_feature (B) LOCATION 1...352
  hypothetical: YES
ATPMQVESIDPRKKKKKKKKKKKKKKKTLGILGGLAACGNGNSSAEGEADEGKTLTVSVDSGYKDYINEIKNTFEKENDVKIKLVEKDMFDQLESLALDGPAGKGPDIFIAAYDRIGALGQQGHLAEVKLGNEAAYDETDKAQVTYDGKIYGEPAVIETLVLYYNKDLVDTAPSTFKDLENLSKDSRFAFESEAGKNTGFLAKWTDFYYSYGLIAGYGGYVFGDDGTNPSDIGLNNAGAVEGISYATDWFKNVWPKGMQDIKSAGDFASQQFMSNKTAAIIDGPWQAQTYKGNNINYGVAKIPTLNNGQPYQPFGRRKKDGMSANYAKNKELSPKWLDYVTNQENQENSLKW

SEQ ID NO: 6704 - protein, 70 aa, Enterococcus faecium
  misc_feature (B) LOCATION 1...70
  hypothetical: YES
VQPIQKQEKLFLLGYSYYLLQGSFFTTSPLNGVLLPTPRSQVTIFNKHEKLFFEIVPCDSELNGRLTTSW

SEQ ID NO: 6705 - protein, 111 aa, Enterococcus faecium
  misc_feature (B) LOCATION 1...111
  hypothetical: YES
SLTIWMENTLQRFVRCSMANEHYFYVLFCKDQTFYGGYTTDLSRRLEEHNNGTGAKYTRLQKRRPVKMIHAEVFSSRSEATKAEAAFKKLTRKQKERYLQTHSTVLLPESI

SEQ ID NO: 6706 - protein, 249 aa, Enterococcus faecium
  misc_feature (B) LOCATION 1...249
  hypothetical: YES
MDTIRNYLDSHFIGVPQSTEIDKLKTDLLANMEDHYHELMGEGKNEQEAIGTVISTFGSIDELLEELDVEKKHQADETETNTASIYLSEAENYWKEYRAASLQVASGVLFISLSFASFLFFCSAGYVFMGISCLIFGIALAVGFFIASGMKITRLNHFLHHRKIPEKVLAEAKEKEEEYQRSFGFSLIAGIGLCIFSLFPLLASLMWYMDGSIGASIFFVTVGTGVFLIIYGSLVRHSYRQFTQSAYYW

SEQ ID NO: 6707 - protein, 68 aa, Enterococcus faecium
  misc_feature (B) LOCATION 1...68
  hypothetical: YES
IGTIELDRKNKVCRLLKNTLEDFSCQDFNEEPIQKNSTNKSSISISMVSLAQKLFESMSLRLLLSING

SEQ ID NO: 6708 - protein, 137 aa, Enterococcus faecium
  misc_feature (B) LOCATION 1...137
  hypothetical: YES
KYEKEPKKKKKKKKKKKKKKLVKIAYVEQKADIDFTFPIKVKECVSMGTYAGMKVFQRIKNAEWQRVSKALEKVDMGKYSNHQIGELSGGQFQRVLLARCLAQNADFIFLDEPFVGIDLVSERIIMDTLKELKHQGE

SEQ ID NO: 6709 - protein, 437 aa, Enterococcus faecium
  misc_feature (B) LOCATION 1...437
  hypothetical: YES
KITMEVEVQRMKKRMRIILALSVMLFFLTACGQEDDKKITLNMAWWGSQVRHDATVKVIELYEEKNPHVTIDYEFYDYEGYYTKLGTLAASDDIWDIFQLNNQFPQYINQIEPLDEYVEQGIIDISNADESYLATTTYDGQLVGLSNGVNSFAIAYNKNIFEQLNIPEPASNWTWDEFEQISYQITEELGIYAISRFEDFIAGCIIQIPQVEKGLNFYNREDLSNSLGFENPDYLTDFFQLRKNLVDKGAHPEPGGGAASTTDLSFQAVRDREAAMVFLSSNQLTEILSGAPEDMEIQLINPPRRKADGESGIPLRSSQMLSMAKSSAHKEEAAKFIDFFQNSEEANEILKGERGVPIMSNIREQLARADDATLQATFDYLEMISDMDNGEVNVFDSALNPEIQDQYNLLVEKVIYEEVTAEEAAESLYEFASNILG

SEQ ID NO: 6710 - protein, 214 aa, Enterococcus faecium
  misc_feature (B) LOCATION 1...214
  hypothetical: YES
LKTINKYRKEVRRMTTMKTFLAVKNEGAVPQIFIQGFIGSSWFFEGNTDKGIKNILDSLGDQEEIEVVINSNGGDVFQGIAIGNLLKSNKAKVNVVINGLAASAASIIAMAGDTIKIYNNAQLMIHRASTYGEGNVDDFRTIADQLESIDKSVKASYKTRFNGTDEALQELLEKESFMDAETALSYGLVDEIIDAENSSGTEAKKEQSVEEIVE

SEQ ID NO: 6711 - protein, 343 aa, Enterococcus faecium
  misc_feature (B) LOCATION 1...343
  hypothetical: YES
GKTMIVIMKKEATEEQIKKVVDHIEKEGFKVSIDQGTERVVIGLKGDTRSLQEGAFTRYEGVENAVRILNTYKLTSREFHPGNTVVDVDGVKIGDGSFVTMAGPCSIEGLDQIRECARMAKAGGAKILRGGAFKPRTSPYAFQGLEEEGLKYIRQAADEFGMKVITEVMDEGHIDMVAEYSDILQIGARNMQNFKLLSAVGKTGKPVGLKRGISGTINEWLNAAEYIAVEDKSPVIFIERGIRTYETATRNTFDLSAVPLMKKLTHFPVIVDPSHGTGIWELVPPMARAGVASGADGMIVEIHPDPANAWSDGPQSLNEKTYSRMMKEVAIMKEAMEKIQTLD

SEQ ID NO: 6712 - protein, 90 aa, Enterococcus faecium
  misc_feature (B) LOCATION 1...90
  hypothetical: YES
GCAISYAFCASCKLLLHIRSLFEWSFYFCTKEETTMYRPQYLEQKYEVITVHKGNGEKVYEYRRPIKSDTYKRKENNEVIPLYGKRIAKH

SEQ ID NO: 6713 - protein, 426 aa, Enterococcus faecium
  misc_feature (B) LOCATION 1...426
  hypothetical: YES
TTAMKQSCRKSCYADTDFSRKDKGIMKYQKIKEALQALQEGKLVLVMDDKERENEGDLICSAQFATTENVNFMATYAKGLICMPMSESLANRLMLSPMVEDNTDNHETAFTVSIDYKDTTTGISAEERGLTARMCVTENVNPFDFRRPGHMFPLIAKNGGALERNGHTEATVDLLRLAGLKECGLCCEIMNENGKMMRTPDLIQFSQTHHIPTLTIKELQEYRKVYDLLVECVSVVEMPTKYGNFKAHCYINKLNGEHHVALVMGDLNNGNDVLCRVHSECLTGDAFGSLRCDCGQQLDKAMKMIAENGSGVLLYMRQEGRGIGLVNKLKAYHLQDNGMDTLDANLALGFQGDLREYYIGAQILRDLGIKSLHLLTNNPDKVYQLEDYGMKISSRVPIEIEANPYDSFYLKTKKDRMGHILNMEEK

SEQ ID NO: 6714 - protein, 317 aa, Enterococcus faecium
  misc_feature (B) LOCATION 1...317
  hypothetical: YES
AAAIGFIKVAAVFLNKKVKKMKKKIGNRPQTQISLLLQLFMAVMFLAGAAVFTYPFLADALSNYLDQRRIENYQKQLERDKEEKHEQQLAVHEKKNQTLAHTSVIPGMGQVKDPFEQAVRNVQNPGKEYYEQHMIGAIYIPKINVSLPLFDETNDLLLDRGATVLQGTSFPTGGESTHSVITAHSGIAEKKLFTDLEEMEQDDRFYLEVYGRMLAYEVVEKIVVLPTKTNTLAIREKQDLVTLITCTPYTVNTHRLLVTGRRVPFTEEVSSKIEQTKKYHLYRLLILLLGILLVLTLFGYWCYRKFKRQKQRKKNNR

SEQ ID NO: 6715 - protein, 660 aa, Enterococcus faecium
  misc_feature (B) LOCATION 1...660
  hypothetical: YES
KMAINRYVKKAGMLVGMLGIIAGCFQGYRAYAEDVTQKTPPEKVNITVHKLMYDQGTQLNVDVDGIKNDGYTHDQYPTGVTKYNKADYGDVEFTLGNITDQVLPREDSDLTNAKVDEIVKDVEDKGSNSEYVKNATNKITSAVDENGEITFADQPAYVNNSKGNVYVVYESKSAAGLVTQKAKPMVVIAPMTDNTGSGFLKDIHLYPKNIVSKLSFELTKFGDDGTAQSKQTPLKGAKFELYKGEPGKGTKLGDLVSDDQGKLTATDLTLGKYYFVEVPSEVVVGSDKEPTADQYLLGADARNDAHNKLTFEITNDGVTSDLKASYVNYKAPVIDKTVTNGTGQEHSFQIGDAVNYQGTIHIPTDIAGGADGITVNGVKSETSPYSVFKWGDTAGQGLSYVAAKANIKVTNKDGSVVLKENTDYKIQNSENGFVIDFIVNNGQVSDTVASLHGQDLQMTYNMYVNDSAAVANPLTNSVDFVYNNNPFNQEEHHEKTKADVVTYGAKFLKVDSGLFGTGIKATPLESAEFAAKNAEGKYYGGLVDTDKNGVKEAVWVDDVANAAILKSDKEGHFEITGLTEGEYSLEETKAPENYQKLTKEISFKVDKDSYKEENRITIKNNQKASVPMTGSNGFQTYVLISCLLLGAGALSAVVYFKKKA

SEQ ID NO: 6716 - protein, 265 aa, Enterococcus faecium
  misc_feature (B) LOCATION 1...265
  hypothetical: YES
LEAIHMFNLLTAEKIKVWKSRKMWVSLGLMVVLPLFYSWNEWYMHTKYGNELNQATDTVINGATGILMVEKMAAWILLAFAAFACFYIGEEFQNGTIRNTLSLGRNRMTYYVSKLLVTLLITTLGVVLITGLAMIAYTLAFGFGEVEGIKNYGNYVLKVFPVLLLLILATLSVPVALTFITRSTSVSLLLSFLYIMGTAFVPGVFAKIKGLEFLTEWFTETWLMYTDFAQQATYSQAPKMILVSLVTIVVSSALGMFIFQKSDIK

SEQ ID NO: 6717 - protein, 130 aa, Enterococcus faecium
  misc_feature (B) LOCATION 1...130
  hypothetical: YES
LWAIKERRKSMQEQSVMEIIKWFIGLMMIMAMVSIGLFCVQLQDINTFKQQVNYQIERKGGLTTEAVEAIDKYSATNYDRRFTIESDKLNQKVSYGEEIDYTIKATIPIQILPLPDVTLSFNGNSVSQIR

SEQ ID NO: 6718 - protein, 69 aa, Enterococcus faecium
  misc_feature (B) LOCATION 1...69
  hypothetical: YES
MDVLREYSSLFTEAYLLEQFGYKIPFADYQQGVGTAAELSFYEGISQAVGRPVDAEHFEQRISSTGKSE

SEQ ID NO: 6719 - protein, 66 aa, Enterococcus faecium
  misc_feature (B) LOCATION 1...66
  hypothetical: YES
LFQIPMFQGFGYSFYHLIFHYEKRAVPDIRYAAFLNKLLCTKNEIFSSTIFLNSKYSLPKAHTSCW

SEQ ID NO: 6720 - protein, 183 aa, Enterococcus faecium
  misc_feature (B) LOCATION 1...183
  hypothetical: YES
VLQMKLDKYTVGRRYGKALFELAIDSNKAEEIYQDLVSLRQIYEQVPGLGNMLSDVRLEPHEKREIMDKLVSGYDGIVKNFLEVVYAYNRMDDLLFMIEEYERRYDEHQGLLLGSVTTAVPLSDEQRIQLEKNVAKTMNYQSVELKQIVDSSIIGGAIVEANHRVIDGSIRTQLENMRNQLNR

SEQ ID NO: 6721 - protein, 110 aa, Enterococcus faecium
  misc_feature (B) LOCATION 1...110
  hypothetical: YES
TYQIKDFFGGITMKEYIKNIYFIEETQNIEGSYIEVKTLFVNEDKTKALDIYKKLASKKTNSFGLILSEYKIKAEESYFYQLLKRWSKLPADFYRKMQIINYQPLAETHA

SEQ ID NO: 6722 - protein, 249 aa, Enterococcus faecium
  misc_feature (B) LOCATION 1...249
  hypothetical: YES
NYQIRKRSENMGRKWANIVAKKTAKDANNSRIYAKFGIEIYAAAKSGDPDPHANQKLRFVIDRAKTYNVPKHIIDRAIEKAKGAGDETYSELRYEGFGPSGSMVIVDTLTNNVNRTAADVRAAFGKNGGNMGVSGAVSYMFDNTAIFAFAGEDADEILEYLMEKDIDVRDVMEEEGQIIVYGEVADFHSIQEALKEKGITDFSIAEIQMIPQNEVTLSPEDQETFEKMIDALEDLEDVQHVFHNVALED

SEQ ID NO: 6723 - protein, 64 aa, Enterococcus faecium
  misc_feature (B) LOCATION 1...64
  hypothetical: YES
EYQILSRMLLLKINIQTNGIHHAKKARQPKSLRVSCLSKVYLICSFKKNDTHTDFSEQRLSQRL

SEQ ID NO: 6724 - protein, 312 aa, Enterococcus faecium
  misc_feature (B) LOCATION 1...312
  hypothetical: YES
QNQMKKLILTETRKAEMRLTDFSAIHLPAVEKEILSFLDEHTTDRGLYDAMSYSVKAGGKRIRPLLLLTAVASFDEPIDVPVYQVAAALEMVHTYSLIHDDLPAMDNDDLRRGKPTNHKVFGEALAILAGDGLLTGAFQLISMAHLGNSPKLLLLQQLAVCAGSQGMVAGQAADIEGESKKLSLEELAFIHERKTGHLIRYALLAGGILAKQPEEILLLLQRLAEHLGLAFQIRDDLLDVIGTTKTLGKTAGKDERMEKNTYPRLLGLEKTREALEIELLSANKIIDKLEEDVFSFDGGLMRQMIKQFDVEK

SEQ ID NO: 6725 - protein, 413 aa, Enterococcus faecium
  misc_feature (B) LOCATION 1...413
  hypothetical: YES
PHQILQKLAYLSNFNHGEESEKMSKEMSNALDALEAEKGISKEIVIDALEAALVSAYKRHYGQAQNVEVEFDQKKGKIHVYAVKEVTEEVMDSQLEVSLKDALLINPAYEIGDTIRFEVTPKDFGRIAAQTAKQVILQRVREAERTIIYNEFSAYEKDIMQGIVERQDKRYIYVNLGKIEAVLSKQDQMPNEFYQPHDRIKVYVSRVENTSKGPQVFVSRSHPDLLRRLFEQEVPEVYDGIVEIVSIAREAGDRSKVAVRSNDPNIDAVGTCVGPKGQRVQAIVNELKGENMDIVEWNEDPAVFIANALNPAQVMDVIFDETNPKACTVVVPDYQLSLAIGKRGQNARLAAKLTNHKIDIKSESDMTEFYENQEQQKETEELHDEAIVQSDLTDDEYETIAFNNETVEEKPEA

SEQ ID NO: 6726 - protein, 430 aa, Enterococcus faecium
  misc_feature (B) LOCATION 1...430
  hypothetical: YES
VSQIKKVRLSKQSKNGWRRNKMEEKVIIVGVETEANQRYFSESMEELVQLTNTASGEVVFTITQKRPQVDRQTIIGKGKLQELVQQADAHEADLIIFNHELTPRQSQLITDAVGLPVIDRVQLILDIFAMRARSKEGKLQVELAQLEYLLPRLVGQGKTLSRLGGGIGTRGPGETKLETDRRHIRNKIFAVKKELKEVEAHRERNRQKRKNSEIFQIGLIGYTNAGKSTILNLLTQADTYSKDQLFATLDPLTKRWRFAEGFEITVTDTVGFIQDLPTQLIDAFHSTLEESQNMDLLLHVVDASSPDRILQEQTVLKLMDELNMKEMPILTVYNKADQIDPAMFTPTLFPNVLISTQTKEGKMALIEAIKRQLMELMTPYTLSVPSNEGQKLSELRRQTMVLDEAYMEETNEYEVKGFAKTNSKWLRKNQ

SEQ ID NO: 6727 - protein, 66 aa, Enterococcus faecium
  misc_feature (B) LOCATION 1...66
  hypothetical: YES
EGQIMKELFSAYKLPIIFGGLGLLLAVLWLTIGFFKTLLIIIMTAIGAGIGFYLKQSGIVDQFFKS

SEQ ID NO: 6728 - protein, 115 aa, Enterococcus faecium
  misc_feature (B) LOCATION 1...115
  hypothetical: YES
PLQIFRAYPQVIQDINQVTLQRGTFVYWCCCIDSQALDSTFAKDDTLLPITLRLATASRKGVRSERGQRSSLKRGLFLYVKKRKSLLNLSALLYFFDVLNQVRYNYIRKRRRDNG

SEQ ID NO: 6729 - protein, 124 aa, Enterococcus faecium
  misc_feature (B) LOCATION 1...124
  hypothetical: YES
SMQILGGNNMAFPQLDLKSEKGPKAVIKTNRGDITVQLFPELAPKTVQNFIELSKKGYYDGVIFHRVIPDFMIQGGDPTGTGMGGEVFMAKVLKMNSVVNCSTFAELYLWQIQVQTQTEANSLL

SEQ ID NO: 6730 - protein, 567 aa, Enterococcus faecium
  misc_feature (B) LOCATION 1...567
  hypothetical: YES
VKQMNQFLSYKHIENWFKAIEEGTIKVCKEQLLLKNYLEERVFTREDIYFDKQMVEDSINIPAQYFPFELIPWEKFLQCFIYGVRWKKDKTLVFNRYLSLMGRGNGKTGFASWNNFFLLTAKHGIKNYDIDIYANNESQAKTSFDDVFKVIKDHPDLDKKVFKATKEVIQNIATNSKLRYNTANARTKDGKRPGANRFDEIHENEDYSMINVATSGGGKIRDYREFYDTTNGHVRGGPLDDIIEESKMILSGELGIDKDGAEFSSLFPFICRLDNDNEVDDPDMWEKACPTINYNADLKRKMFQEYSQMQRNAGLRLTFMTKRMNRPMEDTRFAVASYDDVLHTKEKEFPEKMDEVIGTVDFADRRDFASVGLLGKYDKDVYFTQHTFIHESALRLQNIKREVIDISIDQGKSQIVHGKNIEADYIVGWFLEMSNKYYIKKIAMDMYRAKILKPALEEAGFTVEIVRSGSVTHGMLKDLVDDLFINQRLFFGDDAIMRWYCMNVYEEHISNGNIRYEKIEPETRKTDGFFSFLHGLNFLDDIYDSAPVTVTNSSVENTGTGFTPLVF

SEQ ID NO: 6731 - protein, 318 aa, Enterococcus faecium
  misc_feature (B) LOCATION 1...318
  hypothetical: YES
KEQIMKKIRDLVIDEQFEQFVLIKSADVRIAKNGKKFIAFTFQDTSGTIDGKYWDASEEEINKFTAGTVVFLNGKREVYQGNPQVKILHMRLTRVDEPGEPSLYMERAPLKKEEMEEEINQLLFEITNAHWNRIVRYLLNKYQKQFFEFPAAKRNHHAFASGLAYHTLTMLHLGKSIADEYPELNRALLYAGIILHDLGKVIELSGPMSTEYTLAGNLIGHLVLIDEEITKACLALKISEADEDVLVLRHMVLAHHGLLEYGSPVRPRIMEAEILHQIDNIDASMQMMLTSIRQTEPGKYTDRIFGMDNRSFYVPKDL

SEQ ID NO: 6732 - protein, 82 aa, Enterococcus faecium
  misc_feature (B) LOCATION 1...82
  hypothetical: YES
KRQMIAICTLSIAKISDCKHEWCLLLLMFSVYPRKAQKVFIIAILVKKFRKTLVIIRFGEINVQSKDKNQKDSSGTKCLSVR

SEQ ID NO: 6733 - protein, 163 aa, Enterococcus faecium
  misc_feature (B) LOCATION 1...163
  hypothetical: YES
GVKIMEIPTNLKHKPVIVVEDYDKVDGRNALNMDAKGLSLGLAQWNDRGKVDISGKVWRHTGEKWSRQSEELPITRILDLAILAAQGSLYFQDAYRYEKFYDPENPVVDIIGLQGNRMTVEVDTKNPKIDEDIILYYDTLQKDGELIGERFRILKRLLDELGY

SEQ ID NO: 6734 - protein, 789 aa, Enterococcus faecium
  misc_feature (B) LOCATION 1...789
  hypothetical: YES
GDKMNNRILETLEFEKVKQMVRQFVVTAQGKEELAELVPVSEKQTITNWLQETEDGLKVQRLRGGIPIPKLENIRPHMKRIEIGADLNGVELAQVSRVLSTTSELNRFIDDLSDSEIEFARLYMWADQLVTIPVLSRRLKEAIDEDGRVTDDASPELKSIRQNIRRSEQAVREQLDGIVRGKNAKYLSDAIITMRNDRYVIPVKQEYRGVFGGVVHDQSASGQTLFIEPKQVVDLNNRLRQYQIAERNEIQRILSELSAELVPHRQEIIHNAYVIGKMDLMNAKARFGKEVKAIVPGISEDNHVVLKQARHPLIDQEKVVSNDITIGKDYQAIVITGPNTGGKTITLKTLGLLQLMGQAGLPIPAGEESQIGIFEEVFADIGDEQSIEQSLSTFSSHMTNTVDILSKVNEKSLVLFDELGAGTDPQEGAALAIAILDDLGKKSAYVMATTHYPELKVYGYNRANTINASMEFDVDTLSPTYRLLIGVPGRSNAFEISSRLGLDTEVIDEAKQLMNDESQDLNEMITDLENRRKMAETEYLEMRHFVSEAQELHDDLKEAYSYFFEEREKEMEKAKKKANEVVSEAEEKAEKIIADIRKMQQQIGQGNVKEHQLIDAKTQLANLHQEETLKKNKVLKKAKEQKTLKPGDEVLVTTYGQRGTLLRKNGNQWQVEIGILKMNVSEDELTPVAPQKEPTQRVIHAVRSESSSHVPNQLDLRGKRYEEALSEVDQYLDSAILAGYPQVTIVHGKGTGALRKGITDYLKNHRSVKSFEFAPANQGGNGATIVKFK

SEQ ID NO: 6735 - protein, 1070 aa, Enterococcus faecium
  misc_feature (B) LOCATION 1...1070
  hypothetical: YES
NDKIKLSKRQRGWWRMNQCVKKLIASILFVFPLLMVTSVFADVEKTNESTQSENQSFDKTTFSEESITSETTESQSEASTNKRQEENKTSETSEVAEQTSDSSEAALARAVSADGYSEAATTEELAQLLADESVTKIRLIQPLTLDRELEIKRDIVIDFGGFAHNFGTHHIYINEIPQSIEFQNFKGTAAHPGGLTPNIDGNAIIIAYMTDFWGSRYHFTGEIKFTGTLDLYDGSKLGLIYAPRATVTLDGVSGVLDVQPVKEGLNAAPGKAYFCRSYQLNVINGSQLYGPYLGKFYGFLDSGDETGSGKTAPGIHILSGSKVSLDYDRADGVSDEGEAVDTLPGNVMFEVSGSGSEFSVNTKINITNDNNRGIIQMRGSGSKVTVSNGGKITINTATTGGFRLQGDSSQIHVSSGGQISVKMAGDDDQPGNNGMRFVGKGLSLIVEGAGSVIDIDKQSGRSSAVRFENGTQKLTVTNGGSLRVRNTGDGKSYVNRLNQGNQAIQFYDASGFLESPGSADFTVTGEKSNIDIRADSGATVDTTGDIDLNFTAGEKTYLVMVGKTGEDKTGIISGDVLNVDLESPTYFDFQNKRIGSETNGIGGWVFQGNGDSSLKIAHSEIALWRKTGATFDNFEKDPDYFSDMTDLSINGTDLGNFVSSPSAGLTNEFAQTGAGMKNYNRISANNQLPMIESLRVPTNADKKIYGHVVVPEGVEAKPRDAWTGEVEVTLRITYADTTKSSVEITALTQGQTDENEGAGYNPWGEGEQGGLFEVQVPNDERLKTEDQVQVVAAKKVRGGQEVTELDSAKTTVDVIPPEPANLSTTLINAASRTITGTGEAGALVSLKKNQAVLSETTIDDTGEFVLSIPENQLFAGDVLEIVLNDQAGEATAKGVQNKPSTNDEIGNHNPSDTPVVYHDAPPFAPATKIVVEGGLSFLAPSKLDFGQIKATGLTQEAFGQMDIQEKLWIYDQRETKNPWILTIKLSQPFTNDAGFSMQDVLYFKKGEEYQLVNEEELEIVRGQNSTNVQADYSEYLNNGRAFKLVLTKENQIAGNYSAEITWTLADAPTE

SEQ ID NO: 6736 - protein, 187 aa, Enterococcus faecium
  misc_feature (B) LOCATION 1...187
  hypothetical: YES
GDKMKLSTDWRKEIQTIPNLLSIFRIFLLPIYLYFVLRQSFYIAGAVIVVSGLSDYLDGVIARRYNQVTDLGKVLDPFADILTQLFLILSMASVSTVALAVVSSILDKRSVMFVAGLIGLSKNIKLSGAKWYGKVATAVIYVGMILLLLFPELPTLWVRVIFAVITYGLLQSFVLYAVEYRKMFQRK

SEQ ID NO: 6737 - protein, 272 aa, Enterococcus faecium
  misc_feature (B) LOCATION 1...272
  hypothetical: YES
EDKMKLAAIDLDGTLLDRNGKIPEENIQALRKFDENGGIVTVATGRNSISAKDIFSELGIGGYLISSNGSLIAEMKDGKMAKVLRRSKIDSDTLRKAFFYAQEAKISIIASRETQDDQLTFDESNLVKDDPYYEHFNLQNHSFDQILNMLEDPSLSYLKLALTDKSEEKLQKLQRDLQADGIQSVFSDPHFLEITPTGITKAHSLVFLADYLGIESSDIMAFGDQENDIAMLNYSGLSIAMGNAQRQVKEIANQVTLTNEEAGVAYILKNFY

SEQ ID NO: 6738 - protein, 302 aa, Enterococcus faecium
  misc_feature (B) LOCATION 1...302
  hypothetical: YES
RDKMGKLAIISDLHVDINKFGESELMQLWQVLQKHKITRLHLAGDTANKVDRCLAVVEFFVNKGLSTTFHFGNHELADVPNEQMMDHFPDPHFLNERYIALNEQTVLLGMNGWYDYQFSELKDYEAIVRMKRLYWYDRFIQRGKTDLEVNAEMLAAAKNLLDQLEAKKLEVILSTHFVPKRAFIMYQSAPYERWNKLNAFLGSESFGELLDRYSNIKQVVFGHTHRRFEDKSIGHTIYSCRPFGYYYEWQLTRDFVLKEQLLDSYDPMKLRVLLRAHHPAFQAYQTQHLQEEFEQAMTIVPY

SEQ ID NO: 6739 - protein, 112 aa, Enterococcus faecium
  misc_feature (B) LOCATION 1...112
  hypothetical: YES
ILKMEVFDMSQVITDKTFNEETDKGLVLIDFWATWCGPCRMQAPILDQLEQEYDEEEFRIAKMDVDENPETPQQFGIMSIPTLMLKKDGQVVEKAVGVHSKEQLRQMIDQYL

SEQ ID NO: 6740 - protein, 575 aa, Enterococcus faecium
  misc_feature (B) LOCATION 1...575
  hypothetical: YES
MLKIVKRISLTSAIAAAVFMVIQVLADLYLPTLTSNIIDKGVAQGDVDYIWHTGFVMIGFSLISILAAIANTFFATRESQKLGKQLRTDVYKKSESLTKDAFDKYGTASLITRTTNDVTQIQMVTQMFLRMMINAPITLIGASILAYQKDHQLTKIFLVVIPVMIILIGGIMYFAVPLFKSMQKKTDRLNLVFREGLTGVRVIRAFDKTRFEENRFDLANKDYTNTAIKVNTIVALMMPMMTLIMSGTNVAITWFGGHYIADMTLEVGNLIAFMTYAMQILISFMMLSAIFIMVPRAQASADRINEVLDEKIGIHDPENPKTVSFAGKNATLAFNHVNYRYHGAEKLALEDIDFQAKSGEIVAIIGGTGSGKTTLVNLIPRLYDIESGSIQINGTDISDMTQYNLRELMGFVPQKAVLFSGTIRDNMQYGKPDATDEMIWKALEIAQAKDFVSEMEDGLDSHVEQGGGNFSGGQRQRLAIARALVKTADIYVFDDSFSALDFKTDANLRQALKTNMKESITVLVAQRVSTVMDADMILVLDEGKLVGKGTHEELLATNETYQEIVHSQLREEDLA

SEQ ID NO: 6741 - protein, 404 aa, Enterococcus faecium
  misc_feature (B) LOCATION 1...404
  hypothetical: YES
DIKMSKKKILVVSQYFYPEQFRINDICKTWVEKGYDVTVLTGIPNYPHGDFYQGYGYNKKRNENYEGITIKRIPIIPRKKNSLMMGLNYLSFVVSGELWKMLNKQRFDLVFIYEVSPMTQALPAVKIAKKFGIPCYIYVMDLWPENFEIITGITNPLIIKPLDKMVDYIYKNCKKIFTASRSFKRNIENRGIDSEKIHFWPQYAEEFYHITDTKSDKLIYDKKINITFAGNIGTAQGLEILPMVGNKIKEKQLNVRFNIVGDGRYKQELMDEVERANLQEWFHFVDPVPATEIPEILAGSDFSFVSLQKNDIFSMTIPAKLQSSMACGKPILLSANGEVADIVKEAKCGFVGKAGEPDDLFDNLLQIVHLSSQEIDKLGENSRRYFEKEYEKEKLLSIMDSYLM

SEQ ID NO: 6742 - protein, 104 aa, Enterococcus faecium
  misc_feature (B) LOCATION 1...104
  hypothetical: YES
NSKMSEAIIAKKAAIVDEVSEKFTAAASVVVVDYRGLTVDEVTRLRKQLRDANVEMKVIKNSILSRAAKKAGLEGMDEVFTGPTAVAFSNEDVVAPAKIMDEFC

SEQ ID NO: 6743 - protein, 93 aa, Enterococcus faecium
  misc_feature (B) LOCATION 1...93
  hypothetical: YES
KPKKKKKKKKKKKKKKKKKKKKKKKKKKKKKKKKKKKKKKKKKKKKKKKKKKKKKKKKKKKKKKQSSIEEKMLTLYPHQFYTDGFFICCLRKK

SEQ ID NO: 6744 - protein, 122 aa, Enterococcus faecium
  misc_feature (B) LOCATION 1...122
  hypothetical: YES
NKKNKKKIKNKKKKKKKKKKKKKKIIKTKKKKKKKKKKKKKKKKKKKKKKKKKKKKKKKKKKKKKKKKKKKKKKKKKKKKKKKKKKKKKKTIINRRENVDFVSASVLHRWIFHLLFAQKVMR

SEQ ID NO: 6745 - protein, 88 aa, Enterococcus faecium
  misc_feature (B) LOCATION 1...88
  hypothetical: YES
KKKKKKKKKKKKKNNKNQKKKKKKKKKKKKKKKKKKKKKKKKKKKKKKKKKKKKKKKKKKKKKKKKKKKKKKKKKKKKKNNHQSKRKC

SEQ ID NO: 6746 - protein, 234 aa, Enterococcus faecium
  misc_feature (B) LOCATION 1...234
  hypothetical: YES
MKKILVVDDEPSIVTLLTFNLEKEGYKVTSAADGGEGLELALEQSFDFIILDVMLPTMDGMEITQRLRQEKNETPILMLTAKDDQVDRIIGLEIGADDYLTKPFSPREVLARMKAIFRRIEPRKQSKDEAEPEYLSIGQITADLTNYQVTVDDHLIELTPKEFELLVYFMKRKDRVIDRDTLLDRIWNFDFAGQSRIVDVHVSHLREKIERDPKHPKYLVTVRGFGYKFQEPKR

SEQ ID NO: 6747 - protein, 232 aa, Enterococcus faecium
  misc_feature (B) LOCATION 1...232
  hypothetical: YES
EKKMKKNKNQIIDIIFMLFLSFAYVIPLFMSMGIYHSVNQDTYFHLSRIIGLDNVWSSPVNFNNFDHHGTMMNIFYPWLTLYPAFLFYKMMGNLVLSYNIYYFFITFLTMVVSYFSMKQIKNNRYISLLFSIIYTFSAYRAIDIFHRASLGEAVALTFLPLILMGCYEIYIRDYQKWYWLSIGMTLVVYTHLLSVAMVSVFIGGTLFLSFYFWDQKIARLLSLLKATVLTFF

SEQ ID NO: 6748 - protein, 249 aa, Enterococcus faecium
  misc_feature (B) LOCATION 1...249
  hypothetical: YES
GEKMQIEYQSDVGRRRNTNQDYASVFTSRSGLKLAVLADGMGGHRAGDIASQMAVTNLGEAWEKQEAVDDEKIAQWFIQSIQEENMLIYQRGQEQPEYNGMGTTIVAAALSDDWFTIANVGDSRAYLIREDKIMQLTEDHSLVNELVKSGEISEEMAVNHPRKNILTRSVGMPGTVEVDVSTHLWQLKDRLLLCSDGLTNMLSEEEIGTIINQEGPLSHKVTELIDRANEAGGADNITVLLIEYKEDSV

SEQ ID NO: 6749 - protein, 515 aa, Enterococcus faecium
  misc_feature (B) LOCATION 1...515
  hypothetical: YES
GEKMNVSIGLDIGTTQTKAVAFTDEAQEAASAYFRYPLIQETQGMAEQDQELIFQGVCTVIKEVIKQLPSDTIIQFVSFSSAMHGLILLDEEKTPLSRMITWADNRAADEAEKLKYTVLGKEFYRQTGTPIHPMTPLNKIKWLQNSQPELFKKTAYFVGIKDYIFYRLFGELISDYGTASGTGYFDIHEFQWAEEVLDYLNIRIEQLPQVFPSTYQVTGLPSKTAAELGLPNDISFVLGGADGPLSNLGLGAFGDTIAALTVGTSGALRFITTQPQFHPEMETFCYVLDQKHWVVGGATSNGAGIFDWAGHTFLQEVVQSAKEKGENPYDALLSAIAFVPAGANGLIFHPYLLGERAPLWDADAWGSFIGLQRQHTEKEMMKAILEGICLNLYRILKGVCQENQLTEIRATGGFAQSPIFRQMMADVLGYPLVFPTVTEASALGAVILGWRSIGKIQSISEAQELIELKEQVGVQETDHKKYQKIYPLFVSTQKHLAQTYQQFAQLREELADSEK

SEQ ID NO: 6750 - protein, 281 aa, Enterococcus faecium
  misc_feature (B) LOCATION 1...281
  hypothetical: YES
KEKMPELPEVETVRKGLERLVVGKTIQKVQVLWPKIIEQPETPIFEASLVGETIQSIGRRGKFLIFHLDHCELISHLRMEGKYQFTKENTPIDKHTHVLFFFEDGSQLRYNDVRKFGRMTIVEKGASATYRGIMKLGPEPLPDSFLLADFANGLKKSHKAIKPLLLDQRLVTGLGNIYVDEALWEAKIHPEQPANTLRPKEVEQLRLSIIDVLDRAIEAGGTTIRSYLNALGESGGFQVALHVYQQTGKPCIRCGTPIVKTKVAQRGTHYCPNCQRLKIAK

SEQ ID NO: 6751 - protein, 447 aa, Enterococcus faecium
  misc_feature (B) LOCATION 1...447
  hypothetical: YES
VEKIVIIGSNHSGLAAARFLNLSDSNYEVILIDKKSEISYLECGTSLFIKGEVSNLEDLFYQNRMTLNSEIKKLFLETEVDKIDIQNKKISCVKKDGTRFSQEYDKVILATGSKQIMLDIPGNNLANIFSIKNFPNAKEIFKALDDSTIKKVGIIGAGYIGVEIAEAIRKRGKEVYLFDVADRVLSTYYDRSFSDKVEEILSKNGIHLCLSESPKKYLGRKKIEKIVTTSGTQYSMDMVVQAIGFLSNSPIGEKELLRDVSGAYLTNEYQQTNIKDIYAIGDCATTFFTSINRSSVDFSISNALRTAYIATQHINNQDFTPSGSQFTNGFSIFNYNFYAAGLNLKTARLLSESIDYIEIEDFIRPAFLRKNSRVKLRISFEKNTKRIVGVQLCSQEDLSGLLSMFSLAIEEQITLDKLKMLDYLFHPSFSQPYNFILKAVTGLNIET

SEQ ID NO: 6752 - protein, 226 aa, Enterococcus faecium
  misc_feature (B) LOCATION 1...226
  hypothetical: YES
VRKMTDKQKIDEFFWNKTTPEVARDLLGMYLEHDTPEGRLAGYIVDAEAYLGPEDEAAHSYGLRRTPRVRAMYEKPGTIYLYTMHTHRILNIITQPEGIPQGVMIRAIEPAAMIDQMSKNRGGKTGPDISNGPGKLVEALAIPQELYGQSIADSSLRLVFEKKKTPKKINALPRIGIPNKGVWTEKPLRFVVSGNPYISLQRKNQIEKDWGWRKENEKEGSINIFR

SEQ ID NO: 6753 - protein, 227 aa, Enterococcus faecium
  misc_feature (B) LOCATION 1...227
  hypothetical: YES
NMKITYHGHSCLTIEMENGQRVMIDPFITGNPLTDLTAEEVKTDWLLITHGHSDHIGDMIPIAKENQATIISIVEIADYANSRGVDSFGMNIGGKHAFPFGVVKFVHAQHSSSYEVDGIVQYMGEPSGIIIQAEGKTIYHAGDTAYFSDLGLLAEEFDIDVAFLPIGDNYTMGPEDAAKAAQTIRAKKVVPIHYNTFPVIEQDPESFVELLEDSEGKIMSVSETLEV

SEQ ID NO: 6754 - protein, 67 aa, Enterococcus faecium
  misc_feature (B) LOCATION 1...67
  hypothetical: YES
SMKINYTVDLVSFSLVINFSLFSLRLFIDGLRHTHASILLYQGVNILSVSKRLGHSSLETTMSTYTK

SEQ ID NO: 6755 - protein, 455 aa, Enterococcus faecium
  misc_feature (B) LOCATION 1...455
  hypothetical: YES
NMKIVIIGASHAGITAALNLRKLQPKAEVLLIDEDHKDGLGYVSNGINLYLKGKIRSLAEVAHNMRTLQESGAKLITEWRVTELDPDKHQLILASKEGKNETITYDKLIVATGSSPVTLYKQIEAENVYTYKNLVQSKQVLAALKEAKEVVIFGAGYIGLELADALRNKGYIIHLVDYMPNVLSRYFDKDMINSFQNQLQTKQINFYPNEFLIDWKKSEEKVVSVQLLSQAIKADMVIFSAQTRPNTTLLKEKVALYEDETVIVNEYLQTSDPDIYAIGDIVPVSFDKNKRHLFLPLVTRAVHMARAVALTLSGQPTAYDLRQKITAAVIIDYFLGTVGLTEDEAPFLEQNTGSCSGEFDLFPQYDEENKTVNAKLIYHPDTLEIIGGQLISQEFLLSDLNLLADIVKHKTTIPQLAVEDFGFLSEHTSRFHYLNELAFKVLAKRANSNRVDKRL

SEQ ID NO: 6756 - protein, 378 aa, Enterococcus faecium
  misc_feature (B) LOCATION 1...378
  hypothetical: YES
KMKIKIMTIFGTRPEAIKMAPLIKAIENDERFESIVTVTAQHRQMLDQVMDIFDLKADYDLNIMKDGQTLTDVTSRVIKELDSVLVEAKPDIILVHGDTTTTFAASIAGFYHQIKIGHVEAGLRTWNKYSPFPEEMNRQLTDTLADIYFAPTVMSKSNLLKEGRSEKSIFITGNTAIDAMKYTIKQNYSNDLLDNLAGKRIILVTMHRRENLGQPMTNVFKAINRLIEKFEDVHIVFPMHKNPKVRKNAEETFNDSEQVHLIEPLDVIDFQNFSNNSYMILSDSGGVQEEAPSLGVPVLVLRDTTERPEGIEVGTLKLVGTEEDKVFEEATLLLSDKEEYKKMSQASNPYGDGNASERILDAIAYNFGIQQEKPIDFQ

SEQ ID NO: 6757 - protein, 363 aa, Enterococcus faecium
  misc_feature (B) LOCATION 1...363
  hypothetical: YES
KMKILVTGGGTGGHIYPALAFVNYVKTQEPNAEFMYVGAKRGLENKIVPDTGMPFHTLEIQGFKRKISMHNIKTVRLFLKSIRQAKKILSDFQPDIVIGTGGYVSGAVVYAAAKMGIPTVIHEQNSVPGVTNKFLSRYVDRIALSFKDAASFFPENKAVLVGNPRAQEVADTKKSDILKTFDLDPEKKTVLIFGGSQGALKINQAVSVFLSEYIPSSYQVLYASGDRYYEEILNKINPEIQNISVQPYIKNMAEVMASSDLLVGRAGATSIAEFTALGLPAVLVPSPYVTNDHQTKNAMSLVHAGAAKMIADNELTGESLSQTVNEIMGDEELQKQMCRASKEQGIPDASKRLYDLVKQIIKK

SEQ ID NO: 6758 - protein, 239 aa, Enterococcus faecium
  misc_feature (B) LOCATION 1...239
  hypothetical: YES
KMKIGLIGSGQMGNRVEEVAQERGDTVLLLRTAPKEATTLAFTELPELLIDFSHPDNLEKILSYSLSYQLPLVIGTTGYTQSQFQEIKEHAKHVPVMYSANFSFGIMVMNQLIKQAAAMLQGWQIELIEKHHSRKKDAPSGTANMLLQTIQEVQKLQPVYNWQGKKREENQIGVHSIRAGSLPGEHDVLFAATDEIFTIKHESFSNRIFAAGAVEAADWLKDQSPGYYKLEDLLMDKGV

SEQ ID NO: 6759 - protein, 226 aa, Enterococcus faecium
  misc_feature (B) LOCATION 1...226
  hypothetical: YES
SMKIKAALFDLDGVLVDTARYHYEAWLVLANQLSIPFTEKENEQLKGISRTESLERLLSFGKMEQKFSEKEKSAFAEQKNNLYLQAIQKMDETSVLPGAIAVLEYLKKTNIKIGLGSASKNARLILEKTNLTSYFDVLIDGTQVSKAKPDPEVFLKGAQQLNVPPNACLVIEDSEAGCQAALAGNMHVLGIGENINLPSAEYVIPDLTVFDQVRSFWHLSEAVSRI

SEQ ID NO: 6760 - protein, 81 aa, Enterococcus faecium
  misc_feature (B) LOCATION 1...81
  hypothetical: YES
EVKMMSKKNKDVEVRIEEVKKDIKGKNYEVTQLFIGKKMIGEILAYGPKEYEIFFGEEDFGKEKSFENAIETVIRHWNLHE

SEQ ID NO: 6761 - protein, 224 aa, Enterococcus faecium
  misc_feature (B) LOCATION 1...224
  hypothetical: YES
IKKMKKRGDKMIERYRTIKENGQSEIEIKKSRFICSLRRIESEDQAKSFIQEIKKEHWKANHNCSAFIIGEKNEIQRSSDDGEPSGTAGVPMLEVLKKNQLINVAAVVTRYFGGTKLGTGGLIRAYTHAVSQALSDIGIVEGTLQQEISVMITYPQLGKLQNYLELQHFFIKEIQYTDQVSVICAVHEKSADHFKESIIELLNGQVQFEEGPVSYHEQLVTDHI

SEQ ID NO: 6762 - protein, 70 aa, Enterococcus faecium
  misc_feature (B) LOCATION 1...70
  hypothetical: YES
QKKINFNKLLGSICCKKKMDGRKEDCRSADPVCPAEKRKTILWVIQPLTASEEDHDIKRRNHTRKQTIRN

SEQ ID NO: 6763 - protein, 214 aa, Enterococcus faecium
  misc_feature (B) LOCATION 1...214
  hypothetical: YES
EKKMIFLQKYGFYFLLLGVISDLSTPYILGLFYPKLNQMTTVISVFGDVDSPVRRAFLVWSVVSGLFFVLSLPALYHLFIGTSKTLAILAVATVGLYGIGDCIFTGLFSINTNESSWNLSTWIHNIGSGLGYAGFLLFPLLLVLLYRQSGQGTLSHFYLVLTVISLLIAGLYGLARIPSISQFAFFKQLGFFQRLSFFFNYLPMICLSFFQLRK

SEQ ID NO: 6764 - protein, 68 aa, Enterococcus faecium
  misc_feature (B) LOCATION 1...68
  hypothetical: YES
SEKIPPSPWLSSFNASTTEXFVVGRVVAGRGGGGGGREGRGRGGGGEGGGAXGRGERKEGEREGGGGG

SEQ ID NO: 6765 - protein, 311 aa, Enterococcus faecium
  misc_feature (B) LOCATION 1...311
  hypothetical: YES
EEKIMIELITTVETIEQAEQLLAAGADTLYFGEEQFGLRLPASFTREEQRQLVELAHKYGKKANIAVNGIIHPEKMKNVPEYLAFLKEINVDVITVGDTGIIYTMKKNPELRIPYIYDAETLVTSARQINFWAKKGAVGAVLAREVPFEEMKAMEEKLDIPVETLVYGATCIHQSKRPLLQNYYNYTKQDEQKDRERGLFISEPKKEETHYSIYEDSHGTHIFASNDLNLSNELNELYQHHYCTWKLDGLFTPGEKFVNITRLFAEAKKQILEGSWDQEKAEKMTSEISKLHPENRELDTGFFYIDPSAIK

SEQ ID NO: 6766 - protein, 405 aa, Enterococcus faecium
  misc_feature (B) LOCATION 1...405
  hypothetical: YES
WRKIMENQNESLIKQYVKRRAKRRLFLWLFGTSAGLITILITVFVTLFLILAAGSIDNSDSDSSSGGEAFTGEYSEGLPIYKEIKGRGPFSDEIAQYAVGAAVKYKLLPSVILSQYGYESAFGTSASARNDLNYFGITWFDGCLFPKGTARGIGGIEGGWYMNFPNSKAAFSYYGFMVATQSNFNACVGNKSPGASLLILGRGGYAAAGITEDSPYYTGCMSIITSNKLTEYDEFAMKHWGEGGNDNGTITGEWTNPFPGSSLDKSTFSGGQLFGTNPGSEFRPNGFHDGLDFGSVDHPGSEIHAVHGGKVVYVGNPGISGLGACVIVINYDGLNMVYQEFANSTGNSRVKVGDQVKVGQVIGIRDTAHLHLGFTRMDWRQAQGHAFTDDGTWIDPLPFLNSSKK

SEQ ID NO: 6767 - protein, 225 aa, Enterococcus faecium
  misc_feature (B) LOCATION 1...225
  hypothetical: YES
RRKMVKQNFAIVGLGRFGGSICRTLIEAGQEVLAIDSNEDRVNEYMNIATHAVVANAQDEMTLRSLGIRNFDHVIVAIGEDIQASILVTLMVKEMGVPNILAKAQNEYHARVLEKIGADRVVHPERDMGIRIAHNLVSKNILDYLELSDKYSLAEIRVSNPKFFNKTLAELNFRQRFDLTVVAIRRVDQTVIASPAADEYVRENDNLLVIGETGDVDILDDKMNQ

SEQ ID NO: 6768 - protein, 182 aa, Enterococcus faecium
  misc_feature (B) LOCATION 1...182
  hypothetical: YES
GRKMKIIVIGQSGSGKSTLARKIKEITGFPLLPLDLLWHTTDYSIQAKQWFLQEQQSFMVSNPSWIVEGNYTSTLEERIKEADKIIWLKVPRYVAIYRVVWRSLKRKINKKSRPDMPEAFTEKLNREYVEFLSFIWHFEENNEPKIQQLIQENHARNKLIILKTRGEKQEFLTKLKIESKNN

SEQ ID NO: 6769 - protein, 227 aa, Enterococcus faecium
  misc_feature (B) LOCATION 1...227
  hypothetical: YES
GGKMIKLLVVEDDKVLSNNIKEILAAIGEITQVYDGSEGLFELESGVYDLAILDLMMPEMNGYEVLAKIRKEKIQTPVLILTAKDSLEDKIEGFERGADDYLTKPFYREELIMRVKALLKRSLGLFDENVLKYKDISCDLKSNEVLYKEQVLPIQGKEFELLVYFLQNKGIILTKEQIFDRIWGFDSDTTITVIEVYMSNLRKHLRSTGLDKEIKTLRNVGYILQRV

SEQ ID NO: 6770 - protein, 264 aa, Enterococcus faecium
  misc_feature (B) LOCATION 1...264
  hypothetical: YES
EGKILDANVYQHFRADERTFIDSVGDWIEQVQGQYAPYLTEFLDPRQSYILETLIRQSSDLRFMFYGGYEQAERKRCLIFPDYYEPVEEDFETALYEIHYPSKFASLSHGKILGTLVGTGIKRSYFGDIISDGDRWQVFIANEVDHFVAAQVTKIGKVAVRLEPIKYTEMIMPKDSWTQERGTVSSMRLDSVISEIYNISRQRSKQLIEAGKVKVNWTENTRPDFVLELLDIISVRGYGRVQIQELEGKTKKEKYRVLFGVLRK

SEQ ID NO: 6771 - protein, 63 aa, Enterococcus faecium
  misc_feature (B) LOCATION 1...63
  hypothetical: YES
EIEMEEIMAFGDHYNDIEMLKGVGIGVAMGNAQIEVKHAADFVTQSNEEDGIYEGLKHFGLIY

SEQ ID NO: 6772 - protein, 94 aa, Enterococcus faecium
  misc_feature (B) LOCATION 1...94
  hypothetical: YES
QAEIIDKEVATLKDYKLDFQSELPIEFVNEFKIEAPDKTRTLFTFNHDMILQEFEDDTVICVARDSEFLTIYSNRKFNQTIPVRSKKVIIYFEE

SEQ ID NO: 6773 - protein, 199 aa, Enterococcus faecium
  misc_feature (B) LOCATION 1...199
  hypothetical: YES
HNEIELRRIYMKTKDYIFIGLATVISLVIYFFSIMVSSIGGAFGHSISPGIFGLLSGIIFVYISYNYPRKGIFTIYTIVLLLFFTLMGGAYLPWFISSISMAILADIILSVFGYDRAIPQVVSWVLMQLGSAAGQWIPIWFFTDRFRQDWIDRGQSAATMDAMIHYAVGIWGIISVLVVASLSMIGVLIGRKVLKKYKK

SEQ ID NO: 6774 - protein, 62 aa, Enterococcus faecium
  misc_feature (B) LOCATION 1...62
  hypothetical: YES
ALEIKGGIIQGKVSSLEEITALAKLPNREGLLSMLLSVPQAPVRNVAYAVKAVADKEDGDAA

SEQ ID NO: 6775 - protein, 178 aa, Enterococcus faecium
  misc_feature (B) LOCATION 1...178
  hypothetical: YES
TPEMSWLKKQESIMLLLNLMELRLEGKSLISRSTNQWKKIKETIRMLDIVPSNTHRSGSLINFAAIFACASVILASPVVVDASSTPKTKNDNQLVITTKNEINTISSNDGKIFDVINTVLKRKAEINIKYDEDLNLYFFVIKTTSELFSSDYDVLDTLDNVLSDYKYMGKSVVATLGE

SEQ ID NO: 6776 - protein, 233 aa, Enterococcus faecium
  misc_feature (B) LOCATION 1...233
  hypothetical: YES
EKEITRCTKCKKKSLLEFDGTDFEVKKVEKKERKRNPANPFTTSSLQQEAARKLNFRTRKTMMVAQQLYEGITLGKQGTVGLITYMRTDSTRIADTAKAEAAAFIEDTYGKEFSRHDHRKIKNAQGAQDAHEAVRPTSVLRTPDELKQYLDKDQLKLYTLIWSRFVASQMTPAILDTMKVTLEQNGVIFIANGSKIKFKGFMQVYVEGRDDGKEEKENILPELEEGDVVQSVD

SEQ ID NO: 6777 - protein, 206 aa, Enterococcus faecium
  misc_feature (B) LOCATION 1...206
  hypothetical: YES
MKEIRRKHFRFPAYDDELGVKLTNDKKRVLFDGQEDLLTEQNQSPFEQMKEFHFTNTNTEKIRRKRRATNGLKSAPRKENLEKHKGKLPDYTGHYQSEITSTGRKKLFGDSSRSVRQSETRTESKHTTRNASVDTKVRERSYFVPKYVPASIIPDPRESKIFEDHLIESDEKKRRTLICCSIQNRRRIKKKEMVSRLYEHSIAQKR

SEQ ID NO: 6778 - protein, 519 aa, Enterococcus faecium
  misc_feature (B) LOCATION 1...519
  hypothetical: YES
NEEISIIKEGKRMKKISVGLIGIAALGLLGACSSTNDAKVSNDKDGKLEIVTTFYPMYDFTKNIVGDEANVDLMVPAGSEPHDYEPSAKDMAKAHDADVFVYHNENMESWVPKAKESWKKAGPNVVEGTKDMILLPGSEEEDHDHGEEDHHHELDPHTWVSPKMAIKEVSNIKDQLVKLYPKKAKVFETNAEKYLTKLKRLDADYTTSLKEAKQKSFVTQHAAFGYLALDYGLKQVPIAGLSPEEEPSSGRLAELKEYVKKNKINYIYFEKNANDKIAKTLANEAGIKLEVLNPLESLTKEQMDNGEDYVSVMEDNLKALEKTTMVAGEEVVPEKEAKDEKTVANGYFKDADVKDRELSDYTGEWQSVYPLLKDGILDEVFDYKAKINKDMTAAEYKDYYTTGYKTDIDTINIKDNTIDFVVNGEHHQYTYKYVGYKILNYEKGNRGVRFNFETDDAGAGRFKYIQFSDHGIAPSKAEHFHIFFGGESQEKLYNELHNWPTFYPASLSKHEIAQEMMAH

SEQ ID NO: 6779 - protein, 227 aa, Enterococcus faecium
  misc_feature (B) LOCATION 1...227
  hypothetical: YES
CGEMRERMEKERVDVLAVKQGLFETREQAKRSVMAGLIYNEKNERFDKPGEKIPVSSELRVKGKKLPYVSRGGLKLEKALKAFDLSVEGKTLLDIGASTGGFTDAALQNGAKMSYALDVGYNQLAWKIRQDPRVVVMERVNFRYAKPEDFTLGIPEVAVIDVSFISLKLMLPPLHAILKEEGEVIALIRPQFEAGREAVGKNGIVRDPQTHQKGFRRHFVICGTRWI

SEQ ID NO: 6780 - protein, 138 aa, Enterococcus faecium
  misc_feature (B) LOCATION 1...138
  hypothetical: YES
LMEITKKLNIPASFFYDKVMDSVLFDVRKATGKSVTRKQLKNLEYVKQFSQNNRARIKIEEVIENQSYKFRTSTTKNEFVVHYQIKPLDDSTCEVHYTEKMESYGMLQKLNDMLLGTILMYFKRRRFKKMLDMIEATY

SEQ ID NO: 6781 - protein, 338 aa, Enterococcus faecium
  misc_feature (B) LOCATION 1...338
  hypothetical: YES
EVEIMLKFNEEEQIKAIKGALALRPQVEEIIDKLYAEKFDAVYYLGIGGTYASSMQAVTYMNGKSNLPVFVQHAAEYYTTGNKRLTKDSIVILSSVTGTTQEVVKAVEQIKKVGATLIGFIDKANSKLSQLCDFVVTYPAPGTEQIKFFMAADRLMYLNGEFEAYSEYYEQLERYLPTGLVEAEKKADAFGLSFAEKHRRDSMHYFIGAGNQWGAVYSYAMCYWEEQSWLPSKSIHAAEFLHGTLEIVEETTPVTLFLGEDEQRVLSERVAKLLPKICSNYTLIDTKDYPVEGISEKYRGRVLSFLLMHVVTQRIDAHVEQLNCHPLEIRRYYRQFDY

SEQ ID NO: 6782 - protein, 300 aa, Enterococcus faecium
  misc_feature (B) LOCATION 1...300
  hypothetical: YES
DAEMYEDWKPDSMAVQEVRPVAKKHHHQRQHCNRQKDRLMCRRILGDGAGNLAGGGQDVLGKFRALFGFMGGLGIFPLDFLLLHPFCQRVFALQFGVIPQGGLPCKVSVRPRRFLLGFPQSAVGFGAAAVPFPGAGRAPRPVRQPFRFCGQIPEPRCHAHIHGVCHAALRLPPFLPHFRHGRTGRAFGTPAGFHPQNGAAALSSRWLRQAGDPCAGGVWQAASFVLAPRGGLRVPCGRRPCYISFVGGWAYRAQYRRKCPYLWECPQISGVFPRPLDCHRILAYPPVWRRVRPALLSAAF

SEQ ID NO: 6783 - protein, 288 aa, Enterococcus faecium
  misc_feature (B) LOCATION 1...288
  hypothetical: YES
NEEIKHMKLAVVTDSSAYLPERIKNHPDLFVIPIPLIMDGKIYNEGIDIEADEYYGLLKNSKDFPTTSQPVVGEVLGLYEELKEKGYDTILSIHLSSGISGFVNTLFAMKDDISGVTVIPYDSKITSMPMGHMVEAALDLNDEGQSLDEILAHIDRIRDNTYAYLIVDDLNNLVRGGRLTNGAALIGSLLKIKPILTFSEGKIVLFEKIRSSKKAFARAEEIIGRRNNEIQPPVKLYVIHANNLEVAIAEKEKLQKKYPNAEIEIGHFGPVIGTHLGEKAIGIAISAQ

SEQ ID NO: 6784 - protein, 127 aa, Enterococcus faecium
  misc_feature (B) LOCATION 1...127
  hypothetical: YES
TEEIIMALNIENIVAELKEATILELNDLVKAIEEEFGVSAAAPVAVAAAGGAAAAEEQTEFTVELTAAGDQKVKVIKAVREATGLGLKEAKAVVDGAPAPVKEGVSKEEAEELKAKLEEVGASVTVK

SEQ ID NO: 6785 - protein, 433 aa, Enterococcus faecium
  misc_feature (B) LOCATION 1...433
  hypothetical: YES
QEEMQMNKTEYEQINETLYHEVLPNGLTVYLLPKNDYHKTYGLFSTNYGSIDNEFIPYGEKEKVKVPDGIAHFLEHKLFEKEDGDVFQLFGKQGASANAFTSFTKTSYLFSTTDQVEKNLTTLIDFVQAPYFTEETVNKEKGIIGQEIQMYEDDPNWRMFFGILNNLYPTHPLHIDIAGTVESIDKITAQDLYTCYRTFYQPSNMVLFVVGKMEPEKLMKLIRENQEAKNFPPKQEIVRYFPENTKEIIKQSALEAAITRDKFVLGIKGLDTLPQEGTELLRYKTAINLLFQMILGNTSRNYLAMYNQGIIDDSFGFEFSLDREFHFADFSGDTDEPEKAAEKVKEIILGFADDPEVSETNLDLLKKKMLGQYFQSLNSIEYIANQFTQSLFGDRTLFDLPEIIDSIQMKDVLAAGEAFISEEAFSEFYMRPK

SEQ ID NO: 6786 - protein, 325 aa, Enterococcus faecium
  misc_feature (B) LOCATION 1...325
  hypothetical: YES
QEEIMKFHYHILINPSAGSGNGYKVAERILPVLKNKHIDYTLHYSEYKGHDAEIAETLAKETLIPWIEEEQKTIDTFPLLIIVGGDGTLHQVLDTFYQMEVEFPVAYIPAGSGNDFARGAGLPKNPKKGLQLILAAQSPEKVHIMAYEEKISEKKGIAVNNFGIGLDAAIVHATNHSSTKKRLNKYNLGSFSYLFSILRALFTQKGFPILVDAGGKQLSFSNAFLCTATKHPFFGGGIAIVPTADASKPVIDFVVVERINFFKILWLILLLIQKKQLKSKYFHHYTTNRLRIVSTTPQHGQEDGEEMEKRPFDITITTTKQLFWC

SEQ ID NO: 6787 - protein, 167 aa, Enterococcus faecium
  misc_feature (B) LOCATION 1...167
  hypothetical: YES
KREIIRRNIFFMSIEVGAKLQGKVSGITNFGAFIDLGAGKTGLVHISEVSNGYVKDIHDVLSVGDEVTVKVISVNDDGKIGLSIRKAQEQPAESGEESRPKKYQQKDPRDNRNRPAQKKSFSRSQPSAQKEDFDSLMSSFLKDSDDRLSSLKRNTEGKRGGRGGRRS

SEQ ID NO: 6788 - protein, 521 aa, Enterococcus faecium
  misc_feature (B) LOCATION 1...521
  hypothetical: YES
VNRMAIKAEEISALIKEQIENYQNVLSVEEIGTVTYVGDGIARAHGLENAMSGELLEFSNGSYGMAQNLESNDVGIIILGDFESIREGDKVKRTGKIMEVPVGEALIGRVVNPLGQPIDGLGEIVTDKARPVEAMAPGVMQRKSVNEPMQTGLKAIDALVPIGRGQRELVIGDRKTGKTSIAIDTIINQKGQDMICIYVAIGQKDSTVRTQVETLKKYGAMDYTIVVNAGASQPAPLLYIAPYAGTAMGEEFMYNGKHVLIIFDDLSKQAVAYRELSLLLRRPPGREAYPGDVFYLHSRLLERAAKLSDDLGGGSMTALPFVETQAGDISAYIPTNVISITDGQIFLESDLFYAGTRPAVDAGLSVSRVGGSAQIKAMKKVAGTLRLDLASYRELEAFTQFGSDLDAATQAKLNRGRRTVEILKQKLHAPLAVEKQVVILYALTHGFLDSIPVDSILDFEHELFEYLDTNHSDIFETIRTTKDLPEEEALNSAIQEYKDMFLATKGNNSSTEDKLKSIQNA

SEQ ID NO: 6789 - protein, 72 aa, Enterococcus faecium
  misc_feature (B) LOCATION 1...72
  hypothetical: YES
ICRIGKQIKTNTKKYRFRFKGGCDRSDQLQERRLFGKRSCDTTFVTALFYWKKRVLFFSYFTIKGKINNKKV

SEQ ID NO: 6790 - protein, 136 aa, Enterococcus faecium
  misc_feature (B) LOCATION 1...136
  hypothetical: YES
NQRILLYLITIVLLLRGLVQQKSAGNYASSLLPGTEAKELDYSDCVYLDPATHTKIEEVGAANFFGITKDGKFITPQSPSILPSITKYSLLQLAEERLGLQAIEGDIFIDDLDQFAEAWCMWYSGCYFSNRWDLSQ

SEQ ID NO: 6791 - protein, 278 aa, Enterococcus faecium
  misc_feature (B) LOCATION 1...278
  hypothetical: YES
RLRILNISRQTYYYQAKPIENESDLEEIVQEEFIRNRKAYGTRKLKKCLAKRGLQLSRRRIGRIMKRRGLTSTYTIAHFKGQRTACNEAKTANVLDRTFTQEQPLEAIVTDLTYVRVRKKWHYICLILDLFNREIIGYSCGEKKDASLVKEAFGRIPYSLTDVKLFHTDWGKEFDNQTIHEILNGFGITRSLSRKGCPYDNAVVESTYKSVKVEFVHQYQFETLAQLRLELFDYVHWWNYLRLHGTLAYETPIQIRQQRLAKRILDNERGSDTSGEAA

SEQ ID NO: 6792 - protein, 372 aa, Enterococcus faecium
  misc_feature (B) LOCATION 1...372
  hypothetical: YES
SERIMGGMTMSQFDQSITLPSGVQLKNRLMLSPMTTQLSFFNGVITEDEITYYKQRSKGLGAVITGAANVQDIGKGWPGELSIAHDEMIPRLSELAKAIQGEGAKAIIQIFHGGRMTSRATLSGEQPVSASAVAAKRPDAETPRAMSEEEIVETIQAFGKATRRAIESGFDGIELHGANTYLIQQFFSPHSNRREDQWGGSLENRYRFIEELLTTVFSAVEQYAKKPFIVGYRFSPEEYETPGIRFEDTIWLLERLRESKLDYLHVSLNMYDRIARSDKYNDKSILEVVHNTIQGKIPLVGVGGIRNREDVEQVLKYAELAAIGQQMIVDPDWAEKLLENREDEFVTKPFEEAYKELYLPSPLYNFLKARYQ

SEQ ID NO: 6793 - protein, 76 aa, Enterococcus faecium
  misc_feature (B) LOCATION 1...76
  hypothetical: YES
YDRIELKKERSERGESIMPFVHVELVEGRSPEQLENMMKDITEAVHKNTQAPKEHIHVIINEMKKGTYGVNGEWKK

SEQ ID NO: 6794 - protein, 203 aa, Enterococcus faecium
  misc_feature (B) LOCATION 1...203
  hypothetical: YES
SRRIGKKGVDSVNLPNKLTVLRICMIPIFILVVGLPLDWGQFNVGDTTLAVTQLVGAVIFALASITDWLDGKIARARGLVTNFGKFADPLADKMLVMTAFIMLVDQGKAPGWVVAIIVCRELAVTGLRLLLVEHGEVMAAAWPGKVKTATQMVAIILLFINNIPFSLIGIPVDQIMLYACLIFTIYSGVDYFIKNSGVFKGSM

SEQ ID NO: 6795 - protein, 289 aa, Enterococcus faecium
  misc_feature (B) LOCATION 1...289
  hypothetical: YES
RSRIKLGVGGKVMDIQTVLSDLKLNGKVIPVVGGDVNQTYRIKTEHRAYFLKIHPNVKKGFFEAEVDGLKELSAFVRVPDTYMLGETSEGAYLLMEWIEPGKGDQRDLAAALANLHQQTAPQFGFRKDNYLGTLVQKNSFEEDWWTFFFKDRLESQISLAEETNRWNVQRQEKYLRFKERVLKSVEPKKITPRLLHGDLRSGNVFFDQQGHPVFVDPAVSYGNREQDIAMSQLFGGFRPEFLDAYQTIFPLEKGWKDRLPIYQLYYLLAHLNMFGESYGSQVDQLLENF

SEQ ID NO: 6796 - protein, 294 aa, Enterococcus faecium
  misc_feature (B) LOCATION 1...294
  hypothetical: YES
VIRMKYILCQPAINRFKWELEVCLTNLKKPRIKEIVLLFSRHDDQIPIFFEKEYGVEVHVYDDLRDDKEYIPALKPYLWWKYLEEDHSREDDRYFYIDSDVIFNKRINLRKLPSKDDVWYCSDCCSYLSLDYIRSCENGENILKDMANIVNVTVESLETINTNSGGAQWVINRPKANYWKKVYLDSNRLYRYLRGQKTNIQIWTAEMWAQLWNMMYFNIGPKVHEELDFCFATDPIEKVKEVKILHNAGVTTNDEDLFFKGRYVTSTPFDEDLSFVNKKKCSYAYVKAIKAVVR

SEQ ID NO: 6797 - protein, 109 aa, Enterococcus faecium
  misc_feature (B) LOCATION 1...109
  hypothetical: YES
YSRMILSCVNVPVLSVHNTSIAPKFWMAFKFLITVPFLAITLAPLTKFVVTIIGSISGVRPTATDSPKRKASSQSPFVSPLMTITAGAINDINLISSMDVLWMPNSKLD

SEQ ID NO: 6798 - protein, 306 aa, Enterococcus faecium
  misc_feature (B) LOCATION 1...306
  hypothetical: YES
ESRMKKIIGAFVFAIIIIIICFQIDVFGQKKIVGQTVSSTNSTVTKTKESFDDTEQETLIKIGKNDRTLYTDDSLTTPLATINGGELAEFLSETKNAYQIKTNDGYTGYLALEDGTKVTKNIQTKPEELSDAVIVLDPGHGGNDTGALSNDEQTEEKDITLSTAIKVKKALEDAGATVYLTHTTDELVQLGDICDYSEEKKADVFISLHADSTEYANEATGITTYYYYGQEETLAQTIADSFTDLPLDSRGISTGNYQVLRENLQPSILIEMGYMNNDSDLKELVTDSYQQQIAASLTQALTTYFQ

SEQ ID NO: 6799 - protein, 109 aa, Enterococcus faecium
  misc_feature (B) LOCATION 1...109
  hypothetical: YES
GQRMIIPNSLEELAGYVETGKSVFFFTAGWCGDCRFIKPQMPEIENDFSDWQFIEVDRDKYIDVAAEWNIFGIPSFVVIQDGKELGRLVNKDRKTKQEIESFLESVTKG

SEQ ID NO: 6800 - protein, 67 aa, Enterococcus faecium
  misc_feature (B) LOCATION 1...67
  hypothetical: YES
WKRIETSLAEKAMDRLHLIVSQTKAQIAKVMFRSLRSFLHLYSFSHLLIGVKRSTSYKLIASPPVTP

SEQ ID NO: 6801 - protein, 393 aa, Enterococcus faecium
  misc_feature (B) LOCATION 1...393
  hypothetical: YES
GERISMIETINPAENKVSAYIHIPFCEHICYYCDFNKVFLEGQPVDEYVEMLLNEMKIMLESHPTANLETLYVGGGTPTSLSAKQLDRLLSGAREILPFQNGNEFTVEANPGDLTREKLQVMKNYGVNRLSMGVQTFDNRLLKKIGRKHTAEDVYQTMQFLEAENFTNVSIDLIYALPGQTLEGYLDTLEKALALDLPHYSLYSLILENKTMFMNWVRQGRLELPDQETETRMFEETIEAMEKHGRHQYEISNFGLSGHESQHNLMYWNNDHYFGFGAGASGYLGDIRYRNKGPIQHYLRPLRANERPVLEEEKLTRKNQIEEEMFLGLRKKTGITKKHFYDRYQKTIESVYGDVLRELEQEGLLVNEEDRVYLTPRGTFLGNNVFERFLFEK

SEQ ID NO: 6802 - protein, 194 aa, Enterococcus faecium
  misc_feature (B) LOCATION 1...194
  hypothetical: YES
GGRIMNEKIIEIKHLRKSFGENEVLKDISVTVNKGEVVTIIGSSGSGKSTFLRCINLLEKPTGGEIIYNGENVLAPKYNLPKYRTNLGMVFQSFNLFNNMNVLENCMSGQTTVLKRDKETAKKVAIENLEKVGMDRYIEAKPAQLFGGQKQRVAIARALSMNPDVLLFDEPTSALDPEMVGEVLNTIKDLEKRG

SEQ ID NO: 6803 - protein, 220 aa, Enterococcus faecium
  misc_feature (B) LOCATION 1...220
  hypothetical: YES
NLRIDVYKGRAKMCFFTTFTIIMIAVLFIFLDIAKRNTAFLLYRVLLRAGLITFISIVGFFLFTVIVFIWRTTAPPLPEITYGEFPFSLEYEIDEERILIEDTVIAEFIGSFRGNVTTQPRRSWSIKLLNNSGELKAFHYEFLIIESEDVTITLSSGSAGYFMNDGGSKPQLTVRDRIAGFMHFSHYDLEEARKILAEYGITLINWEYAPPIRNFFNDYY

SEQ ID NO: 6804 - protein, 66 aa, Enterococcus faecium
  misc_feature (B) LOCATION 1...66
  hypothetical: YES
IMRIFLYILYFDNSILIFKINKGGVTKFLSHLPFPNKLCSRNSFFENKLKFHKNLRSNFRTFLLLS

SEQ ID NO: 6805 - protein, 172 aa, Enterococcus faecium
  misc_feature (B) LOCATION 1...172
  hypothetical: YES
GMRIAIGCDHIVTDEKMAVSEFLKSKGHEVLDFGTYDHARTHYPIYGKKVGEAVVSGQADLGVCICGTGVGINNAVNKVPGVRSALVRDMTSAIYAKEELNANVIGFGGKITGGLLMNDIIEAFIEAEYKPTEENKKLIAKIEHVETHNAHQADEDFFTEFLERWDRGDYHD

SEQ ID NO: 6806 - protein, 115 aa, Enterococcus faecium
  misc_feature (B) LOCATION 1...115
  hypothetical: YES
KRRIEIMKNFDIVCSNTKNIYLRELLNSDSETIEDVKKIIVLFEKENMELENWGLFEIPISGNYCFYNWKTEDDVAFANYFFDKNYFSPLYIDKHSNEQVASSIKEAIKLERVRK

SEQ ID NO: 6807 - protein, 279 aa, Enterococcus faecium
  misc_feature (B) LOCATION 1...279
  hypothetical: YES
VRRIVMLNITIRGHDLSEVQTIEDLAEKTKEQGIHTLQLALGLSFPETPSGANEINSGMGNYVKRVLEKQEVTVGILSCYINMIHPDLTIRQELLTKFEQYLRYASSFGASMVASETGCVLPEIQYTEENFTDEAFAEAVSVIRRLVKAGEKYQMMVGIEPGLNHPVYSLARVEQLIQAVDSDYLGIILDPTNLITSSDYQEQVQLVEEAFERFGEKICAVHLKDFRVEQEKIVPVNLGDGVIEYTKIKEIIMKNRPYLYVVLEETKDDGIRYGRSLLE

SEQ ID NO: 6808 - protein, 198 aa, Enterococcus faecium
  misc_feature (B) LOCATION 1...198
  hypothetical: YES
KRRISLKTKEKILEATKDLIYKKGYHETSIRDILAASDTGKGQFYYYFSSKKEVCLAVIHAHMDVWQTELFEDILNAGKQPEEALEEMLDWIFADHETQITYHGCPVGNLIIELSTVDEEYRLLLLELVNQWVKYTKQNILALSEEKLSDEEADRQAKALIAEIQGSILLLKVTQDLSLLRQNFQLIKERLLTSQKVL

SEQ ID NO: 6809 - protein, 133 aa, Enterococcus faecium
  misc_feature (B) LOCATION 1...133
  hypothetical: YES
KRRIFMKKILGLIVIVLIAFIGWKGWDYYQSTYVGKDYYAVIKAPMPAETDIKADNGEVIGKGFKYNVDAYAENGEKRQLDFDVITSGDSANGSAYPEGTILQLKASEKRIIEKKVITSDKVPSSVKDKLGLS

SEQ ID NO: 6810 - protein, 76 aa, Enterococcus faecium
  misc_feature (B) LOCATION 1...76
  hypothetical: YES
ERRILMKTLDAIALTLLIVGGLNWLLVGLFELDLVAMIAGGSTTIFAKIIYIVVGICAIYCLKFFPMITRKVDERY

SEQ ID NO: 6811 - protein, 583 aa, Enterococcus faecium
  misc_feature (B) LOCATION 1...583
  hypothetical: YES
RSGIEGVSTEQGKAAAKQNLHPVQRAIAVLAEIFTPLIPAIIVGGLILGFRNVLEGIQFESLGGTIVEHSKFWNGVNAFLWLPGEAIFHFLPVGITWSIAKKMGTTQILGIVLGITLVSPQLLNAYSVASTAAADIPFWDFGFAQVQMIGYQAQVIPAMLAGFMLAYLEIFFRKYIPQSISMIFVPLFSLLPTVLAAHVILSPIGWTVGSWISNIVNTGLTSSIXWLFSAVFGFLYAPLVITGLHHMNNAIDMQLIADFGSTNLWPMIALSNIAQGSAVLAIIFLHRGNKKEEQISIPAMISCYLGVTEPAMFGINLKYVYPFVAAMVGSGLAGMFANLMGVRANAIGVGGLPGILAIQAETWVPFIIAMIIAVIIPFGLTIIFRRQGILNKIDPAVPENAADVQLQTANGATATPQSFEPVSATGTAVATKETLFAVAAGTIKEITEVNDPVFSQKMMGDGYAVEPSNGKVYAPVNGKVTSVFETKHAIGILSNEGLEVLVHMGLDTVELKGVPFNVFVKEGYLVTPETLIAEMDLPEIEQAGKKTDIIVALTNNEKVAGLSLDQSGLVRPGEAVGKAEVKS

SEQ ID NO: 6812 - protein, 68 aa, Enterococcus faecium
  misc_feature (B) LOCATION 1...68
  hypothetical: YES
AAGILAEIGPIERFSDEIKLTKYAGLYWRQSQSGKSEYENFFTKSFTSNIYFKIKIFLLIWNRFLLLV

SEQ ID NO: 6813 - protein, 264 aa, Enterococcus faecium
  misc_feature (B) LOCATION 1...264
  hypothetical: YES
KKGMRNMNTPQIFNFEQNEVRTILVNDEPYFVGKDVASVLGYSNTKDALSRHVDLEDKMGSRITTSGQSREMTIINESGLYSLILKSKLPSAKKFKRWVTSEVLPAIRKHGGYLTPEKVEEALLNPDTIIQLATQLKEERTGRLIAEQKIAEYEPKISYLDSILSSTDSVTISQIAADYGMSPQQMNKLLHKLGIQKKVGNQWLLCKKHMNQGYTKSHTTEIPKADGGTKIVMNTKWTQKGRLFIYELLKKEGYYPQMDLEEIG

SEQ ID NO: 6814 - protein, 85 aa, Enterococcus faecium
  misc_feature (B) LOCATION 1...85
  hypothetical: YES
KKGIETMKKEYGYPTLKVICKASAGNETAIREILKFYDAYICKLCLRPFYHSESGKITMQVDEELKGQIHTEMMKAILKFEIRVK

SEQ ID NO: 6815 - protein, 75 aa, Enterococcus faecium
  misc_feature (B) LOCATION 1...75
  hypothetical: YES
SEGISGCSRNLGRPDVYDYYPGAVSKHPYRCDPSFSDDFFFGFWGVHADEPVDWRSISDGTHLYAAADERKRPFG

SEQ ID NO: 6816 - protein, 236 aa, Enterococcus faecium
  misc_feature (B) LOCATION 1...236
  hypothetical: YES
KEGIKKMKIGIIGAMEEEVKILRENLSEPLSWERAGALFISGSLGNHEVIVVRSGIGKVLASITTSLLIQQYGVNMVINTGSAGGIGEGLQVGDIVISDKVAYFDADATGFGYNPGQLPGMPLYYEASTYLRSEMVKAAKATNLNAKEGLIVTGDTFVDSPDKIKEILTNFPEALACEMEGAAVGQTARQFNIPFLIVRAMSDTADHSATQSFDEFIEDAGKRSAEMVIEFVKHLV

SEQ ID NO: 6817 - protein, 436 aa, Enterococcus faecium
  misc_feature (B) LOCATION 1...436
  hypothetical: YES
ERGMQMNIVIVGGSFAGIHAAIYLRQLMPTSEIYLIEKQSKLGWIPSGFNLILKGKVTSEKQLSWITKEELTDRYRIHVYTEKTVIGLKEKKVVLAGGKKLDFDRLILATGSNQKFRNISAESTLIHPVKKIQNVTALQQKIMNAKKIAIIGAGQAGIEIAEGLASRKKQIHLYESRKSILFRYLDPEMTEPLVKEMKNQGLSLFLEEQVVSLTENETAIVETEKRKENYDLVLLANHSRPDNQMWEEQLTLNDDGTIWVDDYLQTSQKDVYAIGDAIQVTFRPTNEKMYVSLVNNAVRTARNVSKTISGSQTKDQGTYRPVGNQWFGYFLGSVGLTEEESIFYPQKIETGYVDYKLTAINQSKVKLKFLFDSEKKILGAQLQSKKEMFHLLDQLTIAVEEGWTFEQLEEHELFFQPEYRVPDMVWSKVANTAYED

SEQ ID NO: 6818 - protein, 188 aa, Enterococcus faecium
  misc_feature (B) LOCATION 1...188
  hypothetical: YES
TGGIKMKKILLGVTGSISAYKSADLTSQFVKLGAQVDVIMSKSSTHFITPLTLQSLSKRAVHTDVMQESNPQVINHIELAKQADLFLIAPATANIIGKLANGIADDLLSTVAMALPVGTPKLIAPAMNTNMYQNPITQRNLETLRSVGYQEIEPRESLLACGDFGKGALADIQTIIEQVMLTLNERNA

SEQ ID NO: 6819 - protein, 122 aa, Enterococcus faecium
  misc_feature (B) LOCATION 1...122
  hypothetical: YES
IGGISMVYVKKSETFKEINFLKSQQFISFTKQVDHTHAGVVNGVLPAGSVYPANDGKAEGITINDVDVSNGAQPVGVIIDGHILIERLPVKPSDAAQKAMREIKLYDASGKMIALPAAASGL

SEQ ID NO: 6820 - protein, 161 aa, Enterococcus faecium
  misc_feature (B) LOCATION 1...161
  hypothetical: YES
SKGMNKMAHQNTSDLIESYIKKILENSEMIEIRRIEMADLFNCVPSQINYVINTRFTIQRGYLVESKRGGGGYIRIAKVRISDKKQLLEQINQLFDDTISEKNAFAIIQKLYEDQIITKKEGNLMLSAIAKNTLNFNEYEDHTRARILRAFLERLSYEDGK

SEQ ID NO: 6821 - protein, 404 aa, Enterococcus faecium
  misc_feature (B) LOCATION 1...404
  hypothetical: YES
LGGIIIMVERHLFTSESVSERHPRIKIADQISDAILDAILKQDPTARVACETSVTTGLVLVFGEISTTAYVDIQKVVRETIKEIGYTRAKFGFDGDTAAVLVAIDEQSPDIAQGVDEALEIRDEDKKDVLDEIGAGDQGLMFGFAVDETPELMPLPIALSHRLVRRLADLRKSNELTYLRPDAKSQVTVEYDDQGQPERVDTIVISTQHDDAVDNETIRHDVIEKVVKEVIPAELLDDQTKYYINPTGRFVIGGPQGDAGLTGRKIIVDTYGGYARHGGGAFSGKDATKVDRSASYAARYIAKNIVAAGLARKAEVQLAYAIGVAQPVSISINTFGTGTVPEEELIAAVRENFDLRPAGIIEMLDLRRPIYKQTAAYGHFGRTDVDLPWEHTDKVHALKASLAK

SEQ ID NO: 6822 - protein, 117 aa, Enterococcus faecium
  misc_feature (B) LOCATION 1...117
  hypothetical: YES
LCFFVFYTSKPVTIALKKLTKVAVSKIFNPCFATRFPFSSFNPFIAPEMIPIEEKLANETRKTDIIAVVRSVKWKLPFANSVIATNSFVTSLVAMILPASTASFHGIPLMKARGAKM

SEQ ID NO: 6823 - protein, 87 aa, Enterococcus faecium
  misc_feature (B) LOCATION 1...87
  hypothetical: YES
THTLVLHALRTPKVPFIQSNATFAMFVIXTLGIXVGSVFPFTSFGAELGLMPLPGNYWLWLFATVIAYLALVTAVKKIYIRRFQELL

SEQ ID NO: 6824 - protein, 92 aa, Enterococcus faecium
  misc_feature (B) LOCATION 1...92
  hypothetical: YES
VSTLRSYSPGGVLNALAAALKGGNPPTLSTHRLRRGLPGYLILFAPHAFEPQRQLQTREPPSPLVFLHISTHFTATHGIPLSSSALKSPSFQ

SEQ ID NO: 6825 - protein, 92 aa, Enterococcus faecium; identical to SEQ ID NO: 6824
  misc_feature (B) LOCATION 1...92
  hypothetical: YES

SEQ ID NO: 6826 - protein, 69 aa, Enterococcus faecium
  misc_feature (B) LOCATION 1...69
  hypothetical: YES
YFLILGIVLLSVSTLGITVDAATYYGNGVYCNTQKCWVDWSRARSEIVDRGVKAYVNGFTKVLGGVGGR

SEQ ID NO: 6827 - protein, 64 aa, Enterococcus faecium
  misc_feature (B) LOCATION 1...64
  hypothetical: YES
SFLIILKKTDPNQNQFLILIRKKEKANFKNQNLKKRIFTGKEKSETYGSSRLASHSICLSIHAY

SEQ ID NO: 6828 - protein, 617 aa, Enterococcus faecium
  misc_feature (B) LOCATION 1...617
  hypothetical: YES
SILIDRAKGRKGVDFMEVKQLPKREELPENLTWDLTKIFSSDQEFDEKYLELSEELKQSEKHKGTLDQGASQFLNAIEFVLRVYRQTEVIYVYAHLKNDQDTGNTDYQALYARASSLFSKVSEAVSWFEPEILQLSDDQIWQYFKEEPKLEVYRHYIQQIVDNRAHVLSAEQESLLAGAGEIFDASSDTFAVLNNADLVFPTIEGENGEIVQLSHGVYGQLLESTDRRVREAAFKGLYSVYEQFRNTFASTLGTHIKGHNFKAKVRNYSSAREASLSNNHIPESVYDTLVDVVNKHLPLLHRYMELRKRLLEVEKLHMYDLYTPVLGEAPITFTYEEAKEKALEALKPMGEEYMAIVEKAFSERWIDVVENKGKRSGAYSSGSYDTNPYILLNWHDTLDQLFTLVHEMGHSVHSYFTRSNQPYVYGDYSIFLAEIASTTNENILTEYLLETEKDPRVRAYVLNHYLDGFKGTVFRQTQFAEFEHFMHTEDEKGVPLTSEYLSDSYGKLNAKYYGPAVEEDPEIKFEWSRIPHFYYNYYVFQYSTGFSAASALAKKILNQEPEALENYLAYLKAGNSDYPVEVMKKAGVDMTQAAYIEDAMSMFEQRLNELEELIDRL

SEQ ID NO: 6829 - protein, 859 aa, Enterococcus faecium
  misc_feature (B) LOCATION 1...859
  hypothetical: YES
QCLIERSIAGFKEIEYEVMRDSADNAIVVCNMENFDPVGIHTGDSIVFAPSQTLSDHEYQMLRDASLSIIRALKIEGGCNVQLALDPHSFNYYVIEVNPRVSRSSALASKATGYPIAKLAAKIALGLTLDEMKNPVTGTTFAEFEPALDYVVAKIPRWPFDKFENGERLLGTQMKATGEVMAIGRNIEESLLKAVRSLEIGTHHIELPELADITDDDLIQKVVRAQDDRLFYVAEAIRRGYTIEELADLTKIDLFFLDKLLHIVEIEQQLKQQPLDDKILKTAKQNGFTDKKVAELWEINEEAVRQMRKENDLIPVYKMVDTCAAEFESKTPYFYSSYEYENESSRSEKPSILVLGSGPIRIGQGVEFDYATVHSVKAIQQAGYEAIIMNSNPETVSTDFSISDKLYFEPLTFEDVMNVIELEQPIGVIVQFGGQTAINLAEPLTAAGVKILGTTIEDLDRAENRDLFEQALKELDIPQPLGDTATSKEEAVVIASRIGYPVLVRPSYVLGGRAMEIVENQRDLEDYMEHAVKASPEHPVLVDRYLLGGECEVDAICDGETVLIPGIMEHIERAGVHSGDSMAVYPPQTLSESIKKTIEDYTIRLALGLNCVGMMNIQFVIHENEVYVIEVNPRASRTVPFLSKVTGIPMAQIATKAILGEKLKTLGYENGLYPETKEVHVKAPVFSFTKLQKVDTYLGPEMKSTGEVMGSDRQLDKALYKAFEASGLHLPEYGAVLFTIADETKEEALELAKRFTEIGYSLIGTKHTAAYFEKNGLVVETVAKISEEAAEKNVVDLIRDGKTQVVVNTIDKDRGNASKDGFIIRREAVEHGIPLFTSLDTADAIVRVMESRAFSTNPI

SEQ ID NO: 6830 - protein, 630 aa, Enterococcus faecium
  misc_feature (B) LOCATION 1...630
  hypothetical: YES
SLLILGIQLFRIYLGEGTGDMTADIVSAVMFAVAVAVAAIPEALQCIVTIVLSLGTNKMAKRHAIIRKVPAVETLGSTSIICTDKSGTLTQNKMTVVDYFLGNGDTGDFTNDPSKWTADERRLIEISVLANDASISEDGTKLGDPTEVAFIDFSEKLNQPYQEIRNNYPRQAELPFDSDRKLMSTGHTIDNKNYLFVKGGPDIVFQRSKKVLLNGEVVPMTDELMKKFQEQNEAFSTRALRVLAFAYRPLDNFDLSFEDEDDLILVGLLAMIDPPRAEVTQAVTEARSAGIKTIMITGDHKTTAVAIAKQIGIFEEGNLALTGTELDELTEDQLNEVLEKVTVYARVSPENKIRIVRAWQNKGHISAMTGDGVNDAPALKQADIGIAMGTGTDVAKDAAAMVLTDDNFASIVSAVEVGRNVFDNIKKAISYLFAGNLGAIIAIIFALVADWSNPFTALQLLFINLVNDSLPAIALGTEKAEPATMNRPPRDPNSGIFTDKTLISVTYRGVLIGIAVIFAQWLGMQHSPEFGVAMSFSTLIWCRTLQTFPARSNTQTAIQAGFFSNRSVLLAVVVCSALYCLTMIPGLKEVFSIPSAFGLTEVFTCMGIALVTIVLMEITKLIIVRVQGNK

SEQ ID NO: 6831 - protein, 117 aa, Enterococcus faecium
  misc_feature (B) LOCATION 1...117
  hypothetical: YES
KQLMKDTGHLLCQSRKCRFNRMIKKIKTLIDGFLLERKLVKVRELIKIHIDSGERSMYWVATDSEKQNVMNMIRFFEIAFEDGYFATGEYFDASSWMSSNPEEVWQIYLEMKEVAEG

SEQ ID NO: 6832 - protein, 335 aa, Enterococcus faecium
  misc_feature (B) LOCATION 1...335
  hypothetical: YES
KKLIQIGRDTLLNKKHSIISDISLNIFSITITTGIMQLVVYPMISSFVPIGEFGYILTLMGLVNVISVVVGGSLNNVQLINRTYYLNEEDYYGDFKRLFILSLFISMAVSLLILGTNVFNILLINKLLLLLVILFTTLRAYLTVYWRIELNYRFILYHSITTSIGYLVGTYLVKISIPSLWPLAFLSGEIFSAIYLFFKTDFFQRKLSKSNNFIKIKRDYVNLLSSNIVSNILIYFDRFILQGTLGAKEVSIYFAASVFGKLSSMILQPISGVFLSYLSREDKDSKKKYFVLFLSITVISGVILFVISIIFSPILVRVLYSELFEDAMPFMIKSV

SEQ ID NO: 6833 - protein, 60 aa, Enterococcus faecium
  misc_feature (B) LOCATION 1...60
  hypothetical: YES
RGLIAATCIATSLATVSSVVPSRTVNTAIRPPICKYPPNAALSSFSTTSKRRKLIFSPIT

SEQ ID NO: 6834 - protein, 128 aa, Enterococcus faecium
  misc_feature (B) LOCATION 1...128
  hypothetical: YES
NKLIEVEILASKRVAGTIMLHLEDGTKKFLVHSIDDKLEFALAELSEGKTGLANILNFLKEIVHIDVSKISLMELTNTHIKEENVPLFVFETEQKNQREELGEGYIWEEPGQMRSVLGTYEVEGVPFF

SEQ ID NO: 6835 - protein, 581 aa, Enterococcus faecium
  misc_feature (B) LOCATION 1...581
  hypothetical: YES
RRLIHMSKINAGIAMVKVLESWGIDHIYGIPGGSFNSIMDALYQEKTEINYIQVRHEEVGALAAAADAKLTGKVGAVFGSAGPGATHLINGLYDAQMDHVPLVAFLGQVASTSMNYNSFQELNENPIFADVSVYNRTVMTPQSLPHVVDEAIKAAYEHKGVAIVTIPVDLGFEEIDEQPFSTAHTHKTSVILPEEKDLLAALPYLEKAKKPVLYVGQGTRNGFPQIKEFSEHFSVPVVASVLAKGIIPDDYENFLGFAGRVATKPGNEALAEADLILFVGSDFPFGRAFFNPTAEFIQIDIDASKFGRRHETSLSILGDANTALQRLVELGDARPADSWYLANQENKEKWVNWLKSFEDREEEPIRPEAVYKEINRIAEDDAIFVTDVGNTTIHSIRLLNMNGKQKHTTSGWFATMGNGVPGGIAAQLSYPEKQVFTLSGDGGFAMVMQDIITQVKYQLPIINVVFSNDSFGFIEAEQEDTEQKKFGVFLEDADFGKVGEALGANSFTVTEYSQLRFAFDAAAKSDRPVVIDVKINNKRPLPVEDLHLDPRKYSEEEIQAFKEKYEVHDLPVLNELYEKRL

SEQ ID NO: 6836 - protein, 432 aa, Enterococcus faecium
  misc_feature (B) LOCATION 1...432
  hypothetical: YES
EKLMKWVEEKLVPPMAKIGTQRHLLAIRNGVVSTLSLILIGTFFMVFINLPFPGWNEFIAPYSATIVLPFRMTMGLMAIYATFVMGSDLAKSYGLDSVTGGILSLGTFFMLQVPVNVLTPEEAPLGWVLPMSSLGASGMFAGILSMIFAVEVYRFFKNRNITIKMPEQVPPAVARSFEALIPGAVILTITWLIRSVAGFDVNAALLSLFEPLTNILGNNLLGVLLPMFLIHLLWSFGIHGMSIVGAVVRPMWLIMLDENAKALADGTAATQLPYIAPEQFYQWTVTIGGAGATIVVSVLFIFFCKSKFLKEVGRFSIIPGIFNINEPIIFGAPMMLNPYMFIPFNLVPLVLTIISYFAVKLEMVNRFTVLPTWTLPAPIGGYLSAGNDWRVVILIMINTLIAFIIYYPFVKAYDKKMLSDEQSRGENEVQTV

SEQ ID NO: 6837 - protein, 106 aa, Enterococcus faecium
  misc_feature (B) LOCATION 1...106
  hypothetical: YES
IIMMRGMGNMQGMMKQVQKMQKEMAEAQELLNKTEFTGKATNELVKAVFTGDRRMKDIQINEEVVDPDDIEMLQDLVVMAVNDAIAQIDVETEKKLGKYAKGLPGF

SEQ ID NO: 6838 - protein, 208 aa, Enterococcus faecium
  misc_feature (B) LOCATION 1...208
  hypothetical: YES
LNMIFPKVNEASLNKGSFFHIYENEDFELYNILSQKEVIENQIICHPIIYKSIFKYAFFASNDFQRMEITDCIFENCDFSGCILTKSMLHRVKFVNCKLTGTKLMESYIGNTLFENCKMDYVNLSGSNIKESTFEHSVLSSADFVDCSLTKIMFSTNDLENASFFDTDLKNIDLSSNSFEMIEVRSEHLKNCTLNQLQALGFARKFLQ

SEQ ID NO: 6839 - protein, 123 aa, Enterococcus faecium
  misc_feature (B) LOCATION 1...123
  hypothetical: YES
QNMIKTCWKNLPLLLSFVPYVHFALLLDFYYHSVSGFITLIFLSLFAGYYFQKSRRILSLFIANIISTVTSYLFCVNFAEWRYFYHPLKPTQLILILAGIYLVPQILGSLWAVALSYKKARHP

SEQ ID NO: 6840 - protein, 549 aa, Enterococcus faecium
  misc_feature (B) LOCATION 1...549
  hypothetical: YES
NDMIQEQKWWKEAVGYQIYPASFKDSNGDGQGDINGIREKLNYLKDLGIGFIWINPIYQSPFVDNGYDVSDYQDIEERFGTMEDFDLLLKEAHELGIKVIMDLVINHSSDQHQWFEESKKSKESPYRDYYIWVDGVDGKEPNNWTSIFGGSAWEYSHETGQYYLHVFAKEQPDLNWESEKLKEELFNMIRWWLDKGIDGFRLDAISHVKKDEYSVKATENPFSPFQNVSGIEEHLTDLKHVFEEYDIMTVGEASGVTAEEGPQWVGKDGYFDMIFEFDHIHIWQQEKEGQLDVLKLKHALSAWQTSLDGIGWNALYMENHDVPRAVSVFGDTRPDFWAMSAKAIAMMYFFLQGTPFIYQGQEIGMTNMPFESIDQVDAVDSKRLYKRLLAEGKTREEALDIIRETTRDNSRTPMQWTSEQYAGFSTHEPWLITNPNTKTINVEQQEYEPESVLQFYKNMIRIRQTNKGLIYGSYKEYLHEHPQLYVYERYLEDEQYLIMVNLTESLADYELPKEADQSWTLLLSNSSSGEFEAKGILAPYEARLYKTNK

SEQ ID NO: 6841 - protein, 429 aa, Enterococcus faecium
  misc_feature (B) LOCATION 1...429
  hypothetical: YES
GRMMTRRGKGKAGFAHLQDREGQIQIYVRKDQVGDEAYEVFKHADLGDFFGVTGQIMKTDTGEVFIKASEITILSKALRPLPDKYHGLTNIEQRYRQRYLDLISNRESFDRFMKRSQIISEIRRYLDGNGYIEVETPVLHNEARGAAARPFITHHNALDIDLYLRIALELHLKRLIVGGMEKVYEIGRVFRNEGIDTTHNPEFTMLEAYTAYTDFNDVMNLTEGIIRNAAEKVLGTAKITYDGQAVDLESDFKRIHMVDAIKEQTGVDFWQEMTLEEALALAEKHNVEVTEAMGVGHVINEFFETFVEETLTQPTFVYGHPVEVSPLAKKNPEDPRFTDRFELFIVGREFANAFTELNDPIDQRERFEAQEKERELGNDEAHGVDEDFLEALEYGMPPTGGLGIGIDRLVMLLTDAQSIRDVLLFPTMR

SEQ ID NO: 6842 - protein, 70 aa, Enterococcus faecium
  misc_feature (B) LOCATION 1...70
  hypothetical: YES
CLMIRIKGGGTMAKKSKVQFVCQNCGYVSPKFLGRCPNCGKWNTMVEDIDQDTTDRRTRTSLTARTNLTH

SEQ ID NO: 6843 - protein, 72 aa, Enterococcus faecium
  misc_feature (B) LOCATION 1...72
  hypothetical: YES
LLMINLGAILTCLTSKFPLVYSVYIIYTNSFHHYPNKRIYSIDQFFTLPIVKIYPVTPRRKLLIDQVYSLFF

SEQ ID NO: 6844 - protein, 80 aa, Enterococcus faecium
  misc_feature (B) LOCATION 1...80
  hypothetical: YES
VTMIVALFLSFDSFAKISTTSRAFSESKLAVGSSARIMDGSLYNARAIATLCRSPPDSSSGYLLINLSTPSCSNNSFASF

SEQ ID NO: 6845 - protein, 338 aa, Enterococcus faecium
  misc_feature (B) LOCATION 1...338
  hypothetical: YES
SNMISYPLLERNATIGVTAPSSGVSEEHHSLLESALKRMEEKSFQVVTGKTLWTQDKEKSGPARKRADEFNQMMQDENIQMIFPTWGGELLIEILDFVDFDALQPKWIVGYSDISTLLLAVTLKTGIATAHGTNLIDLRGEYLDETTAMWESVLKTREGESILQQSSEKYQKVWPHEHSSSSVFHLTEPTNWQSVSGDAVRMKGRLLGGCIDTIRHLIGTPYGDVQSFKRKYNDGKPILWFLENCELSSVDLRRSLVQMKLAGWFDGSSGIMFGRSAAEDLLDYKMKDVYEDLSKELKLPILYDIDCGHVPPQLTLINGAYAEVAVEDRKATVLQTFI

SEQ ID NO: 6846 - protein, 280 aa, Enterococcus faecium
  misc_feature (B) LOCATION 1...280
  hypothetical: YES
SCMIFVKENLDDTHWIVAKKWSKKVMTESIQSIKERLKSIQRIDDPTLESLRNDPRKGVQQALASFERRLKKEALIKEKYEEMFCFEKQGYAQGHQWIAGIDEVGRGPLAGPVVAAAVILPKNEIILGLNDSKQLSEKKRELLYQQVQEKALAIGIGIVDQQTIDDVNIYEASKLAMIQAVEKLSIVPSYLLIDAMTLDLPIQQEKIIKGDARSVSIAAASIIAKVYRDQLMKEYDVLYPGYGFSHNAGYGTKEHLEGLERQGITPIHRKSFAPVKKYLQ

SEQ ID NO: 6847 - protein, 423 aa, Enterococcus faecium
  misc_feature (B) LOCATION 1...423
  hypothetical: YES
EIMMNSIENEEFIPILLGSDMNVYGMARSFNEAYGKICQAYASDQLAPTRYSKIVNVEVIPGFDKDPVFIETMLRLAKERYSDKSKKYLLIACGDGYAELISQHKQELSEYFICPYIDYSLFERLINKVSFYEVCEEYDLPYPKTLIVREEMLVNGHLEQELPFEFPVALKPANSVEYLSVQFEGRKKAFILETREEFDLILGRIYEAGYKSEMIVQDFIPGDDSNMRVLNAYVDEDHQVRMMCLGHPLLEDPTPASIGNYVVIMPDYNEKIYQTIKAFLEKIEYTGFANFDMKYDPRDGEYKLFEINLRQGRSSFFVTLNGLNLARFVTEDRVFNKPFVETTYGTNQSDKARLWMGVPKKIFLEYARENEDKKLAEQMIKENRYGTTVFYEKDRSIKRWLLMKYMFHNYIPRFKKYFHVKEG

SEQ ID NO: 6848 - protein, 81 aa, Enterococcus faecium
  misc_feature (B) LOCATION 1...81
  hypothetical: YES
IPMIYEDGQDPLPRVLGDIMISIERAAEQAEAYGHSYDRELGFLAVHGFLHINGYDHMTPEDEKEMFGLQKEILDAYGLKR

SEQ ID NO: 6849 - protein, 66 aa, Enterococcus faecium
  misc_feature (B) LOCATION 1...66
  hypothetical: YES
AAMIVVFSFLISFKLCKIASSVLASTAESASSNINNSGFLINARAIEILCFCPPDKETPRSPTKVS

SEQ ID NO: 6850 - protein, 286 aa, Enterococcus faecium
  misc_feature (B) LOCATION 1...286
  hypothetical: YES
RQMMDYFKKTSVNRQTKKILSYVLMTVIGIILIIPLLWMVFTSLKPMEEIVRYPPTFFPEKIVWENYLDTIAAFPFWRYARNTLFITVLVVIGNVLSNSFIAYGFAKLDFPGKKLMFALVLSTMMIPGFVTMIPQYVLFSKIGWVGTYLPLIVPSFFGNAFNIFLMRQFYLSINNELIEAAEIDGANHLYIWSHLMLPLTKPALITIAINSFNAAWNDFLGPLLYIQDQEKYTLQIGLQVFQNQATTQWNYLMAGATLVLIPTILLFFFAQRYFIEGMDLTGGSKG

SEQ ID NO: 6851 - protein, 76 aa, Enterococcus faecium
  misc_feature (B) LOCATION 1...76
  hypothetical: YES
QKMMEVVTEVVSSKIFRIIFRKSYFWNTVYQEVVSLPFSSESQGTISKNSFSCLMNIVTCDSELAGEHRLFGRIGL

SEQ ID NO: 6852 - protein, 150 aa, Enterococcus faecium
  misc_feature (B) LOCATION 1...150
  hypothetical: YES
EEMIRMAHEKTRYKAVIANQTYTIIGRETKHHMDIVTKLINEQLAELKQLSPQMDNEQAAILMAVNALSDQLKKQERILELEEETAELKKKMIKFTELENRVKRIEAIENEAREVLKENGQADHTIKNHVEAQQILNEKRKGQIKQKSSN

SEQ ID NO: 6853 - protein, 94 aa, Enterococcus faecium
  misc_feature (B) LOCATION 1...94
  hypothetical: YES
FRMISLISGFTYCWQMPRSFLETSRPEMLEMMMFFSTEKPSKYWTLVTKFSSAALAMVWKRLPFNSCWPISKAKEVVRLLITKSSPIIWGFKLL

SEQ ID NO: 6854 - protein, 194 aa, Enterococcus faecium
  misc_feature (B) LOCATION 1...194
  hypothetical: YES
LRMIFILILSESLNKSNRFFICFRYYWEYAIIVRKTKRRRRVFFMAQDDVKSHLDKGLYGTPLVNPEEQHKYLGTFRERCYLSMTVAEMIQPKNKENFLKELKKHPDASILLNGALPLSVQNQYIQLATKNNSRFTVVNDYVTANPEEFGLLLTAKEAVNEPVIDIEKKYPEENSSPAEKEKPKKKKSFWDRLF

SEQ ID NO: 6855 - protein, 62 aa, Enterococcus faecium
  misc_feature (B) LOCATION 1...62
  hypothetical: YES
GMMICGTIESNPIKKEAHANNVNEGAKKAANRETADNATIRMINFGRSTTSPKGTKNSNPNA

SEQ ID NO: 6856 - protein, 243 aa, Enterococcus faecium
  misc_feature (B) LOCATION 1...243
  hypothetical: YES
VVMMMAKKLSEFLPPKFHSVWRATLNQDILNIVCKGGRGSGKSSDIAHIVTQLLMRYAVNAVGIRYVDNTLEQSLYEQMKWAIEQQGVSHLFKFNKSPLKITYLPRGNYMIFRGAQNPERIKSLKDSKFPFAIGWIEELAEFKTEDEVTTITNSLLRGELDDGLFYKFFYSYNPPKRKQSWVNKKYETSFQPKNTFIHHSTYKDNPFISKEFLSEVEAARARNPRRAEWEYDGKAIGCGVVPF

SEQ ID NO: 6857 - protein, 72 aa, Enterococcus faecium
  misc_feature (B) LOCATION 1...72
  hypothetical: YES
LPMIRLGAFGMSTLCPSVSVTVCVLVDEVVELVVVAVSSSEEGEQALNTPASSHMLDKVNTFVFKFISFLLT

SEQ ID NO: 6858 - protein, 67 aa, Enterococcus faecium
  misc_feature (B) LOCATION 1...67
  hypothetical: YES
IKMILPDKYYQIIKWAVLTVLPATSVLVATLGKAYGWNGTDMTVLTINAVATFLGVISGVSAYNLKL

SEQ ID NO: 6859 - protein, 212 aa, Enterococcus faecium
  misc_feature (B) LOCATION 1...212
  hypothetical: YES
IKMIKVLLVDDHEMVRLGVSSYLSIQEDIEVIGEAENGRQGYEKAMALRPDVILMDLVMEEMDGIESTKAILKDWPKAKIIIVTSFIDDEKVYPAIEAGAAGYLLKTSTAHEIADAIRATQRGERVLEPEVTTKMMEKMSRRNDPVLHEELTNRENEILMLISEGKSNQEIADELFITLKTVKTHVSNILAKLEVEDRTQAAIYAFKHGLVK

SEQ ID NO: 6860 - protein, 624 aa, Enterococcus faecium
  misc_feature (B) LOCATION 1...624
  hypothetical: YES
GEMIMQQLTKRERQLLIYLVEMSEPVTIKKLAEKENVSVRTIKYDLDDIREWLNERKQVLYSKRSQGIWMNISSSDRIKLKSELMDVNRFEIFADQSLRIKRLLIMLLVTKEAITGMKMANALDVSKDTIMNDLDVLENNFLKEGLTLNRQARKGFWIIGEERLVRLTIEEILQKEFTDYDIYKLMSLLLNGGETEYFEMYSATATPIQEVFNQVIIRMRHLLEFENLEKLNYAELLNILIRVTIATVRLRKEATIGRYQLVAEQELDKNDLSYRVMQQVFDYYQLPLFEDEYHYIYSDTFDTIHQQDVMKLVENVIYKVSKAINHSFYQDPQLLTNLYAHLSMRLSRKKKFVNEYNPFKEDIKQKYPELFDAIKQAVRQEISEQNILINDSFVAYIALHFLVSYEREEDLRSVRAVYICSTGLGVTSLIKQKINEELNNITIVAFASVLNAQEMIATKDPDLVISIFPINGIDRPFIKVHPLPTEQDLKKIQQIIKKILASSNQQERHNLNLRETSINKDTLEDFSKELILKAYTIYERLLVILEAELIQEYREAFLLHVFLMVHRITFDQQYMAEGRQVDQIILDKGTLVGKIEAVFAENNLGINQSEISALFSYIKEGASS

SEQ ID NO: 6861 - protein, 663 aa, Enterococcus faecium
  misc_feature (B) LOCATION 1...663
  hypothetical: YES
EWMIMKQKEKLLLRYLIDHKKEYVTSQRLASELLLSDRTIRNYLQRIKELVEKNGGKIIAKPGYGYQLHILQRLTFDLFLSRQEIVPGYAREPQGFYESEDRQKYILNQLLLEDAILFMDDLAEELYISRSSLTKDMQEIKERLIPYSLKIVSKHGQGTWIEGEERNRRHFIMDTFFGNHYGNSLKEYLGQSRFFPDISFEELVIIILDETREAKLKVSDFIIQNLTLHLALGIKRLREGFEIKELGIEQEVSKRVEYQVAQRIVQRIEVIAGVSFPEEEIAYLTLHLMAKSNHKENQNDQELSKELAKVLKRLSQEFHFSLVEDLQLFNGLLDHLSPMMIRLSRGIRIENPLTEEIKKENPKVFDAVKRHFSNMPALKNYTINEDEWAYLALHLMAALEKERAAHKLHALIICATGYGSAQLLKNRVVSEFGKNITVVSVKGYYEINETTLKGIDLIISSIDLSTMFFKIPVLHVSIFLNEDDVRKIRKVVGESIPYHSSDRPIPAFSLQQKKQIYTEQLSEKFFKTYTYEPKKEEILHDLLQKLSINEEEGYIREMRKQIQQRENMGQIIFSDTVAVPHPAVPVGIETKVAVALIPSGMQWDQYQEIHFVFLVSPSYVENEGITVVTKAIVRLVDQLKVQQEILAEPIFENFSSKFIKLIE

SEQ ID NO: 6862 - protein, 125 aa, Enterococcus faecium
  misc_feature (B) LOCATION 1...125
  hypothetical: YES
KSVMTLRLFIKLTQKKKRNTFLSGMIEKWKKNYPKVTQSLIENQDLLTFYDFPPSIRRTIYSTNLIESFNKQIKRYSRRKEQFQNEESLERFLVSIFDTYNQKFLNRSHKGFQQVTDTLVSMFTE

SEQ ID NO: 6863 - protein, 168 aa, Enterococcus faecium
  misc_feature (B) LOCATION 1...168
  hypothetical: YES
INVIKPMFLKVGTGIAYIKVNRKKGINHMKKILIATHGHLASGFLSSIQLLTGKVQEITVINAYVDECDFEQELNVFVNQVNEQDQIFVFTDLFGGSVNQKITKTFLEKEIAVTILSGFNLPILLEIVLATKELTKEDIQELVNKCQQELKMTILDEVHVVNEEEDFF

SEQ ID NO: 6864 - protein, 219 aa, Enterococcus faecium
  misc_feature (B) LOCATION 1...219
  hypothetical: YES
MSVIVLAGTIGAGKSSLTEMMAEHFDSQAFYESIDDNEVLPLFYANPEQYAFLLQIYFLNKRFASIKQAMKDDNNVLDRSIYEDSLLFHLNADLGRATETEVRVYDELLENMMEELPYAAHKKHPDLLVHIRVSFDTMLERIEKRGRSYEQLSFDPSLYDYYKELNRRYDQWYEEYKESPKIQIDGDRYNFVEDPQAKEEVLKMIEEKLAEIRQTKVAI

SEQ ID NO: 6865 - protein, 113 aa, Enterococcus faecium
  misc_feature (B) LOCATION 1...113
  hypothetical: YES
FQVMEYADTMMRLFYRSFNKNDSYGYEISKTIRERTNDSYVIKETTLYSVFARLEKNQLIVSYPGEVTHGKKRTYYKITEIGRNLLEEKKQEWLTTKDVVTSIFGGKLNGYNP

SEQ ID NO: 6866 - protein, 702 aa, Enterococcus faecium
  misc_feature (B) LOCATION 1...702
  hypothetical: YES
REVIYVTQLKKLCQNRLAIVLTAVFFFWLKTIIAYYADFSLGVEGTIQYFILWINPIATTLLFFGLSLYIKKPKPALAILLIIDILNTLLLYLNIIFYREFTDFITVKSVLGFSKVSQGLSGSSFSLMKPHDVIYWLDIAVFIGLLVWLKVKKIPIKSNPVGKPMAIAVTCLSGLIFSGNLALSEANRPQLLQRTFDRSYIVKYLGIDAYTIYDGIKTGMTSSVRAHASSNGIDEVLDYTKKHYAEPNPETFGIAKGKNVIVLHLESFQQFLINMKVDGQEVTPFLNSIFQNQATISFDNFFHEVGQGKTSDAENMLETGTFGLPQGSLFTELGSDNVFQAAPAILGQKQGYTSAVFHGNVASFWNRDHVYKNLGYDNFFDRSYFDESDETLGYGILDKDLFRESAQYLEHLQQPFYTKFLSVTNHTPYYTDDKNFDFPSLNTGNSTVDNYVRTAHYLDQSLEQFFTYLKKSGIYQNSIFVIYGDHFGISNTDNKDLASALGKDPDTWDEFDNAQMQRVPLMIHMPGYTKGTVNHEYGGEIDVLPTLLHLLGIDDKDYLHFGTDLLSSQHDQVVAFRNGNFVTPKYTVLGGKAYNNQTGEIIDTKAAGIDEEISKDQEKVKTALSLSDKLNQENLLRFYVPNGFETIDPKKYDYKNEAERNEAIEKQKGEHSTSVFSKNGNKTTTNLYPVTRTDVEQQKNNQ

SEQ ID NO: 6867 - protein, 123 aa, Enterococcus faecium
  misc_feature (B) LOCATION 1...123
  hypothetical: YES
HEVIQMKLEVTKEAQEVLKNKLEADDQLLLDIENGDGPFAESQVSCQLDTAFRLIIVKKDTQTDLSLYSVVADTPVGPIKIKDSAILYMDDPSTLALEPTYNSLQLKGPSGLRKGNLQVVRKD

SEQ ID NO: 6868 - protein, 478 aa, Enterococcus faecium
  misc_feature (B) LOCATION 1...478
  hypothetical: YES
VRVMEMEKKSTGISKWGLVALVVSSSIGSGVFGITSDLASSAAPGPAILSWIIVGIGILALVLSLNHLGEKRPDLDGGIFGYAEASFGKLGGFISGWGYWLSAWLGNVAFATMLMSAMGEFFPIFKGGQNVPSILFASIFIWGLTLLVNNGVEGASVINTIVTICKLVPLFLFLIFVFIAFKVNIFTADFWGNVSDNLVNGTGQQGTIWLQIKGCLMVMMWVFVGIEGASVLANRAKKRSEAQQASIIGLLCLLFIYILASILPYGVLSQEELATISQPAMANILKGIVGNWGAALINIGLIISIIGSWLSWTMLPAETTMLMARDGLLPKGWGKTNKKNAPTYSLVVTAILTNLFLLTFLVTDYAYQFAYSLCTAAILICYLLVGIYQVQFSLKEGIKKQVVIGGIAVVFELMGIILAGFSYVLLCSIAYLPGFCFYWIACRETKHQITGKEKVMIGLICVAALLSIGLLAVGWIKI

SEQ ID NO: 6869 - protein, 186 aa, Enterococcus faecium
  misc_feature (B) LOCATION 1...186
  hypothetical: YES
VASIKSDSIVPLSVLIFIAASMSAGLFSATSSAISFTKSWNISFLETKSVSEFTSTIAAVLPFTATEANPSAAMRSFFFAAFAIPFSRKRSTAFSMSPSTSTNAFFASIIPTPVISRSSFTILAVTSAMFNSSCVFFFLKKAASKESEACRPAFETAPSFKIILLKNCRLQQHLRFLRLMLLCFLL

SEQ ID NO: 6870 - protein, 192 aa, Enterococcus faecium
  misc_feature (B) LOCATION 1...192
  hypothetical: YES
IVAFFCQTCINYKRKRCFNMDISVIDATKTNTQKGILYGSSNAPKKMVEFINLACPYCRQWFEESYELLEEAVQSGQLQRVIKLFDKEKESLQRGNVMHRYLTISDGQKAIKEIKQIFDTQDEWKHLSLQEVADFAVDKLKLTEQKDEQLSQAVINEAEQAHIRFVPTVILGKEIFDESISIEELKELIQTK

SEQ ID NO: 6871 - protein, 75 aa, Enterococcus faecium
  misc_feature (B) LOCATION 1...75
  hypothetical: YES
VLSIFLPISPPNASISRTTTPLAGPPTEGLHGMNATMSKFIVSNNVFDPIRAAASAASEPACPAPTTITSYASAS

SEQ ID NO: 6872 - protein, 64 aa, Enterococcus faecium
  misc_feature (B) LOCATION 1...64
  hypothetical: YES
MESIRMNIIQQYELKYITFDQLSEEIWGYGQRLINEVGVERFSFYVEAAAGYHNFRFYIFPLYI

SEQ ID NO: 6873 - protein, 236 aa, Enterococcus faecium
  misc_feature (B) LOCATION 1...236
  hypothetical: YES
NNTMPDKILLVDDEQEIADLIEVYLKNDGYEVQKFYLGQEALDCIERESFDLAVLDVMLPDIDGFKIVQKIRENHFFPVIMLTAKIEDIDKITGLTLGADDYITKPFNPLEVVARIKTQLRRFQKYNIQVDYSTEESIKEIDIHGLIINQTLHTCTLYGETISLTPLEFAILWYLAERKGEVVPAEQLFEAVWGEKFLDNNNTVMAHIGRLREKLKEPTRKPKFIKTVWGVGYKVE

SEQ ID NO: 6874 - protein, 183 aa, Enterococcus faecium
  misc_feature (B) LOCATION 1...183
  hypothetical: YES
RPAFVFENGHGYFQRKFGQVSEKYLMGNWSILCFYPADFTFVCPTELEDLQEQYSTLKSLGVEVFSCSTDTHFTHKAWHDTSDAIGKIEYVMIGDPSHQISRIFDVLDEEQGLAQRGTFIIDPDGIVQAMEINADGIGRDASALIDKIRAAQYVRTHPGEVCPAKWKESGETLKPSFDLVGKI

SEQ ID NO: 6875 - protein, 292 aa, Enterococcus faecium
  misc_feature (B) LOCATION 1...292
  hypothetical: YES
DVTILFSTRVEKLIHKEHKIYGIRTEFEEFHAPAVILTTGGRTYPSTGSTGDGYKIVKRVGHTVTPLYATESPLISDEPYIQEKTLQGLSLQDITLRVLNKKGRVLTEHTMDLLFTHFGISGPAALRCSSFVNKELEKTGEPVTLSLDCFPTQTKQELIHLLTEKSKATKKNLVNAWHGLLPERLLVFFLERLEMDSLTGQQASQKQIQDFVQLCKEFKLPVNKTFPIEKSFVTGGGVSLKEIHPKTLESKIIDGLYFAGELLDVNGYTGGFNITAAFATGHVAGRNAGQRA

SEQ ID NO: 6876 - protein, 229 aa, Enterococcus faecium
  misc_feature (B) LOCATION 1...229
  hypothetical: YES
NKTIESNRQEKKQMDFQSILEKIKAALISFWRWIRPYLGQFHRWRKRIWKKYHVNKLILLIGLICVLVTSIYLFILAKQANVETLKSGLSQSTVIYDKKNEEAGTLYAQKGTYVELNAISPYIQDAVISTEDRNFYEHHGFDIKGIARAAVRMVLSGGTSGGGGSTITQQFAKNAYLTLDHTFDRKAKELFLAIEIEKKYSKEEILTMYLNNAYFGNGVWGVQDASRKY

SEQ ID NO: 6877 - protein, 327 aa, Enterococcus faecium
  misc_feature (B) LOCATION 1...327
  hypothetical: YES
MRTIFRRKAEKMKWGFRWYGEKGDSIPLKYVRQIPGINGIIGTLLTKMPGDVWEISEIEELKASVESQGLELLGIESVAIHDAIKAGTDERDYYIDNYIRTIKNLSRCGVRLICYSFKPIFGWAKTDLFNENNDGSYSLLYDQKIVDQMEPGEMYQLIHSQSKGFKLPGWEEERLKKFAQLEKLYEGMTEEELFENLTYFLEKVIPVCEKADVKMAIHPDDPPWELFGFPRVTKNLGDLKKILNAVDSPYNGLTLCTGSLGANPENDLVEIIHEVGSRIHFVHFRNVEFLGERKFKETAHPSTEGSLDMYHIMKALVQEGFDGPIRP

SEQ ID NO: 6878 - protein, 120 aa, Enterococcus faecium
  misc_feature (B) LOCATION 1...120
  hypothetical: YES
WRTIMTSINIDHTKKVIHELYNSLMTRPNQTKALLDITDVLFQVYKKIDTAKYPEILVNKLVNYIYIVGFDNKIRFIDNDEKLLIELGDISKKAGINSKYKANFTDKSQFYSYSETMPQR

SEQ ID NO: 6879 - protein, 79 aa, Enterococcus faecium
  misc_feature (B) LOCATION 1...79
  hypothetical: YES
PSAMTVSGYQEKSRKKIFTLGFSTKGINRGFGLNLIHSIVKRHGGFLEFSKQTNGGTIVYLELPKKEDQNDDKCPDNRR

SEQ ID NO: 6880 - protein, 113 aa, Enterococcus faecium
  misc_feature (B) LOCATION 1...113
  hypothetical: YES
GIAMGSLKNQKDKVVGNAKEKIGEMLNKENLIDEGRTQSETAEEKEKQYQARIDEIEDQQAEEEAKRQDLTQERKNPTPDRSKTPLPESDHIPDEQKIEEQGMKHYTGIEEKL

SEQ ID NO: 6881 - protein, 103 aa, Enterococcus faecium
  misc_feature (B) LOCATION 1...103
  hypothetical: YES
ERALNFSFSEEMEKHNITGSMYVDDQWFISTDEVKIAAIRRDYLQKIHKIKDPNGKKARLIITLITSNGKKLKLAGSYDNVKKFEHWYLQKDSISLNKQFEKN

SEQ ID NO: 6882 - protein, 235 aa, Enterococcus faecium
  misc_feature (B) LOCATION 1...235
  hypothetical: YES
QIQMATTKKEVNVLNNLLAKQVDGVISMGHHITDEIRGEFSRSKTPVVFAGSIDPDEQVGSVNIDYVSATKDAVNKLAKSGNKKIAFVSGALIDPINGQNRLKGYKEALSENNLPYSEGLIFEAQYNFKDGLSLVDRIHNSGATAVYVSDDELAIGILDGLLDRGVKVPEEFEIITSNNSLLTEVARPRLTSITQPLYDLGAVSMRLLTKMMNKEEVEEKTIILPYGIEEKGSTK

SEQ ID NO: 6883 - protein, 62 aa, Enterococcus faecium
  misc_feature (B) LOCATION 1...62
  hypothetical: YES
KCQIKRLADCLITLTNKYLFRKVKKTYKKTHKTKKLSKNPGATERICNGILSTYLLFFSKKY

SEQ ID NO: 6884 - protein, 170 aa, Enterococcus faecium
  misc_feature (B) LOCATION 1...170
  hypothetical: YES
GIQMDILAAIDSFKGSASSFELNQAVLNGWEDRKGRKINVPIADGGENTAEAIYYALRGTWRTIDGMDLLFRQRKISYLLTTWQGKNTAVIESAQALGLDLLDKPTDQTIRLASSYALGELIKDALLQEVEQIIVTLGGSGCSDGGLGLLQSVLSVQKVHRRKAAYPIWR

SEQ ID NO: 6885 - protein, 159 aa, Enterococcus faecium
  misc_feature (B) LOCATION 1...159
  hypothetical: YES
RSQMNEKNRLTFSDVYFDAGQALLVKKGNQIKSVDDLNASTTVLAVKGSTSAANIRQHAPDAKILELENYAEAFTALQSGQGDAMTTDNAILLGIADENPEYELVGGTFTNEPYGIAINKGQENFLKAVNQALEEMHADGTYDKIYQKWFPNETEGKVE

SEQ ID NO: 6886 - protein, 344 aa, Enterococcus faecium
  misc_feature (B) LOCATION 1...344
  hypothetical: YES
AVKMNFFKYLKDQWTLILGWLFFIALTIFVMWLAPNIKVDLSTIAYLALIEGVFLIFYLLGGYLSKRRWWGKLADIQKTSPLQNYLSGGRTEEEKLVEEYINQLIREHQEVMQSAISNQQDQKDYIDSWVHEIKVPLSASKLLVRSIEFDIDDQKYTLLENELSKIDEYVEQVLYYARLDSFSRDYLIQEYGLKGIIQPVIRSQANYFIQKNIRYEIVGEDHTVLTDAKWIAFIFNQLLSNAIKYTPDHGNIIVSIEKEAQGVSLSVKDSGIGIPAEDLKRIFDKGFTGRNGRLSKTHSTGLGLYLAKNLAEKLGIHLTAESTEGKGTTMTLFFPILNFYNEKR

SEQ ID NO: 6887 - protein, 65 aa, Enterococcus faecium
  misc_feature (B) LOCATION 1...65
  hypothetical: YES
CFKMSYSEFTKELLDILDLNLTFHEDAFRKERINDETCFAFDGTLTYQPEECFHRHYQNEQTIIK

SEQ ID NO: 6888 - protein, 68 aa, Enterococcus faecium
  misc_feature (B) LOCATION 1...68
  hypothetical: YES
RSKMIVKETKWMIDSPDYCTCNNNKNIHTEFNDQGSLSICDNCHKLVKDSFKTFESYPVQNYVKSRRR

SEQ ID NO: 6889 - protein, 721 aa, Enterococcus faecium
  misc_feature (B) LOCATION 1...721
  hypothetical: YES
LIKIRSKRIVQKKEIAVFIDQITRERATGDLLIVGWAIDEVTKEIPTIKVEKENVIAEATHVVRLDINHLYNLDVKTQSGFKVRLSGKMRGKAILDFQTARHQNGIAVKLNGKYPYDDGIESSWERKKRLLKKGINYARTHGVKKAIRRVKLELKPGSIDYAEWISRHEKPDLKEQRKEVQGFAYRPLISILMPVYNVEIKWLEKCIDSVLDQTYDHWELCISDDASTDPAIRKCLESYQAKDDRIKVVFRQENGHISLATNSALEMAEGEFIALLDNDDELPPFALYEVAKVLNVHPELDLIYSDEDKIDADGNRFDPHFKADWSPDTLMGNNYISHLGVYRTSIVKELGGFRKGYEGSQDYDLVLRVTEQIPAEHIYHIDRVLYHWRTIPGSTASNGEAKSYIYDSGVKALTDALSRRNIKGSVHPGRISGFYEITYDVLQEDLVSVIIPTKNGYEDLKTCVDSIIEKTSYPNYEIIIADNGSTDPKMQELFAEYKHQLKDRFIVELIDIPFNYSRINNLAAEKANGKYFLFLNNDTEVIEPDWMTAMVSYAQFDRIGCVGAKLFYPDDTTQHAGVLLGIGGVAGHALNNYDRTHCGYFGRLVIDVNYLAVTAACMMVKAADFNAVNGFDEILEVAFNDVDLCLKVYELGRYNVYAHQAELYHFESKSRGYEDTPEKQRRFAGEIKKMQDKWPSYIAHDPFYNDNLTKEGIGDFSLRPD

SEQ ID NO: 6890 - protein, 742 aa, Enterococcus faecium
  misc_feature (B) LOCATION 1...742
  hypothetical: YES
RQKIDHPIVNFQFHSSKDNQQRRNKMNIGQIDTRHATANQPNFSNGNCQPYTGVPFGMNYFAPQTTDQNGSWWFHPDDRVFQGYRLTHQPSPWMGDFSHMLFTPINGKLQENTLFHAQSSYRPEESIFCPTHLSICQLRYGICSTLIPSMYGGILSIDYSKNDSGLLLSFPGRHQLFVIDPYTVEGKITHFAGSEDPDFSFYFILRFEYPLTIDELAVSNKNSDSIPLYFEQTKKQTIRFGTSFISSEQAAYNLELEQNQSKETYLAHSQEQWQSYFDRIQLTHHDQQQLRTFYHNLYRVFLFPQTFYEIDPSGQKIHYDTTSRSIKPGVLYTNNGFWDTYKTVYPLYSLIAVEKYEEMLEGFLNSYRESGYLPKWLSPDERGLMPGTLIDAVIADAAVKDIRRDLMPEFLTAMEKGATVQSKHPNYGRQGTEDYLTYGYVPNHYHESVNHTLDYAYSDFCISQVAKVLEEEEMTKKYQQQSLNYQNIFDYESGFMRSKDKDGKFREPFSANRWGQDYAEGSAWQSSFAVYHDFSGLIGKYGGSERYKEKLIELCNQPPTFDPGGYGFEIHEMSEMAAIEFGQLAISNQPSFHYPYLFSYIGQPEMAQPLLKQLMTQTFDDSPMGYPGDEDNGSMAAWYIFNSLGFYPVTPGTGEYVIGMPLIDKAVLLLSNGKELTIEATPNRPQQQFIHKIKRMDKEYTKLYFTHQDLLKGGTISYQLGIIPHPKKYQAKDLPFSLSNYN

SEQ ID NO: 6891 - protein, 332 aa, Enterococcus faecium
  misc_feature (B) LOCATION 1...332
  hypothetical: YES
FSFLVFCFRLDKKEESAMAEIRIGHSQVYAEQLGLGANAVGGHNLFDGLEDETGKQVVRTALNSGINLIDTAYAYGNGRSEELIGEVLKEKEYDRSRVVIATKAAHVPNKGRTFDNSPEFLKQSVEDALKRLQTDYIDIFYIHFPDESTPKNESVATLHELKEAGKIRAVGVSNFTLEQLKEANADGYVDVVEDKYSLIHRQAEKELFPYLEKNKISFVPYFPLASGLLTGKYELGEEKQFGEGDPRKRNPDFQGERFREILTAVDVLRPIAKRYQATPAQLVLAWYMKNPRVSVVIPGAKRPEQVSDNVQALDLHLSNEDYQTIDEAFRGF

SEQ ID NO: 6892 - protein, 149 aa, Enterococcus faecium
  misc_feature (B) LOCATION 1...149
  hypothetical: YES
HQKMRKKCLVYRKRSWMPMDSKDKNVEKNKHFLMSVEFAVQGVKTVFEEERNMRKHVAFGILALFMGVIFQLDRIEWLWLLLAVFLVWIVEIINTVFENVVDMFTDFHFHPIGKKIKDMAAGAVLVTACFAVIIGLILFVPKIYHLLFN

SEQ ID NO: 6893 - protein, 436 aa, Enterococcus faecium
  misc_feature (B) LOCATION 1...436
  hypothetical: YES
KRKIRGERNMSEKKGFHNDDVVLDIHDRPTPGHWVGLSLQHLFTMFGATVLVPILVGIDPGIALVSSGLCTLVYLFTTKGKIPAYLGSSFAFIAAMQLLMKTDGYPAIAQGAVTTGLVYLIVALIIKKIGSAWLDKILPPIVVGPVIMVIGLGLAANAATNAMYNQGTYDFKYIAVALITLGLTIFFNMWLRGFLGLIPILLGIISGYIVALLFGIVDTKPIVDAAWFAVPNFEIPFVQYEPKLYLGAITTMAPIAFVTMTEHIGHLMVLNKLTKRNFFEEPGLHKTLTGDGLAQIVAAFVGGPPVTSYGENIGVLAITRVHSVFVIGGAAVFAVILGFVGKLSALILSIPGPVISGISFILFGVIAASGMKILIENKIDFDKKKNLLIASVILVVGIGGLVFEVGTFTLSAMALATVLGIILNLILPETSRSEEN

SEQ ID NO: 6894 - protein, 61 aa, Enterococcus faecium
  misc_feature (B) LOCATION 1...61
  hypothetical: YES
KSEIVAIDGNANGSIILKNTPKSVQPSIFADSSKLSGKAWKKFLIMIIFIALTATGRIMAQ

SEQ ID NO: 6895 - protein, 263 aa, Enterococcus faecium
  misc_feature (B) LOCATION 1...263
  hypothetical: YES
KGEINMIFDSHTHLNAEQFNEDIPETIQRAQEMGVTKMAVVGFDTPTIEKSLQLSHDYPNIYSIIGWHPTEAGSYTKEIENKLQEQLTLPKVVALGEIGLDYHWMEDPKEVQDKVFRRQIAIAKEMNLPISIHTREALEDTYQILKEEDVRDIGGIMHSFSGDYEWAKRFLDLGMHISFSGVVTFKKALDVQEAAANVPIERLLVETDAPYLAPVPFRGKRNEPGYTRYTVEKIAELRNLPTEEVAAQTWTNAHRLFGLSEHG

SEQ ID NO: 6896 - protein, 503 aa, Enterococcus faecium
  misc_feature (B) LOCATION 1...503
  hypothetical: YES
RGEIVMDQEIFPENFLWGGAVAANQCEGAWLEDGKLPNVTDTLIGIMNQHPSIQWNEEKKIWEIALDESLHYLSHEAIDFYHRFEEDIRLLKELGLKAFRTSISWARIFPRGDEQKPNEAGLVFYDRLINTLNRYDIEPVITLSHYETPLALVGEYGGWQNRKLIDFFEFYAQTVFERYQGKVKYWMTFNEINNAFRMPYAAAGLVTFPARDKLEPIATLTKKVIYQACHHMFLANARATQLLKKIDPNAKMGIMCSFSALATYAYDCDPENVFGSLQFKRNSWFFSDVMCRGHYPAYIYRTWKEEDCAPVMLDGDEQCLQANTADYIAFSYYRSAVYKKEAEMRVDTGGANGFDNPFLKEKSPEPWSWPIDPLGFRYVMNELTDRYELPLFIVENGIGLDEAPDELNRIHDPKRCEYLKIHLQEIAEAIKDGCQIIGYLWWGPIDIVSAGTGEMRKRYGFIYVDRQNDGSGSFRRLKKDSFEYYKQIIQSNGKNLEYRSFFK

SEQ ID NO: 6897 - protein, 628 aa, Enterococcus faecium
  misc_feature (B) LOCATION 1...628
  hypothetical: YES
NVEIKAVIPSIEKYYLFLETWNSRGRLTMLWKLSLTGIKSRLRDYLVLFSGLVMASAIFYMFESMASNEAFLKSNTIVAATVIIFRFGSVLLGIITFVYILYANSFLMTMRQKDYAMFMMLGAKGRKIAQMIFSETFLVGIAATLVGSAVGVGLTSIVHRLLVDQLDLNISHFTPFSIHGLLITVLFFAVLFLLAAVVNAFSIVKKPILALIRADQTPTRIKQHKFLFFLEVVLGIAFLGCGYYMMKHVGTYQVFGIGVALVTIVLGTYFIFHSVIIFFLSLLKKSEQISLKKLNNFTLSQLNFRIREYTQMLSMVAMLFALALGALTVGLGFKNEIADLTENNSGYDLVMNNPRAEDQQKIKELSPTLSASYTQKEDAGTIYYNASEFAAQPLIMIKHEDGTPPKITKEKVPAKKMNELTVQEELRSYELPEQQEKEIKVVSQSEFDQLNLPQSTLQLVQVKDFQANLKPIETLVAQNKMNNPSLQKVEYSNQKYEMYEVYNGLFSGFEFMGFFLGLAFLTMLASCLMFKILSGSKSDIARYEMLEKIGTRRGLLKQSIRREVGVLFLAPGILGVVHVLFGLQMFGLFMQNPYKDIWVPFTIFFVLYFIYYVLTTWLYTGIVLKKRL

SEQ ID NO: 6898 - protein, 172 aa, Enterococcus faecium
  misc_feature (B) LOCATION 1...172
  hypothetical: YES
MEEMSMRYVSKFLLGIYLFFLLWLILFKLSFNLPQFLTYSYSNVNLVPFSTFSFENTTVLRETTYNLIVFFPFGVLLNVNFKRLSFSKKLGIIFLVSFLAELIQFLFGIGVADITDLITNTTGGLIGLWAYQLLNKHLSTNKLDRLAIILGYILFLFLIVAFLFLTRTVRLQ

SEQ ID NO: 6899 - protein, 88 aa, Enterococcus faecium
  misc_feature (B) LOCATION 1...88
  hypothetical: YES
YFWIGNSLIVRKETLKKPMLNVYLQNKISGIHIMNTAVSGNNSQALRERFAKDVLSYTADKVFILIGTNDLAEHKQLSKETYQKICSG

SEQ ID NO: 6900 - protein, 72 aa, Enterococcus faecium
  misc_feature (B) LOCATION 1...72
  hypothetical: YES
ICWISFNVFNRLSPFCPSARGRNHMSIFNPISTAGTTQIVETTKRVPKLVVGVKGFQKPVESKWNNCGISCN

SEQ ID NO: 6901 - protein, 101 aa, Enterococcus faecium
  misc_feature (B) LOCATION 1...101
  hypothetical: YES
KSWMYMVYDELIGEIYWVIGKIQSDPELEEQLRRLKFDIRKNGVKVAGDPYLMNEETDARIEINQVIAEFERIADQAKEPDIRQYLLEMKAELEVNGITDE

SEQ ID NO: 6902 - protein, 89 aa, Enterococcus faecium
  misc_feature (B) LOCATION 1...89
  hypothetical: YES
FFWIFSFIICVWICFRYCLVSRIRIWFWSYIWFFFWGYLWFFWIFSFIICVWICFRYCLVSRIRIWFWSHIRFFFWVYIWFFSRGYFRF

SEQ ID NO: 6903 - protein, 97 aa, Enterococcus faecium
  misc_feature (B) LOCATION 1...97
  hypothetical: YES
EIWIKEGKEMLNFLWSLFIGGILGLIAGAILGKEVPGGVSGNIIIGFLGSWLGEFLLGPLGPELGGFYLIPALLGAIFCLALYSFVARRIRERPKKE

SEQ ID NO: 6904 - protein, 379 aa, Enterococcus faecium
  misc_feature (B) LOCATION 1...379
  hypothetical: YES
CKWIQKRKDAGGNGNMGKLGISIYPERSTFEKDKAYLDLAHKYGYKRVFTSLLQINDDKEKVLSEFKEVVDYANSLGMEVMVDINPALFEQLEISYDDLSFFHKMGAYGVRLDIGFTGAEEAKMTRNPFGIKIEINMSSGTNYVDNIMSYSPNTDNLLGSHNFYPHRYSGLGYEHFVFCSEKFRKYNLNTMAFVNSQSAEFGPWPTQDGLCTLEDHRDLEIATQVKHLILTGLIDDISIGNAYASEEELKEMAEAFNADYPTLKVDTEEGITETERICLFDNFHSYRGDRSEYILRSTMTRVYYKDKDFPPHNTRDMHHGDVLIDNEGYGQYKGETQIALKDMKNDGRVNVVGRISDDELFLLDFLKPWSSFKLIENKK

SEQ ID NO: 6905 - protein, 330 aa, Enterococcus faecium
  misc_feature (B) LOCATION 1...330
  hypothetical: YES
IYRMVLRNHSGIAFAIFLAFQLSPRPGAFLINHMFSNTVHITDKRTFDQAEKNVAKKTDLTYESKYKENTYDIYYPKNSKGPVPVLFWVHGGGFVGGDKSGVKEFATKLVSDANIAVVAMNYELAPDSEYPNQVLQVNELIKDLLAEEKDDKLLDMEQLFFGGDSAGSQIALQYAAIQTNDAYAKQMKIKQLLPKDSLKGTISYCGPVDLKLTAQQHSDDRFMKFFVKTVAWSLIGTKDWKTSEQLKEASVADHVSKEFPPTYITDGNAYSFQEQGQALENRLTELKVPVQSLFYTDTKKEITHEYQFDYTLKESQNCYQQTLDFVNKYK

SEQ ID NO: 6906 - protein, 138 aa, Enterococcus faecium
  misc_feature (B) LOCATION 1...138
  hypothetical: YES
PDRIFQTWRPLEEFARKICFTKSTHWPKQFDGWNTDVAEKKDAQFNRATAMEHDLSSPNYYAIKIAPGIHYTMGGVKINTNTEVLDKENQPIRGLYAAGEVTGGLHGNNRIGGNSVAEIIIFGRQAGIQAARFASENE

SEQ ID NO: 6907 - protein, 66 aa, Enterococcus faecium
  misc_feature (B) LOCATION 1...66
  hypothetical: YES
KDRMVEMIKNGLFLCSIGSLIVLYSLNPHSQRYDLYSMVTGLFLTGLGIYFFMKGKKREEAKEKNN

SEQ ID NO: 6908 - protein, 62 aa, Enterococcus faecium
  misc_feature (B) LOCATION 1...62
  hypothetical: YES
IKRIKYPSDTSIQRGMQMDQKRIHVGLITSFVTMLIYLDQGHLTWTVVGVVGFLTLFTAIKK

SEQ ID NO: 6909 - protein, 74 aa, Enterococcus faecium
  misc_feature (B) LOCATION 1...74
  hypothetical: YES
NRRIIRLVTTIEDNVLIGAQIGGVGASDMVSELALAIESGMNAEDIALTIHPHPSLGEIVMDASELALGLPIHI

SEQ ID NO: 6910 - protein, 310 aa, Enterococcus faecium
  misc_feature (B) LOCATION 1...310
  hypothetical: YES
ERRISMDFGNETVLKATGITKKYGAAKALDKVSIEIKRGMIYGLIGENGAGKSTFMRTIMGLISIDEGSIELFGTTDLQAARRRMGQSIETPALYPELTARDNLRIQAANGGVSDREIEDLLKMMRLENTGKKKAKNFSLGMRQRLAIANALITNPEFLILDEPTNGMDPAGMAEMREIIQRLVKERGITVLLSSHLLDELSQIATHYGILHEGHLIKELSKEELAQESRQFIKIDTSATEQAVTVLDSLGYRDYFVQSSRVIQLFEGIDQVAAINQALVEAKVPVDGIHLVGQKLEDYFLQLTGGNPHV

SEQ ID NO: 6911 - protein, 177 aa, Enterococcus faecium
  misc_feature (B) LOCATION 1...177
  hypothetical: YES
KGRIIVQDTVKRKIELEKKQLSLKNMYFNRYLIVRYLTAFFFFMNMQWMILLLSAKSLGSSLPMILILAILPAVGEQVKLYRKHQTNVPWTKWYFLFQSVFNLLVIPVLFTSGFTFLYPFMANNNGGQLFVFILVVSGIFASAFIQYRLKKISLNQDQQYIRIKQYEKALYLGKENN

SEQ ID NO: 6912 - protein, 481 aa, Enterococcus faecium
  misc_feature (B) LOCATION 1...481
  hypothetical: YES
HMRIFNRGGIKMNVKSNVQKLGRAMLFPVAAMPLAGLIMRLSADDMLNIPVIGAAGNAVFGNLDILFAIGVAIGFVKNKDKGIPALTGFLAIATLKKGLEIMDPEVNMGIFGGIISGLVAAWTYNRFKEQKLPVVFSYFAGEKFPLTMVMILQTIAAVFLGFIWPLIQIGIDNFAKLLVDMGALGVGIFMFLNRLLIPFGLHHVLNTYIYYDLGSYTSPSKEVFRGEMTRFINGDPQAGLFLSGFFVVMMFGIPAICLAIYKAAYKENKEMVKGIMGSGAGTSFIANITEPVEFSFMFLSPMLYVIHALFAGLAGIVCYLFNIRIGFTFGACIVDYLINFRIATNAILILPIGIFFFALYYVTFYYLINKRNIQTLGREAKAEFGNEVTLEETELGLASKNYEYMATKMLQAFGGKANILDVYSCNTRLRVEVVDPTMVEEQRIKQLGISGIIKPTEKNYQIIIGLEVTYVMAEFNKLLEE

SEQ ID NO: 6913 - protein, 376 aa, Enterococcus faecium
  misc_feature (B) LOCATION 1...376
  hypothetical: YES
EVRMMELQFPLHNDTSRKIIHIDMDAFFASVEERDHPEFRGHPLVIARHPSDTGGRGVVTTANYEARKFGIHSAMSAQKAYELCPQAIFKPGDHHKYSDISKQVREVFYRYTDIVEPVSIDEAYLDVTENKINCKSAIKIARMIQADIWESVQLTCSAGVSYNKFLAKLASDYQKPRGITVVAPQDAVPFLKALPIEKFHGVGKKTVPRMHELGIYTGKDLYECTEMMLIRNFGKMGYSLYRKVRGIHDSPVNVTRERKSVGKEHTYGQPLQTEEAVLTQLRQLAEKVEEALRRVQKHGKTVVLKVRYTDYSTVTKRVTLPEYIYKKEALFYQASLIWEEILGVEKGIRLLGITLTNLDPMTYENIVLPLWENQEI

SEQ ID NO: 6914 - protein, 291 aa, Enterococcus faecium
  misc_feature (B) LOCATION 1...291
  hypothetical: YES
EKRIQMENQNKLYHFVGIKGSGMSSLALVLHEQGLNVQGSDIEKYFFTQRDLEKANITILPFNADNVKPGMTIIAGNAFPDSHEEIQRAKELGLEVIRYHDFIGHFIQNYTSIAVTGSHGKTSTTGLLSHVLSGVRPTSYLIGDGTGHGDPQAEFFSFEACEYRRHFLAYSPDYAIMTNIDFDHPDYYTSIDDVFTAFQTMAGQVKKAIFAYGDDAYLRKLKANVPIYYYGVTENDDIQARNIERTTSGSAFDVYHGDEFVGHFTVPAFGKHDILNALGVIAVAYVEKLDL

SEQ ID NO: 6915 - protein, 279 aa, Enterococcus faecium
  misc_feature (B) LOCATION 1...279
  hypothetical: YES
SRRMEMVEVVGVRYRDAGHIYYFAPGDSEYVYNDKVLVESQQSLHIATVVLPKKEIDPNDLPEAIRPILHKASQAELEKDKKNKKDAHDALKIAKEKVQLRELEMKMVKAEYTFDRNKLIFSFTADGRIDFRELVKDLATVFRTRIELRQIGVRDEAKIIGGIGPCGRPLCCSSFLGDFVPVSIKMAKDQSLSLNPTKISGLCGRLMCCLQYESEEYETAKKELPDFGKVIATPDGKGKVVGLNLLSRIVSIRLTGRENPVEYEWDELKEFIQVGEMNG

SEQ ID NO: 6916 - protein, 100 aa, Enterococcus faecium
  misc_feature (B) LOCATION 1...100
  hypothetical: YES
VVGMKLTVTPKAQKWFDSEIDLPETYGIRFFGKVYGKTEVHDGFSIGMSVEQPEHPVKKVEMDGTLFFIEEADEWFFKGYDLLVDYDPNLEEPTYHFKKQ

SEQ ID NO: 6917 - protein, 71 aa, Enterococcus faecium
  misc_feature (B) LOCATION 1...71
  hypothetical: YES
QSGMRLGEVQDKIQNCGLRIRFVGHQAEYTLKTPAEKGRLETTDTFITEESRSIYLRKTSASFRRSFSKTF

SEQ ID NO: 6918 - protein, 586 aa, Enterococcus faecium
  misc_feature (B) LOCATION 1...586
  hypothetical: YES
KRGILMAYQALYRVWRSQRFEDIVGQKAVTQTLKNAIVSHKTSHAYLFTGPRGTGKTSAAKIFAKAINCPNSKDGEPCNECEMCRSITAGTQEDVIEIDAASNNGVEEIRFIRDRANYAPTKAAYKVYIIDEVHMLSTGAFNALLKTLEEPKESVIFILATTEPHKIPATIISRTQRFDFKRINTADIVEHLEFILKESTISYEPAALNVIARSAEGGMRDALSILDQAISFSEGTITLDDAMQVTGSLTDEMMDSYLSACVKKEVPEALETLNQILAAGKESRRFLEDMLQYCRDLLMYQQAPNLVEEQSSTIRSTFTELTQTVSADQLFSMIKILSDTQNEIRFTNSAAIYLEVATVKLAQLPSASVPSADVAFADDQIVKQLQQEIKELRNEIKELRSNTGIENTKVQPVQQTNHKKQTSTYRVPTERVYKVLREATRQHLNQVKEVWEDLLMSLSVTQRAMLKASEPVAAGPTGLVIAFDYEIVCQRAANDEELQLSVHNNLSRMIKDYAPDPVYITRESWPELRRNYLTQAQEEGTENSFASEDSEGEIELLPQEQEVPEDTLVVKAEELFGSEAVTVVDD

SEQ ID NO: 6919 - protein, 102 aa, Enterococcus faecium
  misc_feature (B) LOCATION 1...102
  hypothetical: YES
RGGINMELKIDKLTLDDPAFKIIDDRVVQQVEQTQGTLLSLLEKKYQFPKYMNKAQAAKYMNVSYNTMMQKYVPNGLKLIIVDGVVRISQDECDRFMEEYQK

SEQ ID NO: 6920 - protein, 709 aa, Enterococcus faecium
  misc_feature (B) LOCATION 1...709
  hypothetical: YES
AAVFLARREKMTINEVIYSPKHPFFNAELNDGNVTTSNEYSYYRNIPDVKGLTFDVSNQKTLANLDVCGTIQTLTFYRENLLTEEKPGVWVNKQLSQTNSLSLKVEVNGIVYHLSESDHRIEVDVIQDCLPRYIHHYSTFKVIVVSFAPILANKRLSMLVQQVYIVNETHESLQVSVKDVPSYQEKYSDQQNVLISQKGNKDTIAQQEVASFAIAFVDPNAFEEVMTFQESDIEKWLKETLNYFAQLFGQLSMPNDRVVHLYRRALYQSFSSFGMNRQGQVVGSNWGSYPATNRIWNKDMYYASLPFTMFEPELCQKTVLWFDQYGVKFPGSKFTGGINHSLSNSLSSALLASLYFEHTGDTKFFERCPQVLLNASRIIEDILAQRRSGEPMLFPSVWLSDAFALGKYHTGSNLCLWKACIGLAEIFEALEQLSLSKRYKNIACKLKESICKQMTIDGPFGEQFLEGIGDEEKTTYSVKHYQKPILEQGLIFLSDVIVDGKINLLMHDGEESDTTLMPFYQFLDNKDHLYQNTMAFSASSFNPTYSEEIKGITWGLESGATFPGFITVLMSELHNPQAFVTRLEELICLADLDGSWWWWPYRLEAQQGEVVRDFGCGKCGWASGLFVSLMISQYFGLKFKKGVLQIDPVDNLTFSWKNLKFGQAFISIECTQSELSISNLSEKPLKISDTKKILHVEKGKTIHIQRRKR

SEQ ID NO: 6921 - protein, 207 aa, Enterococcus faecium
  misc_feature (B) LOCATION 1...207
  hypothetical: YES
VKVLRVAYIRVSSIDQNEQRQIEEMKKFGAERIFIEKQSGATITHRPVFQEALDYVRDQDIFIVEAIDRLGRNYDEIIASVNYLKKKNVKLIITSLPIMAEAIGNPLLDKFIKDLIIQILAMIAEQERTESKRRQAQGIKIAKANGVYKGRPKLYSADAKDPQRRLVYKSIVEDLKNGVAIAKIAKDYNVTRQTVYRIKKDSMVNDK

SEQ ID NO: 6922 - protein, 68 aa, Enterococcus faecium
  misc_feature (B) LOCATION 1...68
  hypothetical: YES
DFYFIRYTMPIIFFYFLYHCFNFPQFHSMDVLSCQKINECFMNSTSSQPNFFLYAIVILKKSIRRERK

SEQ ID NO: 6923 - protein, 236 aa, Enterococcus faecium
  misc_feature (B) LOCATION 1...236
  hypothetical: YES
EKVFLFCLKGGRWMKKWLFGFLGVALIVFCSVFGYVSYQKHEGEVFKQNIEKKMPIDQINEHAKSYKEDATNVNNDMSLGQMLSIQKEAIEMGVNKQAFAQIQIPALGLTLPIFKGANQYTLSLGAATYFYEDAEMRKGNYVLAGHNMEIPGVLFSDIQKLSLGEVMDLVSNDGVYRYKVTRKFIVPEYFKLIDGVPEENSFLSLPKKGEKPLLTLFTCVYTSQGKERYVVQGELQ

SEQ ID NO: 6924 - protein, 302 aa, Enterococcus faecium
  misc_feature (B) LOCATION 1...302
  hypothetical: YES
INYFGVFTYMDPEGGSNVSTHPIKKENYMKIMTLNTHSWLEEEPQEKLKQIAQKICHEQYDVIALQEVNQTMDAKRLTSEQLKNFSQVQEQTPVRSDNFAYCLIQLLAEQGETYYWSWEMSHIGYAIYEEGNALLSKQPLTSQTHLVSETKEKEDYHTRKILVGQTSVKTQCITVASCHFSWWVDEKSGFAFEWKELEASLAPLTTPLYLLGDFNNPAEGSGYDLVAKSQLPIRDAYLIAQKKQAEATIEKRIDGWENNKEGLRIDYIYVPQDCFVTSYQRIFDGENGPIVSDHYGVAVTLE

SEQ ID NO: 6925 - protein, 340 aa, Enterococcus faecium
  misc_feature (B) LOCATION 1...340
  hypothetical: YES
KGVFELMTKYIFVTGGVVSSIGKGIVAASLGRLLKNRGLKVTIQKFDPYINVDPGTMSPYQHGEVFVTDDGAETDLDLGHYERFIDINLNKYSNVTTGKIYSEVLRKERKGEYLGATVQVIPHITNEIKEKIMRAAKMTDSDVIITEVGGTVGDIESLPFLEALRQMKADVGTDNVMYIHTTLIPYLKAAGEMKTKPTQHSVKELRGLGIQPNILVVRTEQPVSQSVKNKLAQFCDVEPEAVIESPDVDTLYSIPLVLQAQGMDQIVCDHLKLDTPEADMTEWKELEERVLNLKKKVRIALVGKYVELPDAYISVVEALKHILVSPIIQTSRSIGSKHKN

SEQ ID NO: 6926 - protein, 274 aa, Enterococcus faecium
  misc_feature (B) LOCATION 1...274
  hypothetical: YES
GGVFMEIDKQAVGNRIRQIRQELKLSMEKFGKLIGDLPRSTVNNWERGINLPKTETLHQIAEIGHVTNEYLLYGDQENQYILEMLQKKAGKLDPKIEGLIVDEIKHADLVSEKEMDRMIEFFITNLIPPTEQDQFTFQCIDEKKQLYLGSTNFGKEAQLYLQHDNQNHILHMMPFTFSNFSVDRILVYLANQKSYSYFGKHLPKELGEKAILLYSINQLTSDVRIAPLVYSEETASYQYTEDNQYLLEQQYLYLPFVMEVEKERLLNAAYPSSK

SEQ ID NO: 6927 - protein, 220 aa, Enterococcus faecium
  misc_feature (B) LOCATION 1...220
  hypothetical: YES
VMYFPLIDFSLMWTSLPFVLQGLVYTLGIGFVSFLLGNLVGLLLTVLGLLDWLPLNVFIRFYLSFFRGIPALVLLFLLYFGLPYQLSALTASVICFTITSSAFIGEIYRGSLAGVSSGQWDAGLASGFSFFGVLKYIVLPQAFRISVPALSNVAMDLVKGTSLAATITVPEIFQKAKIIGGRTFDYFSLYILVALIYWVICIGIEKVQQYLEKRSIHQSI

SEQ ID NO: 6928 - protein, 79 aa, Enterococcus faecium
  misc_feature (B) LOCATION 1...79
  hypothetical: YES
KKYLREIFKCATMIFVTNLKEWYRLPTNKKEGIIFTTMMCFLMVLGMSAYNLWLHQDLHLSSLLIGLVPGFVVAFILDV

SEQ ID NO: 6929 - protein, 594 aa, Enterococcus faecium
  misc_feature (B) LOCATION 1...594
  hypothetical: YES
NFHLCFSCKIHKYFHEFSNFLPTSRIGYMMNLSKVCKGVRQLKKYGPFLAIFFIALAFLMPHLFTHKLILGADAPFHYNRFYDAAQQIKYGDFHYFPSLYGFQQSGRIVNAVYGPFFAYLQGLIVLLAGSWFHYQILSNFILYLISGFSMLILLRYVNVRNWVSVPVAVLFMSTYSIQYWSINQGFTSWGTCFYPLCMIPIADFVLHKKFPVIKVAVSVGLMTQIHLLSSIMLALMYIPFYLYYFFNQTEKGKALLQLIKSVLLYFVLTANIWAGLAIVYSGNKILPPFVNREMSQKAIDLDGSYWLHYPKAFPILILSGFLLFIFFQQKNTLFQKIVLYTSLVFFFLSTSLIPWTTLIEKNVPFISLIQFPFRFFVPFTLLLLLYLALSLNQWSEQKWFRLLSIFGILIFSAQTIQNLYQHLEKWENETFVSRHTYLFDTPEEARKTFFSKDMSTSLFVFQKTTPDYLPIYKETKDNKYDRYNEEILENETTFIKTHPGGLLTIKWKNTGDKTVHIPVIVYDRTVLQQNGKTLTDYEVTDIGTPIVKQQKGINELTLHYQTPIYFYFILSLTLIGWFTLLCLFIYHRYKLLRA

SEQ ID NO: 6930 - protein, 536 aa, Enterococcus faecium
  misc_feature (B) LOCATION 1...536
  hypothetical: YES
NLHFQLKKETLIMSKIIGIDLGTTNSAVAVLEGNEAKIIANPEGNRTTPSVVSFKNGEIQVGEVAKRQAVTNPNTISSIKRHIGEAGYKVDVEGKSYTPQEISAMILQYIKGFAEDYLGEKVEKAVITVPAYFNDAQRQPTKDAGKIAGLEVERIVNEPTAAALAYGLDKTDRDEKILVFDLGGGTFDVSILELGDGVFDVLSTAGDNHLGGDDFDNKIIDYMVAEFKKENSIDLSQDKMALQRLKDAAEKAKKDLSGVSSTQISLPFITAGESGPLHLEMTLTRAKFDELTADLVERTKVPVRQALKDAGLSQSEIDEVILVGGSTRIPAVVEAVRKETGKEPNKSVNPDEVVAMGAAIQGGVITGDVKDVVLLDVTPLSLGIETMGGVFTKLIDRNTTIPTSKSQVFSTAADNQPAVDIHVLQGERPMAADNKTLGRFQLTDIPAAPRGIPQIEVTFDIDKNGIVNVSAKDLGTQKEQKITIKSSSGLTDEEIERMVKDAEANAEADKARKEEVDLRNDVDALLFSVDKTLKEL

SEQ ID NO: 6931 - protein, 401 aa, Enterococcus faecium
  misc_feature (B) LOCATION 1...401
  hypothetical: YES
YSNLKGGEKVGIFQKAVGYFTKKATVPLEEYFCKLQVDFVYRKFAIETCIDLIANAMSKAEFKSYEDGKNKKNDLYYRLNVAPNKKNNATEFRKKLIRRLIFYNEVLIVSPSNNSSEIFIADSWDVTEYALKDDVFSQVQINNIVLDREFLESDVIYIKYADQQIRQLVDAYYQAYGKLISSAMNVYKRSNARRYVLKGNLFRPQDNTTQDQINKMMTSQFKAFMEADNAGAVFQLQNEYTLEDFSGNFQSNSRDIKNLIDDIFEMTAAAFHVPKNLLKGDMSGLSDQVDAFLMFEIIPIAELIQDAFNASLYEVEEYLSGNFVRVDTTMIKITSFKDLVDAIDVGIRNGVFTINEGRERVGNDRSDKAMADEIFITKNNQQVSKGGEANDDNENISSSKE

SEQ ID NO: 6932 - protein, 317 aa, Enterococcus faecium
  misc_feature (B) LOCATION 1...317
  hypothetical: YES
TFFLRNEESIETLQREQGMNINDLNLAYHLQTPPKIHRGDLFQQGNIHISKHRRYAEVPEHTHDFVEINYMYSGTCLQIINGERIEMEESDVVIIDKEATQRIEYTGQEDILINILLKEETLSTEILNHLASTNNLLSSFLINASKEKGEHTQFIHFRGGKTSRLTHLIENMLLIYFDTYSHKIRSLNLYTSLLLIELTHLLEQQSFSSADGCAENEMLRVLDYIDKHFTSCTLKETAAHFGYNPVYLSNKLKMYFDASFQELVLKKKFDFALELIQETSFSLEEIANRIGYKQTTSLFKLFKKYSTCTPNEWRNKH

SEQ ID NO: 6933 - protein, 294 aa, Enterococcus faecium
  misc_feature (B) LOCATION 1...294
  hypothetical: YES
YRNFFCVCKEETRFAGQQIIMYHCTSFAFDIFIIGIKKYATMEGENFIAERIKYMITLGIDTANQTLAIGVVEDKQILGQIQTNIKRNHSVTLMPAIDQLFADLQMSPQDIDRIAVSDGPGSYTGLRIGVTTAKTIAYTLDKDLIGVSSLKAIAANCVGVNKMIVPMFDARRKNVYAGAYRWKENRLETVLEDVHIAASDLFAQLQELNEAIYFVGSDCHKFISEIKEMLPDAMINTVPSWDIPSGVTVAQLGALDEPVADKQAFLPRYLKRVEAEEKWLETHTPGDESYVEKI

SEQ ID NO: 6934 - protein, 185 aa, Enterococcus faecium
  misc_feature (B) LOCATION 1...185
  hypothetical: YES
FSNFATEPRTLGFQVLFGSLILTIVFLKWKTSNKKSMWSLVGIVLIIFTVTAATEANYSHKIQSYKGRLVMTKKDVTRYTSSRTGGLYDYAPLDALKYKDHLKKHEVKVGDRWENASHKAYNSKIVYTVEDADEQNITLPVFNYWGTVVKVNGKKSTIENDNGLVSIKGTGKRTIVEVSSTYQIR

SEQ ID NO: 6935 - protein, 613 aa, Enterococcus faecium
  misc_feature (B) LOCATION 1...613
  hypothetical: YES
LPNLSGVCKITRNIERRDTMEKKKTLNTRALIRFWKMIKPEHKYFYGLFLCSLFGNLLVVAMPLIMGIGIDDLLSEIRKTGIGQLSFSDIKQALLFPVLLLIGCSVLSSITSFIQERTMAALSEKITLRVRKEITKKFKTLPMSFFDNHQVGDIISRTTTGLNQLSQVLLTGINQFFTSVVTIAAAGLMLFYIESKLTLLVLLLIVGSSIVTTKIANKNKQISEQNQYELGVLNNRMEEILAGNLVVKTFNQQAHAEAAIHEVNKKQYNAFKRAQFMNFAIYPAIRFINQLAFIISAVFGAMLVLSGGVTIGFLQAYLQYINQISEPISTASYVINSIQSAMAAIDRIFEILDETDEIPDLPDARLLEQPKGKIAFKNVQFGYTSDKILMNQVDFSVKPKQTVAIVGPTGAGKTTLVNLLMRFYELNKGKIEFDGLDITKLSRGELRRSFGMVLQNTWLFEGTVADNIAYGKMDATREQIIEAAEIAQCDHFIRTLPDGYDTIISSENGTLSQGQQQLLTIARVILANPPVVILDEATSSVDTRTEALIQQAMEAVTKDRTSFVIAHRLSTIENADMILVMKNGDIVEKGTHSELLQSPTLYASLYNSQFQIA

SEQ ID NO: 6936 - protein, 356 aa, Enterococcus faecium
  misc_feature (B) LOCATION 1...356
  hypothetical: YES
HFFVTAPFLFEKYFFLKKQARRFKVLLVCATLRVKKGGKLTMSERIIYADRPFRDEFIEEIHTIAPGYIFKTELQPEDLQNVEISLGWNSDYQEKLLASSTLKWVQSISAGVDQLPLETFSKKHILLSNGSGIHSESITEHVLGIILGYSRGLFQAQKAQSDMKWLGSSVHYQSIQGKKILIIGTGHIGKMIAKKCKALDMNCYGINTSGHPAEGMEKTFSLNQLKEVLPEVDFVVNILPLTEETTGLFDQHMFEHFDPKSVFINVGRGASVKTQDLVQALNNQQLSFAALDVFEEEPLPQDHPLWKMDNVLITSHIAGLTPDFQKKLMAIFLTNLKSYFATHELQTNQVKLSAGY

SEQ ID NO: 6937 - protein, 94 aa, Enterococcus faecium
  misc_feature (B) LOCATION 1...94
  hypothetical: YES
RKNLQKQGSYIPSVRPGKGTEEYVSRLLMRLSTVGAVFLGLVALLPIIAQMVWDLPQSIGLGGTSLLIVIGVALETAKQLEGLMLKRKYVGFIE

SEQ ID NO: 6938 - protein, 272 aa, Enterococcus faecium
  misc_feature (B) LOCATION 1...272
  hypothetical: YES
EENLKEGDFMLDVEQMEIDLYNIILNRNTREWERTQFEEAKEDLAKMSIKQVIEKLEVNLRPLALRDNLTPDAMDFYLRITGESASAKAYDYAKHKITSPLYQERAIFAGGCFWCMVEPFETKPGVISVLSGYTGGETKKPNYDQVSGGYTGHVEAVEIIFDTRQITYEELLEIYWQISDPTDAFGQFQDRGKQYRSILFVVNEKQRQLAEKSREQLIQSNRFSRPIVTEIRQAKTFWPAENHHQQFYQKQPKRYKKIKHSHQLHLFFQRHR

SEQ ID NO: 6939 - protein, 173 aa, Enterococcus faecium
  misc_feature (B) LOCATION 1...173
  hypothetical: YES
RYFVFFLTIALTYGKVKLKYLFFIERMFYMENCIFCKIINQEIPSYKIYEDDKVYAFLDISQATKGHTLVVPKRHVADIFEYDPELAGEVFSRVPKIAQALEKAFPEMKGLNILNNNRELAYQSVFHSHIHLVPRYSKEDDFSIHFVNHQDSYGSEELKAIQETIVKQVSCDD

SEQ ID NO: 6940 - protein, 64 aa, Enterococcus faecium
  misc_feature (B) LOCATION 1...64
  hypothetical: YES
LRFVRDYQKRAAFYRHQNESKDQLLTHFLESAAWKTKEAKIHNLAVLTSSSDGLLSASIRYLIN

SEQ ID NO: 6941 - protein, 563 aa, Enterococcus faecium
  misc_feature (B) LOCATION 1...563
  hypothetical: YES
SDFVAWILFLSAYLEVFFSFFCSCCKVKARQVSWEKGKKCLYLKNNRKEGRMNNFIQTLSERKGELLEAAFQHLSISLISLLIAALIAIPLAIWAANHKKMAEVLLQITGVLQTIPSLALLGLLIPFVGIGTVPALIALVIYALLPIFQNTYIGLAEIDPSIEEAAVAFGMSRMRRLLKVELPIALPVIISGIRTALVLIIGTATLAALIGARGLGTFILLGIDRNTPVLTLIGAISSALLAIIFSGLIRWLQHKKPRYSIITLATVVCLFGGVSLYQSALFKNETITIAGKLGAEPEILIQMYKELIEDNTKTEVELKPNFGKTSFLFNALDQGQIDIYPEFTGTVLESLVKVPEAMKSADLTKEKTYDEAEELLNKQFDMTLLKPMAYQNTYALAVKRSFANEHQLKKISDLAAISDQIKAGFTLEFIDRSDGYKGIQEAYGLNFSSVQSMEPSLRYQAINNGDVNIVDAYSTDSQLKEYDLVTLEDDRGLFPAYQGAPLMKKDFAKEHPEIVKALNKLSGKITEDQMIDMNYQVNVEKKKPTEVARIFLKNEGLVKEEDQ

SEQ ID NO: 6942 - protein, 155 aa, Enterococcus faecium
  misc_feature (B) LOCATION 1...155
  hypothetical: YES
CRNLNGGFFMRAIFSSISVVGLFFLLAGCGSADSNTGSVDSIDAGQTVKTSSTKTERQSIFVGTIESITQVEAEEETLQLKLVDVMAKEDPANMGTSFSNDGVILNATAEKISVDINELKIGDKVQFTLVEMPIMTMSIPPQVPGDSIIDVSLNK

SEQ ID NO: 6943 - protein, 536 aa, Enterococcus faecium
  misc_feature (B) LOCATION 1...536
  hypothetical: YES
LEFVWICDNCHRSSFSRMRRKLLLLKSEMLGGVDLELFSLLEKNEQRQIKLFQLLLEEKGEISVNNVLTRLSVDRATLKEDLFYLQANLENIKQLEIVIQEGNILLIRHGNIAAVDVYYHCYLRYSTKYQILLYLLENGSFDRQKLVMELNISSATLSRRVKELNDSLNEFHLKIKSGRLTGPESQICYFYFQLFWFGRPYLENKKEYSDLSGNTFLDLLQKEFSFTITEEGRLKFEIWLSIMKKRMRCTKKSKPDYSNLPVGLFQTTQFLLDLHTFLTRYFFQYAFPWNQNETLVFYLFMISNFTLDTHNSHVQEFLISEKYKDDVVAQLNRTFKQSIEEYFSFYVFPEEISQKIALTVMQNHAHFAYFRGWMNIFGQEGLKQRLTEVEDKQFLVLCERLVRQTFAIVDFTEVDEENARFELFARYASILRTLIKQLELRLQIAYDLPYERLMADIVKEIIQEQLLNTIKYDLVEYEKEKQYDIILTSQLKEYPSQKSAKVFVFTSNEYNYDFPYLNQFLKECYLEKLNLRMNKT

SEQ ID NO: 6944 - protein, 85 aa, Enterococcus faecium
  misc_feature (B) LOCATION 1...85
  hypothetical: YES
YKFVENTPRRKIIMSQYRHLTILERERIFLLHEEGFSISIIGNDIQHSPFTILHELRRNKKKTIHLPKRKKIMLIEEKNADVITF

SEQ ID NO: 6945 - protein, 492 aa, Enterococcus faecium
  misc_feature (B) LOCATION 1...492
  hypothetical: YES
KRFVILFDKSGFILEDAYMDTEQQKKGIGLIPLAALVIGSAIGGGVFGIMTDISGSAGGPAIFSWVLVGTAMLMLSLSINNINKKRPDLKGGIFSYAEEGFGRFAGFISGWGYWLTCWLGNVAFATLLMSALGYFFPVFEGGQNLASIVMSTVFLWGYAWLVNRGVENASFVNAIVTFCKLVPLFLFIVVAISTFSIQQFIDNFSSDIILNANGQPIPFSSQVLSCIMVMLWVFVGIEGASVVGSRAKKQSDVGKATILGIFGLIIIYVLVSMLPYGTMTMNQLQTIKAQPAMGYVFEMMVGKWGAVVINGGLIISLVGVWLSWTILPIETMGNMAEDGLLPKAWGKLNKNGAPTYAIVLTTLCTNVFLLSLLFTDSAYNFAYTLGTAAIFFTWLFLGLYQMKLSYQRKEWVQFLVGLLASAFQVWAMLVVAFNEVMLVLVLFLPGIYFYLKARKEQNEPVQHIHLDKILLIGVTMVGVIAMVLFATGMLHV

SEQ ID NO: 6946 - protein, 729 aa, Enterococcus faecium
  misc_feature (B) LOCATION 1...729
  hypothetical: YES
FLNFGIGICLLFVGAYSNMAYLAIIVVNIVIGIYQEIHARNLVRKLSIVSQSEVLVIRDGKEQSISTKELVLGDLVKIGAGEQIPADLQVISGRAEANEALLTGESDLIVKETGAELLSGSFLTSGSVMAEVIRVGADNYAVRLTSEAKTHKAIRSELVDSIRKVSKFTSFVIIPLGIILFLEALFIRDASIKISVIASAAVLLGMLPKGLVLLISIALTTGVTKLAKKRILVQDMYSIETLAHVDTLCLDKTGTITEGKMSIQRVEALHPLYEKAIPEIMGTYLAESSDNNITMRAMRDYFELSNRYDVTNKVAFSSDRKWGAMEFPELGVVYVGAPERLVEEDRLPDSLKTAQANGYRVLMLGIAPNQQLNEEKPAFVEPVALFEIDDPIRKNAQETLAYLHEEGVDLKVISGDNPFTVSNIARRAGLPNYDAYVDLSQITEEMEVREAAHRYTVFGRVSPQQKKLLVNELKESGRTVAMTGDGVNDVLALREADCSIAMAEGDGATRQIANLVLLDSDFTTLPEVLFEGRRVVNNVTKVSGIFFIKTIYSFILSIICAVTAIGFPFIPIQITLIDLAIEGYPSFFLSFEQDKRKITYRYLPTALINALPNALLVVVNIIAVYLLGKTFAWGNAETTTLMYYLLIGISCMAVVKACYSFNPLRIFLAVTTIVGIYVAAMLFHGILEVNLGLGESVGYFFVFMLVNIVLRVLYWKADIQNQLLKRVAN

SEQ ID NO: 6947 - protein, 339 aa, Enterococcus faecium
  misc_feature (B) LOCATION 1...339
  hypothetical: YES
THLVFLLYTEKRPFSSKQGSKQKQSITHSLMDSDDSFTIYPVSTFSEESGYVINTDSKDTLRKFVQKFRQEVFPGDFFVVSDSFAIQDINEIFQEIRNCTKGQRFYHKGKNLAYQHELLPLLTNHEQQASSYLTKIVHKDYALAVKELENFFTTILEQPIDPAYLKHEAINRFYALLNALADEHVGNEELSLLKIALPSLLADAEYFEDFSILVKETLEKLTHFSANAKKDNFDILTLIYEFVQENYEKEINLQLLSEKYHFSYSYLSAIFTEKFGINFSKYLKKVRISKAKLFLTETRLTLTEICEKVGYTELGYFSRVFKEETGMTPSQYRKGTFVK

SEQ ID NO: 6948 - protein, 74 aa, Enterococcus faecium
  misc_feature (B) LOCATION 1...74
  hypothetical: YES
ALLVRRKTSFQKRIFLGKMASLTSQSLDFVLQLKRNDRTKESLKNGQISSDRSSIDSTQTNYYSGQKLRNKGFS

SEQ ID NO: 6949 - protein, 175 aa, Enterococcus faecium
  misc_feature (B) LOCATION 1...175
  hypothetical: YES
IAIVFQEVTLFNTSILENIRIGNSQASDEEVKKAARLANCEDFIEKLPDGYHTLVGENGSSLSGGERQRLSIARAFLKNAPILILDEITASLDAENEKRIQESLNRLIQDKTVLIISHRLKSIEKVNKIVVMDQGKLVDQGTHNELYRRSEIYKNLIKKTKLSEKFVYEKEAQSR

SEQ ID NO: 6950 - protein, 348 aa, Enterococcus faecium
  misc_feature (B) LOCATION 1...348
  hypothetical: YES
GAIVMFEKLKRFGRNFTQTTPFILSNTVIFIPYLLFLGLTDSHNWLTILPFTLFYAFRMTGLFLVNSLRFGLDSYTLLMIALLIGGAGSLLGILGVFYFPLFYFSSVLLGLSAAWLVPANTTVNFHEKTQGFINMDGKKYLFAAIWLFLLYQAIELPAPTQIAASFTIYTLFYVMAYHTVSHYPRYELDFKDIKRNLVATRELVLFLIFFGLLFLLRNARLLFDERLFDLAIYGFLLLFILFVFVLGHQKKEWKLPSWLNLFTFLNGMLGNFLFLFSSFYVGILYGLEKLSIFMYLPYAAGLIAAKIVGPWILKRLTWSPLAMQLLGLSSSLLVLLIPNGFGDRCLSG

SEQ ID NO: 6951 - protein, 242 aa, Enterococcus faecium
  misc_feature (B) LOCATION 1...242
  hypothetical: YES
VRNLWCRLAKIMMESNAEMYRVEDTMSRIALASGNFRLVSYVTQTGLFIGLDRTSTIRMEQITNRSINLEKVVKVNDLSRKYVASELTLEELYCELQAIDRDRSFFPVWLQIVSAAVISGTIMVLFGGKMTDLPVTLVIGGLGYAAYLYSLKFFRIKFLSEFLSSLLIGIAAIYSVRFGLGSNQDLIIIGCVMPLVPGVQITNAIRDLLAGHYVSGVSRGTETMMTATMIGFAIAFIFQLFY

SEQ ID NO: 6952 - protein, 206 aa, Enterococcus faecium
  misc_feature (B) LOCATION 1...206
  hypothetical: YES
IMIVAESNENKLSGVFDKFLELVIPKDKDMCELLPYKKILKDGTLVTNDNKYQAFFKVKTTDLTSISEDGFMRMVNKLTYLNRVYLEPYKIYSLTYPTETVNQAIYWKHRIQEAKRSLLSNNDPNLETYLKWNLKLAYDNYERVDLVSTLPELMFVICVYGKTQKEVKNHADVMKQAGGRELDLQRITEGDLINVITKLMNPNTSL

SEQ ID NO: 6953 - protein, 138 aa, Enterococcus faecium
  misc_feature (B) LOCATION 1...138
  hypothetical: YES
RVIVMAKNSWELKINGHDELLVRMERYSSESERLINEALKSKGSAIAVDRITEKIPVSEADLRRGHQHAKNSRPLKTQYINLGFIIRPTRKFEYLKYPDLGIGTSKRNQPDEFMRRGLGLALDPITELLIRQFDKLNK

SEQ ID NO: 6954 - protein, 313 aa, Enterococcus faecium
  misc_feature (B) LOCATION 1...313
  hypothetical: YES
TKIVYFIKMKDEVDYMNGFTKYWNRPDRAAYLFLTPSFLVLLLFTVIPLLGTFAISFTDLNIFFTSRNFVSFENFTRIFSDERAVNSLIHSLYFTVLETPTQIIVGLLAAVALSKNTRFNRFCRSTFYIPVICSLTSIAIIFSMLLDPNVGAIPYLFSQVGLPIPQFFRDPTLAMPTVAIMTVWKNFGVTMTILLTAIQGISPSLYESAQMDGATNRQQFFNITLPQIVPSLGFCILTNLIGSMQVFDQVYVATAGGPQFKTETAVQYIYSRGFTAPYELGYASALSSVLFIIVATIAISTNVYMSRKEKQMK

SEQ ID NO: 6955 - protein, 395 aa, Enterococcus faecium
  misc_feature (B) LOCATION 1...395
  hypothetical: YES
GGVVLSGNKQHPSKDKKEASKAATADIIDKRRNLRKKEDKIVRKIILVIALTLLIIGGFLGFTVYRYVDSGLKPLDKSDDQLVQVEIPSGSSNKQIGEILEKDNIIKSGIVFNYYTKFKNLTGFQAGYYQLAPNMTLDEIGKQLQEGGTSEPTKVADGKIAIPEGYDIDQIAERVAKVTGKDKKEFLDLVNDETFFNELYQKFPELLESASKAENTKYRLEGYLFPATYDYYTSTSLKDLVIEMVNKTNTVMQNYYSAIKQKNLTVQEVLTLASLVEKEGVKENDRKNIAQVFFNRIKANMPLQSDISVLYALGEHKELVTYEDTAVDSPYNLYTNTGYGPGPFDNPSEEAIKAVLEPAENDYYYFVADTSTGNVYFAKTYEEHMELVQKYVNNS

SEQ ID NO: 6956 - protein, 170 aa, Enterococcus faecium
  misc_feature (B) LOCATION 1...170
  hypothetical: YES
CGSVHETLGGIILDINEIRELVSQFDQSSLTEFDLREGQFELYMNKNKTSRGMNMVQTNETLPVSEPVNVISEQATTAPEIMKEKESAVFDGIEVVSPIVGIVYLQPAPDKPAFKKVGDQVAKGEVICIIEAMKLMNEITSEADGVITEILVENESVVEYGQPLFRIQQK

SEQ ID NO: 6957 - protein, 68 aa, Enterococcus faecium
  misc_feature (B) LOCATION 1...68
  hypothetical: YES
GIPVIYCSDCFLSTTFLQEIYLLVFSAVIFDFCFHSINKDIQIFYSCFFTSITTYVHCCIFQFLVSNN

SEQ ID NO: 6958 - protein, 71 aa, Enterococcus faecium
  misc_feature (B) LOCATION 1...71
  hypothetical: YES
ILTVTKNGEMEEHQQVIDRIYEATRYLPLDRLCLSPQCGFASTEEENVLFEEQWKKFLLSKALQKKFGENH

SEQ ID NO: 6959 - protein, 76 aa, Enterococcus faecium
  misc_feature (B) LOCATION 1...76
  hypothetical: YES
ISAVLTNARAIARRCLCPPEKFPPPCSTWLSKPSSISETKSLACAISNAFQIISSVASGLPYCILSRIVPENRTAF

SEQ ID NO: 6960 - protein, 64 aa, Enterococcus faecium
  misc_feature (B) LOCATION 1...64
  hypothetical: YES
QAAVLPPPAVPAKGGKGRPAPAFSPASGLAGSPGRPCGRSGQPLSFPPAPGRPCRPQSAPSGRG

SEQ ID NO: 6961 - protein, 172 aa, Enterococcus faecium
  misc_feature (B) LOCATION 1...172
  hypothetical: YES
RVYVKQGGRSVTRKISKIGASLLVLAVATTIDYRQSEAKTIGNVVYRETAKSMLKKAMDNQPESSYWFPEDSLAWSFGKDTDTKYNTSVVPLAERVSKATLPNMNVTQTEEVKVVALSAMNSSINGNASRGIDIFYANVFSYWQYIDQLVYGGALLVKDHRIAKSSCDGCSP

SEQ ID NO: 6962 - protein, 70 aa, Enterococcus faecium
  misc_feature (B) LOCATION 1...70
  hypothetical: YES
QRDFLVRFLLRHTHTYLRCLMLLAQYHQEEQLESGCALRHLLFSSVIFYFNVYYTTYNIVSKSVCQIQKN

SEQ ID NO: 6963 - protein, 80 aa, Enterococcus faecium
  misc_feature (B) LOCATION 1...80
  hypothetical: YES
RADFFRLSHQTFFPPPGGFSRGGMQNPPRPPALGGWGGGDFMGGEKKKKKVRNKKKKKKKIKKKKKKKKKKKKKNPSFFI

SEQ ID NO: 6964 - protein, 63 aa, Enterococcus faecium
  misc_feature (B) LOCATION 1...63
  hypothetical: YES
PANVKQAYLELGGLPELDGRYTVFGQVYQGLEIVAAIAAQPTNSEDVPIEPVFIRQINFEKTS

SEQ ID NO: 6965 - protein, 95 aa, Enterococcus faecium
  misc_feature (B) LOCATION 1...95
  hypothetical: YES
INNVNPITLRAISPISDKIKRPVKYRFIISRFLISTIGPKTKKAATGAVPNRLNKEDPINASASEQRDIVKANNSMMIMAKIFVEPSVSIILVGK

SEQ ID NO: 6966 - protein, 411 aa, Enterococcus faecium
  misc_feature (B) LOCATION 1...411
  hypothetical: YES
EYNVFCRKHTRIGLISMTQVHFTFESEEIQAIINESGANDTAKTLMTIMFNQLMEEQRNQYIQANAYERSEERQSQRNGYYDRSFTTRIGTLELHVPRTRDGKFSPTIFERYQRSEKALIAAMIEMVISGVSTRKVTKTVELLTDGATVSKSFVSNLMKQLDPFVFEWRNRSLEGSEYPFFMCDALYMKVRENHRIVSKGVYIGIGIDSDGRRTILGFDVQDGESEDNWDTVFQSFVQRGLFGVKLVISDAHKGLVKAVRKNFLGASWQRCQAHFLRNIFDKLPKKVSSDVKDELKSIFKASELELTRERKEHFLEKYGCDSKLSAACDILENGFEDAIQILSFPENIRRRIRTTNVLERLNEEIRRRERVIRIFPNINSITRIIGTLLMEKDTEWLASPRKYLEFNSNNI

SEQ ID NO: 6967 - protein, 127 aa, Enterococcus faecium
  misc_feature (B) LOCATION 1...127
  hypothetical: YES
LINVIPTKKKPKINAIIVNVAAAFFALGFLKNGTALLIASTPVKEEEPEENARKIKAIETPGTAAPGSAVACNGTAPVTILYKPTTISNEITRINVYTGNNRNDADSLSPRRFSIISSKTIVTEIAT

SEQ ID NO: 6968 - protein, 161 aa, Enterococcus faecium
  misc_feature (B) LOCATION 1...161
  hypothetical: YES
MTNVKMAQLEVDLSFEQVAKNSQLNVAILDPDGKEIYQQQYPLKEQMTIRIDGFENVALWGHFQPNLYKLELETIDEEKRVTEYIDYSFGFRKIEIKDKIIYFNGKRMIINGVNRHEWHPKKGRAITIEDMEKDLAIIKNAKINGVGPSHYPPEWPDPHTA

SEQ ID NO: 6969 - protein, 119 aa, Enterococcus faecium
  misc_feature (B) LOCATION 1...119
  hypothetical: YES
IKNVRAHSKVKSANRLKKELSEGFIVLKPLGDRVIIEVAKEEEKTVGGIVLASAAKEKPQTGTVVAVGEGRLLENGEKVPAAVKAGDQVMFEKYAGTEVKYEGKEYLIVAGKDIMAIVE

SEQ ID NO: 6970 - protein, 564 aa, Enterococcus faecium
  misc_feature (B) LOCATION 1...564
  hypothetical: YES
GANVMLQEISITNFAIIPELRLSFHEGMTALTGETGAGKSIIIDALGLLAGGRGSSDYIRQGAEKCVLEGLFELPKQEGFSELMVELGIETDEDNLIVRRDMSLTGKNVCRVNGHIITLANLRRIGSYLVDIQGQNEHQELLQPESHLALLDRFGDVAFQQKKKSYQQEYISYRELEKRVRKVQQNEKSYVQRIDMLHFQQEEIAAADLQVGEEEKLKEEREKLSNYQKIADGLAAGYGALTNNEQNSVDGVGLAVSELQGIAHLDVEYEAIYENIQSAYYLLQDAIGDMSRQIDLLELDESRLEEVTQRLELIRQLKRKYGESIESILAYYDEITEELASSDFSEGQLDKMKEELEQKELLLQQQAADLHEARKKIAKELEKSILHELKSLYMENTEFEVRFLKEENRQLNHDGFDQIEFYITTNPGEPLKPLVKVASGGELSRMLLALKTIFSSEQGVTSIIFDEVDTGVSGRVAQAIADKISQISKYSQVLCITHLPQVAAVADYQYYIVKAVIDGRTQTSVSELKTKEREEEIARMLAGSEITKLTLEHAKELLKLAKRT

SEQ ID NO: 6971 - protein, 105 aa, Enterococcus faecium
  misc_feature (B) LOCATION 1...105
  hypothetical: YES
KENVGMNKKAAMQRIIELTYSEDWQNDKEAASEVMRLGRAMWADKSNKPRPRKIAIWHGDKLLVTGTAEQLASLTGLHEKIVRKRARCGYTDVKKRTFRYVEGSS

SEQ ID NO: 6972 - protein, 105 aa, Enterococcus faecium
  misc_feature (B) LOCATION 1...105
  hypothetical: YES
KENVGMDKKAAMQRIIELTYSEDWQNDKEAASEVMRLGRAMWADKSNKPRPRKIAIWHGDKLLVIGTAEQLASLTGLHEKIVRKRARCGYTDAKKRTFRYVEESS

SEQ ID NO: 6973 - protein, 328 aa, Enterococcus faecium
  misc_feature (B) LOCATION 1...328
  hypothetical: YES
NRNVSAFLNRKNQTYILDILEKNMKTAFLFSGQGAQYQGMGKDLYEEAVVKQTFDEASEILGYDMAELCFTENERLDQTQYTQPAILTVSIAYYRLLKEHGIIPDAALGLSLGEYSALVASNALSFTEAVALVAKRGAYMTEATPAGSGKMVAVMNAPIETIEESCHEASKYGIVSPANYNTPQQIVIGGEEKAVDEAVLLLKEKGFKRMIPLNVSGPFHTAILEPAAKKLAKDLSQIQFSEPSFPIISNTTTEIMKKETIAGLLEQQVMQPVRFYESIHKLKTIGIEQVIEVGPGKVLSGFMKKIDKTIPVLRVENKQTFDETIAIL

SEQ ID NO: 6974 - protein, 96 aa, Enterococcus faecium
  misc_feature (B) LOCATION 1...96
  hypothetical: YES
IGNVKIVVDKKLAVSPTKLSGEKPVVSRCNTERKNAVATPAAGPNKNMLINTEISLKSIFKKLKAGMIGKAKYCKTNAIAANIATATIFCTRVFFI

SEQ ID NO: 6975 - protein, 319 aa, Enterococcus faecium
  misc_feature (B) LOCATION 1...319
  hypothetical: YES
EGDVKMEAKIEESKQKIDQLIQELEKAVIGKRSTIQLMIVALLAGGHVLFEDIPGVGKTLLVKALAKAVQGTFSRVQCTPDLLPSDILGFSVYNSQTKEFEFRPGPIFTTILLADEINRTTPRTQSALLEAMAENHATIDNNTYPLDNHFFVLATQNPIEYEGTYPLPEAQLDRFLFRLQIGYPSFDDELLLLLDKFEKVLDNLKVVLNSHEIEEIKTRVANVFVSPEVASYALQLVSATRTHSAIQIGISPRGSLAFIQAAKAYALIHGRNYVTPKDLQELVPFVFSHRLIFYDRSLKEDEKTQMIHTLVAQIPIPVR

SEQ ID NO: 6976 - protein, 100 aa, Enterococcus faecium
  misc_feature (B) LOCATION 1...100
  hypothetical: YES
LIDVTSQREIDYIKFSDEVKYYYDKSKGRYGAIKIQRDLEEAGIPCSVKRVQRHMAKLGLRSVVVRKYKYQNNQGKVPDDKENILNRDFTTTTINPKMGY

SEQ ID NO: 6977 - protein, 242 aa, Enterococcus faecium
  misc_feature (B) LOCATION 1...242
  hypothetical: YES
SIDVFSYLLKKEVERMDKLQVIADYSMDQLAHDQTGHGSDHTKRVVKLAEKILETEPQADRFVTLAAAYLHDTIDDKVVKNENEAKQQLRVFLRSLPIVEEQISMIFSIIENMSFSKNLSEAAELSLEGKIVQDADRIEALGAIGILRTAYFGGGHGHPIFDPELYPQTFKDKENYRKGTTVINHFYEKLFLLSDKMNTDYGYEEAKRRETFMREFLEEFFLEWSIDDENFTPDNWIKNNKK

SEQ ID NO: 6978 - protein, 350 aa, Enterococcus faecium
  misc_feature (B) LOCATION 1...350
  hypothetical: YES
EKDVNGMSLIQLTNVKKTFNGKNGNIQAVNDVSLNVEKGDIYGIVGYSGAGKSTLVRLLNGLELPTSGEVIVNDQDITKLKNKELRTFRKKIGMIFQHFNLLWSRTVLENIQLPLELAGVPKSKRKERAEELLRLVGLEGRGQAYPSQLSGGQKQRVGIARALANDPEILLCDEATSALDPQTTEEVLDLLLAINKKLNLTIVLITHEMNVIRKICNKVAVMELGKVVEEGDVLTVFRQPKKEVTKRFVQQDIEPEADSTELLAELIKENPSGRLATLTFSERNANEPVISQAIRRYNIDVNVVYGKIKQVKEGSFGSLTVLMTGETKELDQAEVFIKEQGVGIEVIHRG

SEQ ID NO: 6979 - protein, 235 aa, Enterococcus faecium
  misc_feature (B) LOCATION 1...235
  hypothetical: YES
KGDVFLGKRLIKEVPTSSLPRERMEIYGAEALSDQELLAILLRTGQHPYSVMSIAGNLLKTFGGLASLRQATLHELEEIRGIGRVKAIEIKALIELGRRIQTDHERAAPPVRTSYELAQQLILEMKDHKQEHLVCIYLDTKNQVILKKTVFIGSLNQSVAHPREIFHYAVRYCAARIVLAHNHPSGNVIPSQQDMNFTKRIQKCGEMMGITVLDHLIIGRKRYFSLREEGMMEEK

SEQ ID NO: 6980 - protein, 98 aa, Enterococcus faecium
  misc_feature (B) LOCATION 1...98
  hypothetical: YES
NKDVQDNMYKPYMISYDLNNPGQKYDKVFEIIKEFGAYIKLQKSFWLVKTNLNPNQMCEKLNTVLDNNDSLFICELQKNYQGRATEENWKFINEHIFS

SEQ ID NO: 6981 - protein, 177 aa, Enterococcus faecium
  misc_feature (B) LOCATION 1...177
  hypothetical: YES
LSCVCSSNPKINVPTNARTKAIPVAITATVTFDSTPSTVLMKVGIVNKLTKLLEKAFTPENPIIAPPIPPEIQAAMNGFFKGNVTPYTVGSVIPNNEVTVEEIPNARSFVSFVRNATAKAAPPCAKMAGRSIGINTSNPYCSIFKNMIGTNPQCMPNITNTCHKLPMIRPATIGLNP

SEQ ID NO: 6982 - protein, 94 aa, Enterococcus faecium
  misc_feature (B) LOCATION 1...94
  hypothetical: YES
IACVGSPVCSFFWMSLSLATILAMLEILSDTLDRFIERIKFLINMAETIKETNVEKQTTRMIVFWSFNGFFLKKGNIGYLERIYCENFNMKTKI

SEQ ID NO: 6983 - protein, 223 aa, Enterococcus faecium
  misc_feature (B) LOCATION 1...223
  hypothetical: YES
EPRVLANRTSLQLGLQANIFGTVLGTILGTISAMKQNTWADTSSTLVAILGRSIPNFVFAVLLQYIFAIKLQVLPIAKWDGFVYTILPTIALAMSPLADSARFIRTEMVEVLHSDYVELAKAKGLSRWEIAFKHGLRNSLIPLMTLLGPLAVALMTGSLVVENIFAIPGIGEQFVKSITTNDYPTIMAVTILYSFMLIFVILIVDLLYGLVDPRIRVSEGSRG

SEQ ID NO: 6984 - protein, 63 aa, Enterococcus faecium
  misc_feature (B) LOCATION 1...63
  hypothetical: YES
FKRVIFIPEAIKKPTANAIPKIRQEIPMNTYPAEQKKRKLAKDKLMNRTPDATWRLAALYSFQ

SEQ ID NO: 6985 - protein, 113 aa, Enterococcus faecium
  misc_feature (B) LOCATION 1...113
  hypothetical: YES
AERVCSVLQKGERSMEQLAYKYPTKQPINKKIHVGVVGSGDLEILMFPTEKTESTVKICTGSDGFGEVWNNVLTRFFDRYPISADIVINDFGATPGVVYLRLTQAMEELSDEK

SEQ ID NO: 6986 - protein, 472 aa, Enterococcus faecium
  misc_feature (B) LOCATION 1...472
  hypothetical: YES
NLRVVEEKKISPKIEETPKSKINIASIIKKNGIKENSEAIEGNLDFLTKLLEEDSGNYEPPIEDAKLNMIRDDLTRNYSQEVLQALTDDEIRRKLVQVVLKEHGTFFKKDKEVAEYVVRECIGTGIIERIMTNDEITDVGWNGSQLSIETNSNKWLFDGDKLNITQEYIERVISKYAVVNDRAFNSGNPIMDGMFKNVRISATHIDNSPDGSTFSMRVARPRLALNKENFEDFAPDYILELFEKMMKTKANICISGETGTGKTELQKLLLSFIDNHDRMIMIEDVQETHAKELFPDKDIFSWITTPKKAISDLVKASLRNNPRWIIVSETRGSEAYEMLQAVLSGHYVVTTLHAVNARAIPRRFVNMCASGFKINENAVEEDINRYFDFGVHIKKTVVDGKVIRYLNEIVEFSASEPTTVFKQKFINGKFVIENGSLSEDFKEKMAEKFITFEFPEDQTNTEESLPEEEEVI

SEQ ID NO: 6987 - protein, 221 aa, Enterococcus faecium
  misc_feature (B) LOCATION 1...221
  hypothetical: YES
IMRVRNRPGAAEMLAAHPNFVISDPTLWKGKWNELFENDHPIHIEIGMGKGQFITGMAKAHPEINYIGVEMQVSVVSIALDKLIEQPLPNLKLLHVDGSALTEYFADSEVDQIYLNFSDPWPKKRHEKRRLTYKTFLAVDEQILRPNGEIHFKTDNQGLFEYSLASFSQYGMILKQVWLDLHQSQFEGNIMTEYEEKFSSKGQRIYRVEAQFQDKTKKKSL

SEQ ID NO: 6988 - protein, 82 aa, Enterococcus faecium
  misc_feature (B) LOCATION 1...82
  hypothetical: YES
FDSVRCDMAIIVNLDVVLAQKKMSVTELSEKVGITMANISILKNGKAKAIRFSTLEKICQVLECQPGDLLTYKNDSNTIPEE

SEQ ID NO: 6989 - protein, 75 aa, Enterococcus faecium
  misc_feature (B) LOCATION 1...75
  hypothetical: YES
KKSVERNGRKVTKNNETKTMKQKHLKRLSVAQYINDMQLTGKEKACLLGSMKNFEQLRRTYVKKSSNCQLLLEVS

SEQ ID NO: 6990 - protein, 129 aa, Enterococcus faecium
  misc_feature (B) LOCATION 1...129
  hypothetical: YES
NESVLNLLKREKHMIKGIGIDAVELPRITRLIEEKPKFIARILTSDEMKLFQSLPFHRQVEFLGGRYACKEAFSKAWGTGIGKVTFQDVEILKNENGQPVVTRSPHEGNVWVSITHTNETAFAQIILED

SEQ ID NO: 6991 - protein, 498 aa, Enterococcus faecium
  misc_feature (B) LOCATION 1...498
  hypothetical: YES
NRSVKHMENLAVNITNLQVSFGNQLELSIDSLRVYQQDRIGIIGENGVGKSTLLKLIAGELFPDHGKIQTEITFNYLPQLTYLAEAKDLNLELASHFQLRLEETSERKWSGGEERKIELIRLLSSYEQGMLLDEPTTHLDRKSIDRLIEELRYYYGTLVFVSHDRYFLDELASKIWEVKDGEIREFSGNYSAYLTQKELEKKTQLREAESIMKEKKRLEKSIQEKKKQAEKLEKVSSKKKKQQIRPDRLSSSKQKDSVQKAIQKNAKTLERRLQKIGETTKPQQMKQIRFPVPKSLELHSRYPIMGQNVQLERSGRTLLVNGDFQFSLGKKIAIVGENGSGKTTLLEHIRKQGEGILLSPKVSFQVYQQKGYQMTSEESIIRFVMRQTEFSESLVRSLLNHLGFAQETLTKPLCTLSGGEATRLTIALLFTKPSNVLLLDEPTNFIDMATIEALEKLMQIYPGTILFTSHDSYFVERTADEVYEIKGQKIKKVLTRNF

SEQ ID NO: 6992 - protein, 408 aa, Enterococcus faecium
  misc_feature (B) LOCATION 1...408
  hypothetical: YES
KRSVLVKYSEIMVRYGELSTKGKNRKSFIMQLAQNVRQALKDFPEIKIHADRDRMHLLLNGADGQLVIPKLAKIFGIQNFSPSIRVEKDVEVLKQAVQDIMKEIYTGKETFKIIAKRSDHQFELTSNELNQTLGNAVFDIFPHIQVQMRQPDIPLRVEIRRDGAYLSYETIKGAGGLPVGTSGKGMLMLSGGIDSPVAGYFAMKRGVEIEAVHFASPPYTSEQALQKAKDLTAKLAPYVGTIHFIEVPFTEIQEEIKKSVPQGYWMTITRRMMLRLTDEIRRIRHGLVILNGESLGQVASQTLQSMVAINEVTNTPIIRPVATMDKLEIIEVAEQIDTFNLSIQPFEDCCTIFAPPQPKTRPQLEKVHQYEERLAIDEMIQRALAGLKMEEIQAESSNEKTEEFSELL

SEQ ID NO: 6993 - protein, 297 aa, Enterococcus faecium
  misc_feature (B) LOCATION 1...297
  hypothetical: YES
SAGVFRKLVKKMGKERTNKHQSKRGFEDKKQNRYSNKKQTGRNQSVSDQNEEALEDNFVFGHHAAVEALQQGRGNKLFLQEDSRGEKVEELKEIAREQAVPVKWVPKQKLETLSDHGVHQGVVLAITPYEYLSLDQLIERTKEKKEDPFFLILDSIEDPHNFGSILRTADASGVDGVIIPKHRAVGITPIVTKTSTGAVEHVPVARVTNLVQAVQQLKETGFWVFGTDMTGTNFQKWNAKGSIALVIGNEGKGMSPGLKKEMDELLTIPMTGHVQSLNASVAAGLLMYQAFSQRQGE

SEQ ID NO: 6994 - protein, 161 aa, Enterococcus faecium
  misc_feature (B) LOCATION 1...161
  hypothetical: YES
ERGVTAFSKCYTLLRGEGMEKLYDVIVVGAGTSGMMAAISAAEQGARVLLIEKNKKAGKKLLMTGGGRCNVTNNRPVDDLIAHIPGNGNFLYSTFAQWNNFDIMNFFESQGVHLKEEDHGRMSPVTNKSKTIIEALLNRLKELGCDDPILYSSREIDPQRT

SEQ ID NO: 6995 - protein, 377 aa, Enterococcus faecium
  misc_feature (B) LOCATION 1...377
  hypothetical: YES
WAGVKLMVYKMNESIIVIQAEATSPNRTNVVFWSHDRGTAKLRMKLVRKNGIPQSLPEGTTVPIRLMFKSATAEGGYGKHDYLATVEDPVNGIVFIVLEDNILGYVGKVEGSVYIDFPNDRSLDTAGRFTFYIKRSPIDDSTPELEDYYFNGFSQTIDKIEKILADGKLEIEKKIAESETQIDAKVKDTNDKITKANQDVATLNTNIDKANDRIDQTNQQIGDLGKLKKMYSNSIDFGDYDYSGRPNLFLNLDFSKLSKNASEITEPPAYVKDGGSHFVLDFSDPSANDVSRSVYIPSVGRLEKGSTYIVTVPIMISEDFSTNYGSSPIYPYCVSANNVVTRVTYLYPDNSCRGKWGFIKETFTVPENVSDGEFTYF

SEQ ID NO: 6996 - protein, 90 aa, Enterococcus faecium
  misc_feature (B) LOCATION 1...90
  hypothetical: YES
VRGVTLWWVVGGVFSCLQTFITNVMMKPRLKAQVAEELKQNPPKQVVTPRKDVTESAKPADSKQATKQIKQPKNSTNNKGRNAGKQQKRK

SEQ ID NO: 6997 - protein, 128 aa, Enterococcus faecium
  misc_feature (B) LOCATION 1...128
  hypothetical: YES
KVGVEMFPEKIKELRLSKKMTQQEVADKLGITRPAYTAYESGKREPDFSILQSLANIFDVTTDYLLGRNKTPKWADENDLIELDKMLDSNVNMAYGGETLTDEEKQRVKDVLTGLFWEFRKEDKSKEK

SEQ ID NO: 6998 - protein, 279 aa, Enterococcus faecium
  misc_feature (B) LOCATION 1...279
  hypothetical: YES
HNFVRKKYNFFLTISLRKGLCLHLSGGKIMEYTIKKMSEISGVSPRTLRFYDEIGLLKPARINSSGYRIYGKKEVDRLQHILFYRTMAFKLDDIQEVLDNPSFDHQKALIKHQQMLLEKRAQIDTLLTTVQQTLDMYEGGRKMSDKEKFEGFKQQKLKENEESYGQEIRQKYGKKKVTASNEKWMNMDKETYEEMQTVEKQMLFDLTLYLKEPEDESLADRIFQAHKKWFSYSWPEYQPKAHKGLGMMYEADERFTAYYDERSGHGAAKALNEIIQKKA

SEQ ID NO: 6999 - protein, 731 aa, Enterococcus faecium
  misc_feature (B) LOCATION 1...731
  hypothetical: YES
VLFLVKIGEIEKMKKCRNIILSMLFIITNITSLIPVHVYADAGRDISSNVTSLTVDPTNITDGGNIKVKFSFDEKKQNIQPGDYLWINWPSEGNIRGEGFQKEIPLMIENKNVGTLTVRKDSAQVVFNENIKNLDSVEGWGQFEIQARNVTDTGEENTGPFTVTSGDKTATVNVTKPASGSSSSVFYYKTGDMLPEDTKHIRWFLNINNNGTYVEQPVKISDEIQSGQRLDPSTFEINQIHLGEQKVYRGEEGIQQFLQDFPSATFNFSVTDNYIEITIPKNFVNLRKIMVSYKTIIENPEQINFENHSEAWFKEFNKPAVDGESFNHTVKNISASGGVNGTVRGELKIFKYINDTEIGIPNVTFELRRADEQPIQGQSSILLTSNEQGEASIKGLQVGDYVVKEKEAPNWIDFDPLSSNELKFSINENDTEGVSLPIYNKKKVTNITATKIWNGGTTPRPSIYFKLFRASTNNWEPVPDAETKRLDNGITSVTWEDIQQYDDSGNEYTFKVQEVDQNGNDYVPSGYQKIENGLVVTNENKEVISVSGQKTWEDNENQDGKRPTTITVNLLADGQPIQHKEVSEKDDWRYRFTNLPKYRDGQEIIYTVTEDNVPEYSTTIDGYNIKNSYTPEKTNISIPGSHITPWKNFPEKTEREKIRNLFSQKLQIFAHTGESSEQRSNYISKRAVPKQITNKSKSILPKTSSKKSSFAVIIGLLIVTICAGASIILCK

SEQ ID NO: 7000 - protein, 123 aa, Enterococcus faecium
  misc_feature (B) LOCATION 1...123
  hypothetical: YES
IKFVKRGNQMKNDLQISQETELEPIVEVASKLDLKEDDLELYGKYKAKINFSGINRSKDNAEGHLILVTSINPTPAGEGKSTITVGLGDALNKINKKSVIALREPSLGPVMGIKGCAASPDMH

SEQ ID NO: 7001 - protein, 179 aa, Enterococcus faecium
  misc_feature (B) LOCATION 1...179
  hypothetical: YES
IFLVRPTIIKRNRKAYGTRKLKKCLAKRGLQLSRRRIGRIMKRRGLTSTYTIAHFKGQRTACNEAKTANVLDRTFTQEQPLEAIVTDLTYVRVGKKWHYICLILDLFNREIIGYSCGEKKDASLVKEAFGRIPYSLTDVKLFHTDRGKEFDNQTIHEILNGLVIKFFSTIRMEEFDFLK

SEQ ID NO: 7002 - protein, 211 aa, Enterococcus faecium
  misc_feature (B) LOCATION 1...211
  hypothetical: YES
QLLVTAGIGIFGNGKLVKAEEVAQKPSEVTITLHKKGFSSVPEERPNSGLVSTDFGEENIPGVDFDLFDVTEVYYDLIRDNPLTPEREDGLNSAEAIEWIQKRHTESWFLKYRLTSIDKQTTNEAGEAVFSTVQVTEEAPSSRDKVYLFLETYSPAHISRIASPMVVMMPVMMPDMVDGVWDGSTWKDTYNTDVHLYPKNEIREADKQMNV

SEQ ID NO: 7003 - protein, 60 aa, Enterococcus faecium
  misc_feature (B) LOCATION 1...60
  hypothetical: YES
AKIVFNQSKTTSKEKNPSLLFKKAGVFIYFKIIFLSALLNHRSAMKPCYTAHLFSFILLV

SEQ ID NO: 7004 - protein, 80 aa, Enterococcus faecium
  misc_feature (B) LOCATION 1...80
  hypothetical: YES
KSVVIFYFEKLLGIFDNRYSHIERVEKLFTKVFQKNSVLSVEGCEFRSHVSVEDKLSFISADGETEKLIEKIYLHKKFLD

SEQ ID NO: 7005 - protein, 89 aa, Enterococcus faecium
  misc_feature (B) LOCATION 1...89
  hypothetical: YES
LNVVTIRGATTQGIRIVAFNTIGKPKIAGSFTLKIPGAKANRPTSRYCFFLRTKAINKTTAKVIPEPPIPTVKVSMNGFVMMCGNSFPC

SEQ ID NO: 7006 - protein, 208 aa, Enterococcus faecium
  misc_feature (B) LOCATION 1...208
  hypothetical: YES
KDVVMSERGLLIVLSGPSGVGKGTVRKAIFESEDNDFQYSISMTTRKMREGEVEGVDYFFRSKEEFESMIEAGEMLEYAEYVGNYYGTPLSYVNKTLDEGKDVFLEIEVQGAKQVKEKVPDGVFIFLTPPDLAELKSRIVGRGTDADEVIEERMKVAKEEIEMMALYDYAVVNDEVPLAVERIKNIIASEHFRVDRVIGKYIKMLKEM

SEQ ID NO: 7007 - protein, 188 aa, Enterococcus faecium
  misc_feature (B) LOCATION 1...188
  hypothetical: YES
MRVVCSEILFITRLFDEIKEDQEHCLKKLEKENLELKERIRYYETKFCKRGDCMKPNPVETGKRIKSIRSNFGMTMEQFADLIGNAQKGNINNWERGFSLPNKERLIKIAELSNKTIDWIKWGTLEEYITSYLIGIGYELYIKDFPEIPHKVFKDIQEKYSDTFSLDKDYELLDSIIKNIFTKYYSNG

SEQ ID NO: 7008 - protein, 73 aa, Enterococcus faecium
  misc_feature (B) LOCATION 1...73
  hypothetical: YES
NECLLYMLITQKYDIHIEKGALEPAGSWFQTIWRPQKVAVITDTNVAPLYAEKIMFQLRQANFEPVLSIRTGG

SEQ ID NO: 7009 - protein, 264 aa, Enterococcus faecium
  misc_feature (B) LOCATION 1...264
  hypothetical: YES
RNSVIVRVRKEGVAMNFTRKDKYTIKEEVFRLISQQENTDKDQDLQFLEAELAKLFIANQNETTEPDEELYIGKWLFDEFQPLDENTGIGYFVFLSPVGFTPGVLVKQNDEITVKAWPALFSVIKAEGVIKKIQSAYYKSQFIANSKLMNMFYNRLVEIARPGKIPQTFTYTQQKNLYEEVLYSRDLSEFSPWEEVRLHELLSTKPVSLNFFNALDNKRKLISTNYWEVFAARKKWMEEKKIADQQIQFVQLKKEKLYYGLYSR

SEQ ID NO: 7010 - protein, 478 aa, Enterococcus faecium
  misc_feature (B) LOCATION 1...478
  hypothetical: YES
GQSVVSTIDSLSCRVNNESSFCMEEEKLTRSLSARHIQMIALGGTIGVGLFMGASSTIRWTGPSVMGAYAIAGFFLYLIMRALGEMLYVDPSTGSFANYASEYIHPVAGYLTAWSNIFQYIVVGISEVIAVGSYMNYWWPDLPAIIPGIIVVLFLMLANLISVKAFGELEFWFSIIKVITIILMIIAGLGVILFGFGNHGQAVGISNLWKNGGFFTGGVKGFFFALSIVVASYQGIELIGMTAGEAENPKKTIIEAVQSTIGRILIFYIGAIFIIVSIYPWNQLSEIGSPFVQTFSKVGITFAAGLINFVVITAALSGCNSGIFSASRMVYTLAINGKMSKKFLKLSRHGAPFYPVVAISGGILIGLILNYLLPMFINQSENIFVFVYSSSILPGMVPWVVILISEIRFKKKHADKMHDHPFKMPLSPYTNYVTLAFLAIVLIFMFINPETRISLIIGLVFLLYMTIHYFVREKRTGK

SEQ ID NO: 7011 - protein, 294 aa, Enterococcus faecium
  misc_feature (B) LOCATION 1...294
  hypothetical: YES
KNPVCLLLIIYKKEFEMFPLNLGIRAHDLDVRNREEIVQKVSQLHLSHIQFAPQKAFPEQLKLTDMTLGSAAYFGEYFQKNNIELSILGCYINLSSKNQEVRAQALATFKQQIALCSAYQAKMIATETGSVSVGYTKENFTEEAYQIARNSIIELVAHAENFGVTVAVEAGINHPIYNYQLAKRLIDEVASPNLKIILDCANLMHKENHADQEKVIRGALDNLHGYITALHLKDYIMENGKIRMVPVGKGCLDFRPVLHYIKYERPLMYATLEATPEIYVPEAIEHLQFIYQDC

SEQ ID NO: 7012 - protein, 282 aa, Enterococcus faecium
  misc_feature (B) LOCATION 1...282
  hypothetical: YES
KKCLWIGHTFCYFLYCDDFEFPIIISFAFSFMKIGYSFEFVGFDNYLAIFRDPLFIKSYTNVLIIMAGSIPITMLLAIYFAVLLNSAQLKGKGFFRTVYYIPTITSTVAVASVFMTFFNPTGLFNGFLNALGINGVQWLTNPFWIRISMIITMIWLSVGYNTILFLAGLQGISKEIYESAEIDGASKFRQFFLLTIPMLKPIILMATVLATINGLGNFNIPNIFFGTSNGPENSALVVGVNLYKTSFEMVDFGKASAIAWTMVFVSVILSAIQFKFGGDKND

SEQ ID NO: 7013 - protein, 73 aa, Enterococcus faecium
  misc_feature (B) LOCATION 1...73
  hypothetical: YES
RKCLKMESLYDVQQLFKKFGIFIYVGARIYDIELMTIELRNLYDSRLIDHDTYMTAWRILKREHRIEESRKKR

SEQ ID NO: 7014 - protein, 270 aa, Enterococcus faecium
  misc_feature (B) LOCATION 1...270
  hypothetical: YES
YSFFYPFFMNNKKKKNIMTEIFFDTWYIGVIKEKEGKIMQSSAELKRQAKESLKGRWGQAVLLNLIPTLIGIATILLIMIPIILFATTIYDGSASVSEATTSGGGSSGGGGGIISSIISALFMSGISWTYLDILRGQKDQIEPFKDAFRGFKGLFIGGVISLAVLISIFTTLWGLLLVIPGIIKSYSYSQSYFIYYDIVQETGQTPKVLDTITASRKLMDGYKGQLFWLDLSFIGWHILALATAGIGYLWLSPYISATKAAFYEQLPKDI

SEQ ID NO: 7015 - protein, 98 aa, Enterococcus faecium
  misc_feature (B) LOCATION 1...98
  hypothetical: YES
LNTVYSEQGTLTRLLSQSLVFLWHYKWYDRTKFQREVREENEDHRDWTKWVGKIDPRKEDQRNHRLSATASRPFMAYDRLQYSGKTVVFTRTAIVYGI

SEQ ID NO: 7016 - protein, 75 aa, Enterococcus faecium
  misc_feature (B) LOCATION 1...75
  hypothetical: YES
LNTVYQEVVSLPFNSESQEIISKTTSPVFGSVGLLSRSSYWESIYQKKECDIGHTPFLFSLKHLSVLDSIQDKRL

SEQ ID NO: 7017 - protein, 363 aa, Enterococcus faecium
  misc_feature (B) LOCATION 1...363
  hypothetical: YES
KAAVVMTYRKIMAMGPKEMGFKVGVLDPVSDCPAAQVADWHIESVYDDTFALKELARRTDVITYEFENVSVEALNAILPMSFIPQGTDLLAITQDRLLEKSFLETNNIVIAPYATIVSPTDIQDAIDGIGYPCVLKTTRGGYDGKGQYVLKSRADLAPAMDLLREGTCVLEAWIPFEKEISIMVAGNGQGNFTTFPVVENIHHNNILHETIAPAAIDQDVIEEAERIARVIAEAVSLSGVLGVEMFLTKTGGLYVNELAPRPHNSGHYSIEACSMSQFDAHIRGICGWPLGEKVRLISNAVMVNVLGEQLLESYRLIENKPDWQFHFYGKKQAKKGRKMGHITILTEDIQQTLEEIKQTNIWD

SEQ ID NO: 7018 - protein, 79 aa, Enterococcus faecium
  misc_feature (B) LOCATION 1...79
  hypothetical: YES
NSFFIFRLEKISSCFFHFTIIEKLNFIAKKIINTYKYPLSILQFLCILFLLEKGILLDNFVISGKLHCNNDNKCTIITL

SEQ ID NO: 7019 - protein, 77 aa, Enterococcus faecium
  misc_feature (B) LOCATION 1...77
  hypothetical: YES
ESAVLQKSISSSRGTMNKVVSKRFRPNHSRKNAKTTLCELRFLFQNFDVFVNFLNKKLTIAEKARTNFFCYCFIGLS

SEQ ID NO: 7020 - protein, 75 aa, Enterococcus faecium
  misc_feature (B) LOCATION 1...75
  hypothetical: YES
ALFLSILTDKNVFLKKNKKTGVALLQATPAFDTLFILHIHEQVQRLLPSYRILSMHDQQVQPFSLCPSVSLNYAF

SEQ ID NO: 7021 - protein, 345 aa, Enterococcus faecium
  misc_feature (B) LOCATION 1...345
  hypothetical: YES
NKYVREKLKGGNIMKKWLLLLIGMGILFTGCTSENTRTKATIETDTTIETKKSKTQSTEQTTTEMKQSVETSASSITESSSEEVKNTLWDTNKASKLETFVTQWGKTLGQEYKSYNLQNNVSLYGTPLPQAVINGDWKMAINEAPVTVQWSEDGTGHADFNLVAVYSDVETGEYLGQHVYFFGFQNGQPKVYLTQQNQGNENNYLYFNETQNQQLKQGFSDIVNGQTPQTPVVEESTQQATTTTTQSTSSSGISSWEAAKESVLNNKALWLYDSPDKNVSNTNLISTNEYMKDLMQDENGSYYSINIVTDDDGNTTMAGGKQFRVYTDGRISQRIGMTNNFQMIK

SEQ ID NO: 7022 - protein, 189 aa, Enterococcus faecium
  misc_feature (B) LOCATION 1...189
  hypothetical: YES
LVHVKISQRRFSYMFETIKQNIQKYALLRAAVYIISGIAIVLNPSAVFHFIGYLITAYLVLLGLLNLFEAYRFKRKTGSWSIGLFSGLFFLILALIVYAFAPAIVSILPILLGLAVIINSLFQLFFSMNTKAKSWSVYSSILLLIGGFVLLFNPFKSLMLLFQIFGFILIFMGIQEIINFIRIRKMTIR

SEQ ID NO: 7023 - protein, 140 aa, Enterococcus faecium
  misc_feature (B) LOCATION 1...140
  hypothetical: YES
ISNVQRSLNPSKQSFNLIFSPLLLRAPSSPIAVNNRSLDEFKAVSIESWITPIINPIPTICIATSLEIPNKLHANGINNSEPPATPEAPQAAKADKIHKRTFKTKGASIPKECTAVNVIKEMVIAAPPILIVAPNGIDME

SEQ ID NO: 7024 - protein, 99 aa, Enterococcus faecium
  misc_feature (B) LOCATION 1...99
  hypothetical: YES
PVNVPVIVEFWPEARSATANKVDKIPDFATAIKIPLLIADGSDKASYRPKKEGSWTEPVLKTATPMINSSALTRKAIDNWILESQVEKRTACATSSSFW

SEQ ID NO: 7025 - protein, 81 aa, Enterococcus faecium
  misc_feature (B) LOCATION 1...81
  hypothetical: YES
ANNVANNALLNPSTKVTSFPASIGNNWTVPCPGVNNPHMTITAIGINLTINVTDCTEAPTFVPNKFNPVTETAVITAINKR

SEQ ID NO: 7026 - protein, 237 aa, Enterococcus faecium
  misc_feature (B) LOCATION 1...237
  hypothetical: YES
ALDVEDADKLFVLDSKEKIKRFSEIVSQIPIEFMDFAEEVIELITARISSPLDSNIYITLTDHIYFAIQRKREDRDVTAIMLPEMRFLYPNEYDIAVEVVERINHRYQTELGSNEVGFITMHIINAELGEPNSLKSLKIVEMTTTILSHLEKSYSNVYDKESLTYHRLMVHIKFLVKRLIYQEETPVENIGFFTETFKHSKAYCTALKIKDIIEQQFQLAIQENEIIYLAIHLARIY

SEQ ID NO: 7027 - protein, 598 aa, Enterococcus faecium
  misc_feature (B) LOCATION 1...598
  hypothetical: YES
YCRFSIIKGGISMKKTFSSLKRLARYIRPYRETFLLVILFTVLTVAFNVALPYVTGLPTTEISRNIANGESINFSYIFKCLIWITVVGIGYCISQLLSGVLMTNVVQSAMHDLRRDIEEKINRLPVSYFDKNQQGNILSRVTNDVDAVSGALQQAFIGIVNAILGITLAAAMMFYIQPMMALISMIMIPTSIWISKRVINASQKYFQSMQNSLGELNGYVQENMTGFSVLKVYGREKETLEGFKKVNHSLKYFGFRAAFISGLMMPLVQLTAYATYIGMAVLGSFYVITGAIVVGQLQAFIQYIWQISQPMGNVTQLSSVLQSASAATKRVFEILDEPEEKENKVDASLPETILGDVTFDHVDFAYDPKKPLIQDLNFEVKAGQTVAVVGPTGAGKTTLINLLMRFYDVDKGAIRIDGIDTKSMSRSDVRSLFGMVLQDAWLYQGTIADNIRFGKLDATDYEVVDAAKTANVDHFIRTMPDGYDMAINSEGDNVSLGQKQLLTIARAVVSDPKILILDEATSSVDTRLEALIQKAMDRVMEGRTSFVIAHRLSTIRDADLILVMDQGQIIEKGTHESLLAQGGFYEKLYNSQFAEEAE

SEQ ID NO: 7028 - protein, 68 aa, Enterococcus faecium
  misc_feature (B) LOCATION 1...68
  hypothetical: YES
ARRFHLMKAIQSRCNQKTNGWVKIEERFQPRATCDYDTTEKQYVEAKRMSFHFRRFLQSALLYLLCPE

SEQ ID NO: 7029 - protein, 82 aa, Enterococcus faecium
  misc_feature (B) LOCATION 1...82
  hypothetical: YES
DKCVFVLGSXFFFPETGTXGGXXINIXNWGGGEKIFVGERGGEKPPPRGGVKKKKKNPLCGAHPKSSPGYEHPAPERKILKR

SEQ ID NO: 7030 - protein, 165 aa, Enterococcus faecium
  misc_feature (B) LOCATION 1...165
  hypothetical: YES
KYSVYYIREREVMKAEIIAVGTELLLGQVVNTNATFLSEQLADLGIEVYYQTVVGDNQQRLEDLIALAETRNELILLCGGLDRPEDDLTKEATAAHLGKFFIQNTEGYKKLLAYLETTLPKNDQKQFATVPDYRRRGSSTKSYRACFRDFLSNRYTCVYPSSRSA

SEQ ID NO: 7031 - protein, 344 aa, Enterococcus faecium
  misc_feature (B) LOCATION 1...344
  hypothetical: YES
YQSVMKQLQISLRMNFFHYKKIPKEEREQITAPSLNFIQDSWRRLKKNKAAVISMVLLLVIILISVITIFVSPHDPTAQNVAYINLPPRIPGINIDGLNGKAMVGGELVDKYAQANVPSNVNFFLGTDGLGRDVLSRLFMGMRISLLIAFIAALLDVTIGVAYGLVSGLLGGRVDNVMQRFLEILSGIPNLVVMILMLVVFEPRIFSIVAAMAITNWIPMARIVRAQTMKLKDQQYVLAGLTLGESRMKIAFKHILPNISSVIIIQMMFSIPSAIFFEAFLNFIGLGLTPPSASLGTMLSEGYKTFLYLPYLLWIPAVTLSVIMIGFNLLADGLRDAFDPKMKE

SEQ ID NO: 7032 - protein, 353 aa, Enterococcus faecium
  misc_feature (B) LOCATION 1...353
  hypothetical: YES
LESVNQMKAKQWLKTVLIIIFGMLIIGFVVVPLPYYVESPGATIDLKELITVNDKEDKGSGSFSLTSVGIRQATGFLALKAKMTPFEELISEEELTGGATNEEYNQMQQYYMDSSQNAAIEQALKLADKPYKMEFKGVYVMSVEKTSNFFGKLSVGDTVTKVDGKSFQSTEAFMDYVKSQKVGQTIEISYLHNGEEKTASGDLIELPTDKKAGIGITLTDHTEIESDTDVRINSGSIGGPSAGLMFTLEIYEQVTGKNLRHGKQIAGTGTINSEGEVGRIGGIDKKVASADKAGVEIFFAPDDTISDDVKKEYPEIKTNYEEAKAAAKKLNSSMKIVPVKTVQEALDYLEKMK

SEQ ID NO: 7033 - protein, 290 aa, Enterococcus faecium
  misc_feature (B) LOCATION 1...290
  hypothetical: YES
GGSVMLYTMKELLKVAKENQFAVPAFNICSYDMMKAIIEEAERLEAPVILEIHPDEIAYLSVEFVAAVRAYAYTSKLPIVIHLDHGGTIEDVLRAIRNGYSSVMIDASLKSFDDNVQITKKVVALAHAVNVSVEAELGTIGNNGSAEGGAETIIYTDPDQAKIFVKETGIDTLAVAIGTAHGLYPKNRTPKLNIDLLKELNQQIDLPFVLHGGSGNPDAEVSEAVKYGVAKVNLSSDLKSVFFNALREILSEHPSMYEPNAIYPAANKKVQEVVKHKMEILNTVGKASLY

SEQ ID NO: 7034 - protein, 516 aa, Enterococcus faecium
  misc_feature (B) LOCATION 1...516
  hypothetical: YES
KRSVRKMQLVIAEKPSVGMALSKVLGAKSRGDGYMEGGGWLVSWCIGHLVELAPADAYDPRYSKWELSGLPDFTQNLGQFPGAAGHQKQFEVFKTVIHRGDVTALICATDAGREGELIFRLTYHLCGCTKPVKRLWISSMEEAAIQKGFDNLLDGKNYDNLYAAALCRAKADWLIGINGTRLFTTLYQGKSLNVGRVQTPTLALLAEREAAISGFQKEKFYTVELELEGFRAASERFASKTDAGRLRTGCVGKPATVQTVSQKEKTERPPKLYDLTTLQREANRLFDYTAQQTLDYLQALYEKRLATYPRTDSRYLTEDMAAGLPALCQSVAAALPFAADLSLPVNAAQVIDNSKVTDHHAILPTTEAAKTDLSALPPGETHILFLVAARLLCAVGEPHTYAETAVTLECGGAVFSAKGKTETAAGWTAMEQGFPCHTEKETEAARTLPATSCTHQGPEADRRGCIHQRGRDLPTGPFYRGHASLRNGTRQCKGVCETGRCGTQRTWHSGHPCRRD

SEQ ID NO: 7035 - protein, 373 aa, Enterococcus faecium
  misc_feature (B) LOCATION 1...373
  hypothetical: YES
KGGVKMIIKEEIFVPKELVKEKIDLLVENLTTIKDDNGEFLLDFDGLKVDDKSWTVWNWPQGVGLYGIYKNYQMTKNPRAYQVVNEWFEDRMEEGAPPKNVNTMAPLLTMAYLYEDTKDSRYLPYLEQWAEWVMNDMPRTNEDGLQHATYGPENKNQLWDDTLMMTVLPLAKIGKLLNRPEYLEEARYQFMIHIKYLMDKRTGLWYHGWTFEGNHNYAEAFWARGNCWLTIAIPEIIEILELSKEDALRKLLIETLEAQVRALKTYQSESGLWHTLLDDPSSYVESSATAGFAYGILKAVHKRYLPQEYKEVAYRAIQGLLEQIDEKGEVQNVSIGTGMGDSLDFYRNIGITAMPYGQSLTVLCLTELLVSYC

SEQ ID NO: 7036 - protein, 724 aa, Enterococcus faecium
  misc_feature (B) LOCATION 1...724
  hypothetical: YES
RLGVRMSLKNLQDVSYFKLNNEINRPVNGQIPLNKDKEALVAFFEENVKPNTMTFPSIMEKINYLIDQEYIEAEFIQLYSPSFIEKLYQFLDEQHFSFKSFMAAYKFYSQYALKTNDGSAYLETYEDRVAFNALYFANGDEELALALADEMIHQRYQPATPSFLNAGRKRRGELVSCFLTQVTDDMNSIGRSINSALQLSRIGGGVGITLSNLREAGAPIKGYEGAASGVVPVMKLFEDSFSYSNQLGQRQGAGVVYLNVFHPDIIAFLSAKKENADEKIRVKTLSLGVIVPDKFYELTRKNEDMYLFSPYSVEKEYGVPFSYVNITAEYDHLVANPNIRKQKIKARDLENEISKLQQESGYPYVINIDTANRENPIDGKIIMSNLCSEILQVQTPSVINGKQEYEVLGTDISCNLGSTNIVNLMQSPNFGQSVRTMTRALTFITDASDIDVVPPIQNGNKLNHTIGLGAMGLHTYLAKEQMEYGSEDSLDFTNIYFMLLNYWTLVESNNIARERKQVFHNFEKSAYADGTYFEKYVTGEFQPKSEKVKALFEGIFIPTAEDWNALKQAVMKDGLYHQNRLAVAPNGSISYINDTSASIHPITRMIEERQEKKIGKIYYPAPYLSNETIPYYTSAYDMDMRKVIDVYATAQQHVDQGMSLTLFMRSEIPEGIYEWKTTTKQTTRDLNILRHYAFHKGIKSIYYVRTFTDDAEEIGSNQCESCVI

SEQ ID NO: 7037 - protein, 250 aa, Enterococcus faecium
  misc_feature (B) LOCATION 1...250
  hypothetical: YES
EEGVFLAKKYTKKHEVSYYECDINQTMTFPSMLGVVIKTSEDQSDQLGRGSEFVNSFGLTWVITNYSMEINRLPRVGEVISVTTQAMEYNKFFCYRNFWIHDEDGKELVKIESVFVLMDFVNRKMSSVNEEIIAPFESEKIKKIKRQEKIEKIDSGFMLPYRVRFYDIDSNQHVNNAMYFNWIIDVLGYDFLTTHVPEKVIIRFDKEVEYGNEIESHFEQIPIENGVKTKHEIRMQEQLYCEANIIWKNK

SEQ ID NO: 7038 - protein, 329 aa, Enterococcus faecium
  misc_feature (B) LOCATION 1...329
  hypothetical: YES
LFLVINFILKRGEKMLNYLITGGAGFIGSTLANYLGKENNVVVIDDLSMGKKENLDESKHITFIEGDVADKNLMEKVMKEYHFDYIFHLAAVASVADSVERPLETHRVNFDSALLLLELVRKYQSGLKRLVFSSSAAVYGDEPTLPKKEESVIRPLTPYAIDKFAAEQYVLDYCHLYDVPTSAVRFFNVYGPNQNPNSPYSGVISILVDRYKKQLAGEKTEFTLFGDGSQSRDFVYIEDVIQALLLVAKEEKALGQQFNVGTGKSTTLLELIHSIDQILGTELALKYEAERSGDIRDSLADISKIRSLGYQPKFDILNGMERYLKTEID

SEQ ID NO: 7039 - protein, 105 aa, Enterococcus faecium
  misc_feature (B) LOCATION 1...105
  hypothetical: YES
ITLVTLMRSYFIFILSFFLFTSLVYTILINKNEVCPMMKRLYYSLIITIGYLIVSNLGNMVCGISKEFSWTTTLWESLFLFILRIFVTKCSKKINMWPLTCWHMF

SEQ ID NO: 7040 - protein, 307 aa, Enterococcus faecium
  misc_feature (B) LOCATION 1...307
  hypothetical: YES
SCLVYIFRKRSGVFMAEIVKVTHLKKSFGRFEALKDVSFTVHSGEVVGFIGPNGSGKSTTIRTLLGIIKKDGGTATIFGQDVWEDSLSIHERLSYVPGDISLWGNLTGGAIIDLFMKLHGKGSAQKKDELIQRFSLDPKKKAKNYSKGNRQKVGLIAALAVDSDLYLFDEPTSGLDPLMETIFQEEVEKLKEQGKSILLSSHILSEVERLADKVVIIREGTLDEEGTLDELRHLTRSTITIETEAENSHLAQLNGVHDFVQKSHLAQFAADNEAFDVILAEASKLGVKKFESIPPTLEDLFMRHYEG

SEQ ID NO: 7041 - protein, 304 aa, Enterococcus faecium
  misc_feature (B) LOCATION 1...304
  hypothetical: YES
LYLVVCFFKNRREKMDIRILTYFLAVAREKNISRAAKSLHITQPTLSKQLKDLEEELGVTLFTRGSREIQLTDSGRYLYSKGKEILSLVEKTANNLTNDAIISGEIYIGGGETKAISFISDSLHSLIKAHPDIQFHLYSGNADDIIDKLDSGLLDFGLVIEPTNKQKYQSFRLPAQDRWGLLIHRNHPLAKQTVIHPQELKTVPLIISRQTSVDSQLAEWLGFSIDQLSIVGTYNLLYNASLMVDNGTFGALALDGIINTYGTEKIFIPLDPPLQASLNLIWKKDQPLSPAARKFLDVLTEKYS

SEQ ID NO: 7042 - protein, 203 aa, Enterococcus faecium
  misc_feature (B) LOCATION 1...203
  hypothetical: YES
DLLVCNSIIFDVIYKREYYKTVKEMKEGLKMDEKRTIDWGSLILGILFVLVSLLSFQDPVGNLVAIVVVFAIFAFIKGIFELFVRNRLKELTGYKGKMPLIIGIIDILVGVFFLFNIGAGVAALPFVFAVWFIADSVLALFTADLARGVSEGYYWFTIIVNILGILLGIFLLFNPISSALTLSFLVGFYFMLFGITHIVYAFR

SEQ ID NO: 7043 - protein, 61 aa, Enterococcus faecium
  misc_feature (B) LOCATION 1...61
  hypothetical: YES
IVFLFPFYLEKPFQKPIKKETGTKVKQAHNFSLIVGSFEPFGLLPQPLSRMVIQRCQRLVL

SEQ ID NO: 7044 - protein, 130 aa, Enterococcus faecium
  misc_feature (B) LOCATION 1...130
  hypothetical: YES
VFLVYPRINYKNKTFVDSKEVKQMFESFDSSRNRYASVGVVSSLPDELIDSIWFIIDLDLKGVIPLENILTFDLIENRGKVTMHFSQAGSNVEMDIDLPFAYSNQFPAQVYAYDDGTRETILLPSEIRQY

SEQ ID NO: 7045 - protein, 396 aa, Enterococcus faecium
  misc_feature (B) LOCATION 1...396
  hypothetical: YES
YHLVVSTPCKLRRDDFMAKISKYKKKNGQVAWMYKGHIATDPRTGEKINTTRRGFSSKQEAQKDYDEYRHQILYGVKKKAPDMTFEDLYNEWITHQRTSVKASTIAISVRYANNQILPAFGKLKLSNISVPYCQKVVDEWHSKYESYDYMRKQTAQILRYGVAMQYIDNNPMEKTLLPRKKEYEKNRKFYSKEELNNLLDAFKDFGNMKQYAFFRLLAYTGMRKSEVLALQWKDIDTFNKELHVNKTLAVDEFGKVIIQSPKTRASRRVISLDTETLSILNNWKLQQKEEYLKLGYNTSSKEQHVFTTVKNTLYIPNTVNDWLRYILKKYNLPRITPHGFRHTHASLLLEAGESVKVVQQRLGHENSKVTLDIYAHITNNAPKKTGQDFADMMAHQ

SEQ ID NO: 7046 - protein, 241 aa, Enterococcus faecium
  misc_feature (B) LOCATION 1...241
  hypothetical: YES
KNLVTSCIESILGEIHMIEIYLFVNPLGEYCFEMEQQLLQFIEEEYGTPSKEKMQFRFLPLVNLQTIGDVMQQKGISQNNLEERNHLFSMTYSAALDCKAAQFQGKKKGRRFLIKLQEAVGCNDIPYSQELAESIFEEIGGDLNMFKEDRQSDFVKEVFFSDQKIAREMGITKHPSAVVYNYACDRDFGVLVEVKGTSSLWRITELCKTTDNSYQVFNGEHLHTNDSQFHSRTSHLHLLSN

SEQ ID NO: 7047 - protein, 62 aa, Enterococcus faecium
  misc_feature (B) LOCATION 1...62
  hypothetical: YES
TDLVVETDKNPPVVVLSFYFYFLQSSMTGCKYYGTSYGVVIFLSTIFPIHVFIKKHIVFLYD

SEQ ID NO: 7048 - protein, 373 aa, Enterococcus faecium
  misc_feature (B) LOCATION 1...373
  hypothetical: YES
YILVRKKGGNLLFEKLRQSKLMFWSLELLIIAALIMISSEINFIFEPIGTFFSTLFAPVLIAGFLYYLLNPIVKLLMKAKIKRIWAVAIVLLLLVAAIIWILLSVIPSLVQQISSLASNMPDFIKQVESWLKEVAELPLFKEVDINKYFEQLDISYGTIIQQFLSGVSNSLGSIVGTIASATVVIITAPFILFYMLKDGEKLVPNIQQFFPEKRRNQIVELLGQLNKTLANYISGQAIECLFVGTFTFLGYMVIGVDYAFLFGVIAGLTNLIPYLGPYLGLAPAFLVTVFNDPVKALLCCVVVLIVQQLDGNIIYPNVIGKSLKIHPLTIIIVLLVAGNIAGLLGIFLRCSFLRNLQDDHFLYNQNRQRRQAK

SEQ ID NO: 7049 - protein, 61 aa, Enterococcus faecium
  misc_feature (B) LOCATION 1...61
  hypothetical: YES
YTLVTQPIKEMTIAIPNEARNSINFLPFWSANFPHQGEISVVTKKVDEKANPLQKFNGDVL

SEQ ID NO: 7050 - protein, 333 aa, Enterococcus faecium
  misc_feature (B) LOCATION 1...333
  hypothetical: YES
FKLVCNSKIYMEGTVLRIEQGSLHDGAGLRTVVYLKGCPLRCAWCSIPESQSKQIEKGFGQTMTAEEVMDEIEKDAVFYFHSDGGVTIIGGEALVQADFAKEILQKSKYIGINTVLETSFCGAYNEIQKVAPYVDTLFVDVKMFTSKLHKQWTGLDNQQILKNIRRFLIEYPNCEVRIRVPVVPGINMNLTELLTIACFVADLDRFVPLELLPYHCYGMHGYQALGLEYPLADTPAPSPKEMFALADQLARTVPHLLVTALTKTFIYLLNPSFILWINERHSLAAASSRIELLLKSVSVFLRCFFEVNLSNEHWLNRYIFTVCRLSCDRCYDF

SEQ ID NO: 7051 - protein, 81 aa, Enterococcus faecium
  misc_feature (B) LOCATION 1...81
  hypothetical: YES
KQSLTFRKADHRICLFKRFFCRISKLKNKKVFDFIYILKDEWQKLEKEKTALIYEEIEMIHKIENIRTIPNYIEAKIFFHH

SEQ ID NO: 7052 - protein, 479 aa, Enterococcus faecium
  misc_feature (B) LOCATION 1...479
  hypothetical: YES
MNIVENEICIRTLIDDDFPLMLKWLTDERVLEFYGGRDKKYTLESLKKHYTEPWEDEVFRVIIEYNNVPIGYGQIYKMYDELYTDYHYPKTDEIVYGMDQFIGEPNYWSKGIGTRYIKLIFEFLKKERNANAVILDPHKNNPRAIRAYQKSGFRIIEDLPEHELHEGKKEDCYLMEYRYDDNATNVKAMKYLIEHYFDNFKVDSIEIIGSGYDSVAYLVNNEYIFKTKFSTNKKKGYAKEKAIYNFLNTNLETNVKIPNIEYSYISDELSILGYKEIKGTFLTPEIYSTMSEEEQNLLKRDIASFLRQMHGLDYTDISECTIDNKQNVLEEYILLRETIYNDLTDIEKDYIESFMERLNATTVFEGKKCLCHNDFSCNHLLLDGNNRLTGIIDFGDSGIIDEYCDFIYLLEDSEEEIGTNFGEDILRMYGNIDIEKAKEYQDIVEEYYPIETIVYGIKNIKQEFIENGRKEIYKRTYKD

SEQ ID NO: 7053 - protein, 597 aa, Enterococcus faecium
  misc_feature (B) LOCATION 1...597
  hypothetical: YES
KKIVRRRECIMSTVLHVLDAINSPADVKKLSVEEMKQLAEEMRQKILQKDSDVGGHVGPNLGVVELTIAFHYVFDSPKDKIVWDVSHQSYGHKLLTGRKNGFEKGHYREVSGYSNQHESKHDYFTVGHTSTSISLATGLAKARDLKKESGNVVAFIGDGSLSGGLAFEGLNNGGVLQSNLIVLVNDNEMSIDENHGSLYKNLAELRQTNGKSSNNLFKAMGFDYRYVDNGNDLETVIRLFEEVKDIDHPIVLHVHTEKGRGYQPAIDNKMKYHWHVPFDLSTGEAKQVTSGETFNMIIMDYLDKKMQTSTAPIAAVNAAIPGAFGLKTFQEKHPDHYFDVGIAEQHSITFASALASQGVRPVVFQSSTFLQRAYDQLSHDLAINENPVIILVGGGTISASDRTHQGTFDIPYLSSIPNIKYLAPATKEDMISMLDWAFEQTAQPVAIRIPTHGVEHGTAIANDYSIPAYQTVNNGGKVAILALGGFLELGKETVKAFRKKGIEATLINPGTITENDVETLDKLKETHELVITLEDGSLSGGFGENISRYYGDSSMNVLNFGAEKEFTDSVPVGQLYERYHLTPKQIVEDSLRVLNIQ

SEQ ID NO: 7054 - protein, 86 aa, Enterococcus faecium
  misc_feature (B) LOCATION 1...86
  hypothetical: YES
LSVVILCLPDYYMSHLSVNDFSSHAPSSMSASKPNVQAFYHLDWSFFGSILPRLLCVQEIDVADQRIEKNNSVMHRKKYYEKVHIH

SEQ ID NO: 7055 - protein, 450 aa, Enterococcus faecium
  misc_feature (B) LOCATION 1...450
  hypothetical: YES
MKVVVIGCTHAGTAAVKSILKNHPEAEVTVYERNDNISFLSCGIALYVGGVVKDPAGLFYSNPEELSSLGATVKMEHDVTDVDTENKTVTAKDLKTGETETVSYDKLVMTTGSWPIIPPISGIDAKNVLLCKNYNQANEIIAQAKEAKRVVIVGGGYIGIELVEAFVESGKQVTLIDGLDRILNKYLDKPFTDILEKELTDRGVTLALGENVTEFITDEEGKVKQVATPTDTFDTDMVILCVGFRPNTKLIEGKVDTLPNGAIKVNEYMQTSNPDIFAAGDSAVVNYNPSGTQNYIPLATNAVRQGLLVGNNLTDHKMAYRGTQGTSGLYLFGWTIGSTGVTKESATLNDLEVQATVFEDNYRPEFMPTTEKVMMELVYEKGTNRIVGAQFMSKYDITQSANTMSLAVQNKMTVEDLALSDFFFQPHFDRPWNYLNLLAQAALGEIETAQ

SEQ ID NO: 7056 - protein, 431 aa, Enterococcus faecium
  misc_feature (B) LOCATION 1...431
  hypothetical: YES
RGVVRKVIKNAIAYITRKKNRTLIIFIILTIVLSCLYSCLTIMKSSNEIEKALYESSNSSISITKKDGKYFNVNQFKDIEKLKEIEEKIIQYDGLAKLKDAKVVSGEQRINREDLSDEFKNVVSLEATNNTKRNILFSSGVFTIKEGKNIEENDKNSIIVHEEFAKQNNLKLGDEVDLELLDIEKSGKIKSHKFKIIGIFSGKKQETYTGLSSDFSENMVFVDYSTSQEILNNSENNEIANKILMYSGSAESTDLALNKLKELKIDESKYFVEKDSNAFEESLESVSGIKYIIKVMTYSIMLGGMVVLSLILILWLRERIYEIGIFLSIGTSKIQIIMQFIFELIFISIPSIISSLFLGNVLLKVIVDGFINSEDSMISGGSLINNSSFMSNITTLGQSYLILISIIVLSVVFASSLMLIKKPKEILSKIS

SEQ ID NO: 7057 - protein, 414 aa, Enterococcus faecium
  misc_feature (B) LOCATION 1...414
  hypothetical: YES
DISVFGGIKTMINVIGLGYIGLPTALMLAANGNEVVGTDYNQKLLHKLQEGQLTFEEKGLEELFDKALTRGIKFENEYSSTDFYIITVPTPYDKVDKKIDPSYVIAATKRVLEVCKKGTILVIESTISPGTIDRFIRPLVKEAGLSLGEDVHLVHAPERILPGQMIKELQFNSRTIGADEPEIAEKVKEIYSTFCEGEIVCTDIRTAEMTKVVENTFRAINIAYANELTKIARHDGLDVHEIIRIANMHPRVNILSPGPGVGGHCIPVDPWFLVGDYPRLTQLISTALEINESMPELVLERLVAIMKENNITDRNKIGIYGMTYKQDVDDIRESPTVQLFEKMKSSFAEPFRVFDPMIKEKIMDNQVMDFDKFLNDSEIIVLMVEHTHLKENLSMLQNKLILDTHNLVANAYKL

SEQ ID NO: 7058 - protein, 63 aa, Enterococcus faecium
  misc_feature (B) LOCATION 1...63
  hypothetical: YES
NVGLFFVWLNLLPQMQAFDHRLFGIWDCDKAFVTALFYIKIIIVLTVLAERRRKKWKFYQQWI

SEQ ID NO: 7059 - protein, 360 aa, Enterococcus faecium
  misc_feature (B) LOCATION 1...360
  hypothetical: YES
RCSVGVYYXNFDVKEGEIVVLVGLSGSGKSTLIRLLNRLIEPTSGSIYIDGEDVSKLSKEELREVRRHKINMVFQNFGLFPHRTILENTEYGLEVRGVPKEERQEKAEKALENSSLLSFKDQYPSQLSGGMQQRVGLARALANDPEILLMDEAFSALDPLIRREMQDELLDLQANVQKTIIFITHDLNEALRIGDRIALMKDGEIMQIGTGEEILTNPANDYVREFVEEVDRSKVLTAQNIMVPALTTNIESDGPNVALTRMRNEEVSMLMAVDRKRHLKGIITADQALEARKQKRPLIDFLDENVTVIGKDMVVSDIFNIIYDSPTPLAVVEDGKLKGVVIRGSVIEALAETSEVSEHE

SEQ ID NO: 7060 - protein, 332 aa, Enterococcus faecium
  misc_feature (B) LOCATION 1...332
  hypothetical: YES
VLSVTSLNKTLFVLKGVKIRMIEFEKPRIAKIDEEKDYGKFIVEPLERGYGTTLGNSLRRILLSSLPGAAITNIQIDGVLHEFSTIKGVREDVTQIILNIKGLALKMYGQEEKTLEIDITGPATVTAGDIIVDSDVEILNKDMYICSVSEGATFHARLTVKPGRGYVQADENKKEDMPIGVLPVDSIYTPVRRVNYQVENTRVGHREDFDKLTMEIWTDGSIEPLEAMSLSAKIMTEHLDIFVNLTDEAKNAEIMVEKEETQKEKMLEMTIEELDLSVRSYNCLKRAGINTVQELTNKSEPEMIKVRNLGRKSLEEVKAKLHDLGLGLRKED

SEQ ID NO: 7061 - protein, 102 aa, Enterococcus faecium
  misc_feature (B) LOCATION 1...102
  hypothetical: YES
KKSVERTSRWAERGLKAHANPDRQGLFGIIQGAGFEDLRRQSAKDLVGMDFPGYSIGGLSVGEPKSEMNRVLEFTTPLIPENKPRYLMGVGAADSLIDGVIR

SEQ ID NO: 7062 - protein, 492 aa, Enterococcus faecium
  misc_feature (B) LOCATION 1...492
  hypothetical: YES
ERSVLGCLAHLLSIWEVSSIQGFMNRAMKQLMVTGLDKMSPPYVKELELGVIRYPGGNFTSGYDWVDTVGRKEQRPKKIDLAWRGIEPNSFGLHEFFKWISHVQAKPIFTVNLGTKGIDEAKNLVEYCNFPKGTFWSDLRIKNGQKKPFGVKLWCLGNELDGPWQVGAKSAYEYGRLANEASKVMKLVDDSIETILVGSSTPRLPSYPEWDRIALEEAYENVDYLALHNYIDKYDEEDLTKPPKNERDDTATYLAKAYRFDRQIEEIVATCDYVKGYLRSEKTMYLAFDEWNVHAQPEKRHRDFEVGSPIDWCYFTMEDTLLFGSLGLAILRHADRVKISCQSLLVNTIPLILTDAKGQAWRNPTYYVMQHLSKYAKGQVLKQQIICPVYDCEKIKNVPYVDSVIVDNGNQLTIFLINRTNEQQKITIEHDFNLVDQGEHYTLTSSDLLDKNTREEPEKIKPEINYFSIEKHDELNVGIEKYSWNVIRIKKM

SEQ ID NO: 7063 - protein, 144 aa, Enterococcus faecium
  misc_feature (B) LOCATION 1...144
  hypothetical: YES
SAGFAAILNPIKVNMDEAVSDRVFTASAIMETVPEKSPIIRLETNKIRFVTNHKIPVSTPFIVRCCGICIFFSSCFLAKFFTPSSLLVAQVNRWRGRLFSSPLFLSLSIVRPISIKRWSLLVRSHGVVAIXSRARYYISMSRXR

SEQ ID NO: 7064 - protein, 509 aa, Enterococcus faecium
  misc_feature (B) LOCATION 1...509
  hypothetical: YES
RRSVMEATMLISSVKRVGKVDPRLYSSFIEHMGRAVYEGIYQPDHPSANKSGFRQDVIHLVKELNIPMIRYPGGNFVSGFRWEDSIGPIANRPRRLDLAWRTIETNEVGIHEFYNWCQHVGAEINMAVNLGTRGVDAARNLVEYCNFPKGTYWSDLRRSNGQESPFGIKTWCLGNEMDGPWQIGHKTAEEYGRLAEETAKAMKLVDDSIEVVLCGSSNRQMPTFGDWELTVLDQAYDQIDYLSLHQYYGNQKNDLSHYLARSLDMDRFISEVTAMCDTVKAKKHSKKQINLSFDEWNIWYHSAEQDEQAAPWQIPPPLLEDNYNFEDALLLGCLLITLLKHADRVKIACLAQLVNVIAPIRTETNGEAWRQTIYYPFMQAAVYGQGEVLSPQIRSANYATEDFEEVPYLESIAVINDKELVIFAVNRGEEEMNLTVHLSELSLEGVIDFSEMSGFDTKATNLPKSEQVKPSHSTNVKAEDGKINCLLKPLSWNVVRCRLSDEGGTKNER

SEQ ID NO: 7065 - protein, 796 aa, Enterococcus faecium
  misc_feature (B) LOCATION 1...796
  hypothetical: YES
NYGFLRGCCYGEERKRRMNMLLQNKFSFFRSFFFTSLFVLSIFIFSPSAEAVGATPPAISYDPYTYENIVPPNGGRSAVNGGKLVQLTGANQLPKLTATYLNDGSNDPWKGGTVRFHWESHVKLTNVLDLVNITAQGFAFVAIINLPEHVSSSDVLKAIDWNNAYLYIAGAPIKVTSGSLLSAGSHTLRFGMGSWDTNTLLADIIAIITRGEFNVDDIPLQFDVTANVAKMTENGDKYDTSPNKILTKGKLQPSMSKKAVFSVDFYDSNNIIQDRMFNSILAPAAGRFYPKLTGGNLNPGAYAFSASAEINTWNSYISTSDSTGKYNTFADTTEYVDGNNQNLPGSTNSRTLTMGLTEGRFDQLPFSRFDRVVNYFTGKNVTQGAILTHTPASTSGLNQTANIVYSGKDAQGGLLSPVALKVLEQYKLDGTVLPTNLTADSQWGKLLSSASYQVTANWSATELKKGSIHYRLYSKGTQKLATGWTDQLFQTIQSNNGGVNTATSTLPALASGQYYFDYRLVDDVLTNMYPSFAYKWQSEQAGITTLPQITVANFPSVSADSQLKNLSRQPETGDPLSALSGDTIQENVTFTLTKSGDAITDKKITISLPENTTYINGSLKLNGTTIADTGIQQGVSVPADLLSKIGDTIHLTYNYQLNTVDTSVQSVSILTKAAVLSSNITLADGAKLPNPVVQTSAKTILVPKQELTLVNVPDDFTFGNDLPKPLKTSYYEAKGDFSFDVRDTRLPSTSPLATDRDIDFFILALNQGQELRRNKIILQSFWIKTIDSARSKHVDL

SEQ ID NO: 7066 - protein, 116 aa, Enterococcus faecium
  misc_feature (B) LOCATION 1...116
  hypothetical: YES
PSPVEPDTIATPALVPILVAPASIIAIASSSLWIPPEALTPISGPTVSRIKRTSSTFAPPVEKPVDVLTKSAPAAFAISQARMISSLSNNDVSIITLTSARSFAASTTASISFWTC

SEQ ID NO: 7067 - protein, 65 aa, Enterococcus faecium
  misc_feature (B) LOCATION 1...65
  hypothetical: YES
SRPVNTVTPMEFVNRIPRKINPKTANAKKLIPLSHNVPFLSASTKDAALIMIQINNTVYEREPAR

SEQ ID NO: 7068 - protein, 112 aa, Enterococcus faecium
  misc_feature (B) LOCATION 1...112
  hypothetical: YES
LIAVKKELIATPAKISCKGFMPIFENCKKPNTSKVTAKEPANDTRNTENPEALGQKAKLRAIANEAPALIPSKPESANGFLVTPCINAPLNAKQLPTRNAPATRGKRMFLMI

SEQ ID NO: 7069 - protein, 160 aa, Enterococcus faecium
  misc_feature (B) LOCATION 1...160
  hypothetical: YES
SSAVGVSSTSTCSSLERKFFARFAALTTKNKTKPVIRNVMIALITLPNANVTPFVGDQSRIESAPSKSEVPVIIATNQPISGVIKPCTTWFTMLVNALPITTPTARSKTSPRMMNSLNSLIMNDPPFFYLSLVYRKIKNKKTIYAFSRLFLLIKNIYAIL

SEQ ID NO: 7070 - protein, 350 aa, Enterococcus faecium
  misc_feature (B) LOCATION 1...350
  hypothetical: YES
IYAVIFYILQTHSMYSNSLSVIIKETGNRRKIMIKYFTLDNEKLRNTGKETDQTIWYCVERPNQEEIHQLTHQFEIPSDYITSILDDAENSRTEEFNQSKLTKPALLLLQYPFAKTSPSGYFQVDTYPLSIILTPKKKLITITNHEPLFLKKVFSQTFPKSDISPNLNIFFQFIWQVTLSYNSYLATLQSQCDTLEAKLQVSTENKQLYQIMDIQKSLVYFREATSANLDALKELAQNKLFQENHALKNHLRDVLVETEQAMTTSRIQLKLVEQMNQTFSAIVSNNLNNIMKILTSLTIILTIPTIVGSIYGMNIKLPIAERDDAFIWLVLLTLFICIVTTYYLKKGKFL

SEQ ID NO: 7071 - protein, 103 aa, Enterococcus faecium
  misc_feature (B) LOCATION 1...103
  hypothetical: YES
ANAVGKKKLMVFCKLSKIRRPSFTAFAIVWKLSSPKTISAACLLTSLPLIPIAIPTSDLFKAGASFTPSPVIPTISPFFCKALTIRSLCSGVVRAKTSTIGTC

SEQ ID NO: 7072 - protein, 103 aa, Enterococcus faecium
  misc_feature (B) LOCATION 1...103
  hypothetical: YES
RSGLKCKDNPNAKTIPNGNEPIKVNKNNFNVVSAPTNNCGITSIKYSIFFSSFKIKKSSWQMPRGRIIRGSTSVYFFLAEKTSHSRCRSDENKKSFDPKIKGR

SEQ ID NO: 7073 - protein, 79 aa, Enterococcus faecium
  misc_feature (B) LOCATION 1...79
  hypothetical: YES
NQAVGQLLDRQAVRIAQVVKAVQKTRAVKAVQRVRAVKVAQKTRAAKAVRRVRVVKVAQEARAAKAVRRVRVVKVAQEA

SEQ ID NO: 7074 - protein, 127 aa, Enterococcus faecium
  misc_feature (B) LOCATION 1...127
  hypothetical: YES
SMAVKKQCNHAGCKTLIDYRQKYCGKHKAKQTAIKREERKQSEGKYFQFYQSRTWRKASYLYRLNHPVCEDCLEEGLIRKADVVDHKIELKDDWNRRLDETNFRSLCHAHHNSKTANERQRREKSTL

SEQ ID NO: 7075 - protein, 88 aa, Enterococcus faecium
  misc_feature (B) LOCATION 1...88
  hypothetical: YES
KIGLKEQNMTEQQIVKKNERYTVEIVDLSYEGMGVAKIDGYPLFIENALPGEEVEILVVKAGNKFGYGKVETFITQSPDRHPVGPDPY

SEQ ID NO: 7076 - protein, 301 aa, Enterococcus faecium
  misc_feature (B) LOCATION 1...301
  hypothetical: YES
IFQVNPWFFFRVCYNKVKSTFTVNGGGQMNRFASKEEEKLYYEHKASEEEFLNWYQKQERPEYDKPSLTVDIVLMCYNKEEDQLKVLLIQRKGHPYRNSWALPGGFVQKDESTGESVLRETKEETGVVISKENIEQLHTFSTPNRDPRGWVVTVSYLAFIGEEPLIAGDDAKEVRWFTLERHSNKIHLSSGEVAISLDLVTGESSGKDTLAFDHSQIILKAFNRVVNKMEHEPQVLQVLGKDFTITEARKVFAKFLGIDYKTIDHSNFKKAMLQYFDEIGERPVGIGRPSKIYQLKPGHHE

SEQ ID NO: 7077 - protein, 498 aa, Enterococcus faecium
  misc_feature (B) LOCATION 1...498
  hypothetical: YES
LLQVDIDKENIVIINSAQLDQLIDLRDRSELHDILDMMIDQFSDDPFAVKLVIFYDKILFHMQAPIKKICVHFETKQWRNKMVATVTLYLTFTLILDLGIYLFFSKQLLVKNSFGCIALMVVTLLLPIPKVSFPYLVGLLLMFLFYFTTKNLFISCLISNLFFAITGLSFFLVFDLMDYLGKRHLGTASFFALLIAFIFYLLVKSIDKQTRFLNLLFTYPTEHYFGGICILLSWGVIYLVLGSVHFRSSNYLLLSLLSIVISFFSLFFSIMLISFQVKERQHQESLQLYQINEEYYHHLEEFKHDYKSLLFSLKITLQENKKETLEFLEILEDHSAAIFEKPQIQQLTNIVSPAVRGVFLKFLEKAESEKIPIQVVIPVEVKTIPIDLVVFIRCLSIFISNAFDHRVADQSPITINLLEEKEGSRFSIANKANPTNLTLSEMVKRGKTSKKNGGLGLYSAKKMLDVYENAELKIEFSKQNHYFFVEMYLASRKSKSAY

SEQ ID NO: 7078 - protein, 306 aa, Enterococcus faecium
  misc_feature (B) LOCATION 1...306
  hypothetical: YES
RNQVFISKIEFGGQIMLIEEKLTKQELFTTTEKRIVDYIRRNIEAAVYMTIEELAKATYTSHSAIIRLCKKMGFSGFKEFRFELGREVHQLIAQFNQTIDPNFPFSSEDSTQQIAKKMADLSIQSIKKAQLQIEHEDLDQIGKVLNKAQRIFLFAKGDSQITARKFQNKMVKLNKFLIMAEEYSDSSWNAANLTSEDCAIFISYSGRIHHYERIMTYLKHVEAPTLLITGNQHSEMAKQADMCLVISQEEYDFAKVATFSSQIAFDYVLNTLFSVIYSQNFEENIRNLKNKQELMQKGLLKEYRKT

SEQ ID NO: 7079 - protein, 431 aa, Enterococcus faecium
  misc_feature (B) LOCATION 1...431
  hypothetical: YES
IIQVIFYRRLLKMKEVPVVDIKITDLKKLYQKGYNMLEELRHEADAPVVKAKIFNKEAITIYGSSAAKVFYDPRNFKRKGAMPKLVLKTLFGQGGVQTLDGAAHHHRKNIFMDLMTPERMEDYHRILDKNLTQALEAQHGQFELFDLSKMVFFTSICEWAGINLSAISKDEVEKLAEYQISMISGTFTSPIDHIKGVENRKKSEKWAQGLIEEARQNPVAGKENVALYAFANATDLDGQLLPLEVAAVELLNIIRPTVALTVWAALMGHALFSRPDLYQQLKNDFSTLQDPFIQEMRRYYPFFPMLPAISLKEVEVDGYRIPEGSWVILDLYGTDHDERTVEAPDSFMIKRYVGKAKDISYKEEYEMIAQGGGNFRQMHRCAGEWITLHSLRVFSDQLVNKFEFSVPEQDWTIPFNQFPTYPNSRALLYKN

SEQ ID NO: 7080 - protein, 90 aa, Enterococcus faecium
  misc_feature (B) LOCATION 1...90
  hypothetical: YES
HNKVSPTNSSMYFIVHLRIIFNNPFFILIPYINYIKIFFCKFFTSNTISTMIIIIFLRSINMDFITLIDNFQYYCCVFSNFSFWISHILK

SEQ ID NO: 7081 - protein, 147 aa, Enterococcus faecium
  misc_feature (B) LOCATION 1...147
  hypothetical: YES
NLKVISLLDNGKGGNKMKKKQTKLSLADILTQLTATEDGVVEFERSEISVVDDRYFKMPYFFDQAKVICLCGYDGVRDYFGIRITEEKVVWVNNHTELGALAFEGTVLDNISIVFEEESFTLECDKLTRYIDPKFYEDKNLAWELAL

SEQ ID NO: 7082 - protein, 435 aa, Enterococcus faecium
  misc_feature (B) LOCATION 1...435
  hypothetical: YES
SKKVSKPARARRIIVLSLSFFVYLKIETSENFTCSWKAPWTTVIIEKNFKKEGFLMIYFDNSATTPIFPQSLDAYVKTSQRIIGNPSSLHDLGNQANRLLQQARKQIADLIHVEPEEIYFTSGGTEGDNWVLKGTMIEKREYGNHMIISGVEHPAVSETAEQLKELGIEVSIAPVDKRGFVRVDELKELIRKETVLVSVMAVNNEVGSIQPIQEISDLLDDFPKIHFHVDAVQAIGKVPFSQWLTERVDFATFSAHKFHGPRGTGFIYWKKGRRLAPLLTGGGQERNQRSGTENVPGIVAMVKALRLSLEIKEQKPEQTQRLKVALINALKTYEKVTIFSEGTDYAPHILCFALKGIRGEVLVHALEEKQIFVSTTSACSSRKHMASSTLHAMHVPNDLATSAVRISLDENNSLAEVEQFMIIFKQLYKKFSAIN

SEQ ID NO: 7083 - protein, 120 aa, Enterococcus faecium
  misc_feature (B) LOCATION 1...120
  hypothetical: YES
MEKVCQVTIVHKEKVNVIKNKLDQKDFSNLLVLGKCFSDSSRIKIFYALETYKEMCVCDLAEILTASVATTSHHLRFLKKHGMAKSRQDGKVVYYSLANEDILSAIRVFFKLSENLSMKS

SEQ ID NO: 7084 - protein, 155 aa, Enterococcus faecium
  misc_feature (B) LOCATION 1...155
  hypothetical: YES
FLKVVSNLSIQAELQKIRKEKLASCYLILGTEKFLQDQVRTEIVKKIQLEGEDDLNFLSFDMENASLDEVVAEAETLPFFGDQRLVFVENPYFLTGEKVNNGIEQNTDLLTAYLKEPLESTVLVFFAPYEKLDERKKVTKQLKKHSNYHQCPTVE

SEQ ID NO: 7085 - protein, 145 aa, Enterococcus faecium
  misc_feature (B) LOCATION 1...145
  hypothetical: YES
TMKVVQTKDTMSNIYLDAVRIRHQVFVVEQGVPLSREIDKDEAHCIHFVLYSDKKEPQGTVRLLPLENGKMKLQRMAILSEYRHQGLGKILIEEAENFAKNQGYNTILLGAQSTAETFYEKLGYTAYGDPFEDAGMPHIYMKKTL

SEQ ID NO: 7086 - protein, 266 aa, Enterococcus faecium
  misc_feature (B) LOCATION 1...266
  hypothetical: YES
LMKVKALKKKRKSSISPLKITKTEHKSFWIKLLGDVYYQKLREMNNSNIAIIKWQKQRLKKSLIFILVGFLMYLFLGKEWYYLAGGIATSVGFYVWQAKSINGIYNQFRFERHLQFSKFTRLLIPYLKQKKDGGNLYGVFAKIVKRLDYDTDKKLLMKLMQEMTDQPNDIRPFTEYAEQTSGTDMSVLFMSTVYDIRQGSADLDVIEELDRLASEELMAGIDSIIDYKSRRFVFFPTKIAMTSFILVVGFAVGVLFMNLKDINFGQ

SEQ ID NO: 7087 - protein, 341 aa, Enterococcus faecium
  misc_feature (B) LOCATION 1...341
  hypothetical: YES
MKKVAIIGAGQVAEKVHAAYYQKRSDVLELAAVVDPVSQRAEDFCRRTGFSHAYTSVTQMLNEISPDIVSVCTPNRFHFEHVLAALEANASVMCEKPPAMTADQARKMAETADKNGQILAYGFQHRFSDEATMIKNHLDVLGDIYYVEANALRRSGVPGWGTFIDKELQGGGPLIDYGIHMLDTAMYITGFPKVKSVRAYSFQKIGTKKNSGKFGKWDPSKFTVEDAIFGTLELENGKIIQLNTSFALNIREDKLNVAFCGDQAGANLYPGELFEDVDGKLVSLQKTTPVNDPHELSMAHFVNRALGDQTQMIADGWQGYVIQNLVENLYRSAETGEVITL

SEQ ID NO: 7088 - protein, 146 aa, Enterococcus faecium
  misc_feature (B) LOCATION 1...146
  hypothetical: YES
VEKVKTPVKISDSEWEIMRVIWTLGQTTAQEITQILADSMDWKPATIKTLLGRLVKKEVIWTEQEGKKFIYHPTVSEMETVRSATENLFSHICAKRIGETIADLVEEATLTQEDINEILKQLEQKQPVETIECNCIPGQCECKQHQ

SEQ ID NO: 7089 - protein, 186 aa, Enterococcus faecium
  misc_feature (B) LOCATION 1...186
  hypothetical: YES
KLEVLQRKEGSPMLNQLAIAEVGNAMLGNVIVVSGSFLILLALLKHFAWGPISDILKKREDKIANDLDSAEQSRINSAKMEQEREQQLLASRSDAADIIKNAKESGELSRQNILKDAQEEAARLKSKAQADITVERDSALNSVKDDVAELSLQIAEKILNKELSPEMHESLINQYIEGLGSSNETR

SEQ ID NO: 7090 - protein, 248 aa, Enterococcus faecium
  misc_feature (B) LOCATION 1...248
  hypothetical: YES
MSEVVKVSQLVKKLSLEIVTGDEKSLDRVIVTGDISRPGLELTGYFNYYSHNRLQLFGSKEISFAERMIPEERLIIMRRLCSEDMPAFIISRGLPAPEEMIQAANENGIAVLRSPISTSRLLGELSSYLDGRLAPRTSVHGVLVDVYGLGVLIQGDSGIGKSETALELIKRGHRLIADDRVDVYQQDELTVIGEPPKILEHLIEIRGIRIIDVMNLFGASAVRGSMQVQLPVYLEAWAKDKKYARLGS

SEQ ID NO: 7091 - protein, 144 aa, Enterococcus faecium
  misc_feature (B) LOCATION 1...144
  hypothetical: YES
EEEVEHAASLAFINNEIKELPKGYDTLVGERGVSLSGGQKQRISIARALIKNPELLILDDALSAVDAKTEEAILHNLKEIRKEKTTIIAAHRLSSVMHAKEIIVVDQGKIIERGTHHELLALGGWYEQMWEKQQLEAKIEGGEA

SEQ ID NO: 7092 - protein, 101 aa, Enterococcus faecium
  misc_feature (B) LOCATION 1...101
  hypothetical: YES
HGEVFSWSCRLLNYKNKKQTISEEYIIMVFEKIQEIIAEELGKETEEIKLTTDIQEDLEADSLDLFQIINEIEDEFDVKIETEDGIKTVQDLVTYVEKQTA

SEQ ID NO: 7093 - protein, 362 aa, Enterococcus faecium
  misc_feature (B) LOCATION 1...362
  hypothetical: YES
NERVKTMTKILEVKDLEISFDTYAGKVRAIRGVNFHLNKGETLAIVGESGSGKSVTTRSIMRLLSSNANIDAGQILFKGNDIVGKSEREMQKIRGKEIAMIFQDPMTSLDPTMPIGKQVAESLRKHNKVSKKEGQKAALELLKLVGIPEAEKRINSYPHQFSGGQRQRIVIAIALVCYPEILIADEPTTALDVTIQAQILELLKEIQTKIDTSIIFITHDLGVVANVADRVAVMYGGRIVEVGTSEEIFYNPQHPYTWGLLGSMPTLDSANDRLYAIPGSPPDLLNPPKGDAFYPRNEFAMKIDAEQEPPFFELSKTHKAATWLLAPQAPKVTPPEEIQRRWAIFKEKQKHTYGQGGIADAK

SEQ ID NO: 7094 - protein, 61 aa, Enterococcus faecium
  misc_feature (B) LOCATION 1...61
  hypothetical: YES
KERVPMPIAIGNKRLPVTLDEKRQKELQQLKQKYGKSESRIMCIALDLLIAKKKQDLRYQH

SEQ ID NO: 7095 - protein, 64 aa, Enterococcus faecium
  misc_feature (B) LOCATION 1...64
  hypothetical: YES
KERVLMPIAIGNKRLPVTLDEKRQKELQQLKQKYGKSESRIMCIALDLLIAQEKAGFEVPALKK

SEQ ID NO: 7096 - protein, 147 aa, Enterococcus faecium
  misc_feature (B) LOCATION 1...147
  hypothetical: YES
IVGVMVCMYLKLKEMLSEYNLKLIYMEMEEPGFYYPKPRIVFLNEKLHEDSSEAFHLAHELGHFIASHFEYSVLYDNSTTFHSKFETEADKIAIMILLNIFIENELTDETQFKLENFMKFYSINNKLRTECFNVCQSYFKKKYSYAQ

SEQ ID NO: 7097 - protein, 150 aa, Enterococcus faecium
  misc_feature (B) LOCATION 1...150
  hypothetical: YES
IVGVMVCMYLKLKEMLSEYNLKVVYMEMKEPGFYYPKPRIIFLNENLYGETAEAFHLSHELAHFSASHFEFSVLYDTSTTFHSKFETEADKIAILILLNIYIENELTDESQFNLEKFMEYYSIQNKLRYTCYAVCQCYFKKKYSYARQYV

SEQ ID NO: 7098 - protein, 447 aa, Enterococcus faecium
  misc_feature (B) LOCATION 1...447
  hypothetical: YES
KNGVLFMMDYSKEPVNDYFLIDMKSFYASVECIERNLDPLTTELVVMSRADNTGSGLILASSPEAKKRYGITNVSRPRDLPQPFPKTLHVVPPRMNLYIKRNMQVNNIFRRYVADEDLLIYSIDESILKVTRSLNLFTTEGTRSQRRKKLAQMIQENIKEELGLIATVGVGDNPLLAKLALDNEAKHNEGFVAEWTYENVPEKVWNIPEMTDFWGIGSRMKKRLNQMGIMSIRDLANWNPYTIKNRLGVIGLQLYFHANGIDRTDIAIPPEPTKEKSYGNSQVLPRDYTRRNEIELVVKEMAEQVAIRIRQHNCKTGCVHLHIGTSILETRPGFSHQMKIPITDNTKELQNYCLFLFDKYYEGQEVRHVGITYSKLVYTDSLQLDLFSDPQKQIDEENLDKIIDKIRQKYGFTSIVHASSMLEGARSITRSTLVGGHAGGNGGIKND

SEQ ID NO: 7099 - protein, 215 aa, Enterococcus faecium
  misc_feature (B) LOCATION 1...215
  hypothetical: YES
KKGVLMKNTKNFTLTAMFLAILILLAVTPLGFIPIGPINATTMHIPVIIASIVLGPRLGAFLGGTFGLISMIRSTVIQTPLSFVFSPFIPVIGTEHGSWKALLIAFIPRILIGVVPYFVYKGLRKLMKQKADSVSLFLAGLSGSLTNTILVMNMIYFLFQQDYAKVIGTNLNAVYSAILAVIFTSGIPEGIVAGLATAAVCNVLLRYFKHPSLTN

SEQ ID NO: 7100 - protein, 151 aa, Enterococcus faecium
  misc_feature (B) LOCATION 1...151
  hypothetical: YES
EKGVEFMNLTRDLIFLVLYLIGVFSIVYWRKQKKDPSLFFYSSTWTFAVILTYFVVLEIFYSTFYFFIPLVFFSIFAFSYFSEKRRLLNGLLFNVFLISFGIYLFVSLYETQNIFTGRTDCLNHDPVTACLSIRHLWIDRFSFLERCHSFT

SEQ ID NO: 7101 - protein, 186 aa, Enterococcus faecium
  misc_feature (B) LOCATION 1...186
  hypothetical: YES
MKGVLQMIDPKMLGMIFLINFAYITLNTLRFMLTMKGYRLIAPLVSMVEITIYIVGLSLVLDRLDNPLNLFVYALGYAVGISVGILIEDKLALGYIMVTTILPANSAEDKSLPGILREHGYGVTQTSAMGLEGERLVLEILSPRKSERELYRLIKEIEERAFIISYEPKYISGGFWTKKVRKRQGK

SEQ ID NO: 7102 - protein, 118 aa, Enterococcus faecium
  misc_feature (B) LOCATION 1...118
  hypothetical: YES
MKGVMNDFYWSFFEKRTMIEKISKKILASPKLIIWMSMIVLIFCIASGFLLSNLLFYRETEETAAKEILSSFSSSGEDPSAEGNDVEVDARPKVMYTDIKGSVKGAWYLFLFFRKTGL

SEQ ID NO: 7103 - protein, 204 aa, Enterococcus faecium
  misc_feature (B) LOCATION 1...204
  hypothetical: YES
TEGVMNMQYPEPIAKLIDSYMKLPGIGQKTATRLAFYTIDMKDEVVNEFAKSLLSVKRDLHFCSICGNITEEDPCEICRNPSRDRSVILVVEEPKDVMAMEKMREYHGLYHVLHGVLSPMEGTGPEDINISSLLQRLHDADVKEVIIATNATTEGEATAMYLSRLIKPAGIKVTRLAHGLSVGSDIEYADEVTLLKAVEGRREL

SEQ ID NO: 7104 - protein, 332 aa, Enterococcus faecium
  misc_feature (B) LOCATION 1...332
  hypothetical: YES
SEGVEIIMAQKTMIQAITDALALELENDENVVVFGEDVGKNGGVFRATEGLQEKFGEDRVFDTPLAESGIAGLSFGLALEGFRPVPEIQFFGFIFEAMDEVVAQMARTRYRMSGTRNLPITIRSPFGGGVHTPELHSDNLEGLIAQSPGIRVVIPSNPYDAKGLLISSIRSNDPVVFLEHMKLYRSFREEVPDEAYEVPLDKAAVTREGTDVSIITYGAMVREAIKAADNLAKENISVEIIDLRTVAPLDVETIIQSVEKTGRVVVVQEAQRQAGVAAQVVSEISERAILSLEAPIGRVSAPDTVFPFGQAENVWLPNAKDIEDKVKEIAEF

SEQ ID NO: 7105 - protein, 191 aa, Enterococcus faecium
  misc_feature (B) LOCATION 1...191
  hypothetical: YES
EEGVSVMINDERKKAVTQQLAALVEEALIAEVTLSPKPGLVDALDAGAHSDMDYALFLKSAKTLTPFFEEMAQIAWHHAIDQELRERIAEIGRKAEKAMLIATNGINTHKGAIWAMGLLISVIAQKISMEQPFYLSKILDDVSKLVAFPDTKYRHKKTTHGHRVKQKYGVHGAYEEAILGYPHIRVAIQAA

SEQ ID NO: 7106 - protein, 93 aa, Enterococcus faecium
  misc_feature (B) LOCATION 1...93
  hypothetical: YES
LLGVDTLSQSFFRINGVLLPTPRSQVTIFNKHEKLFFEIAPCDSELNGRLTTSWYKRCSKACIYANESNQVKNEELFWLSLLLDAGQFFHNLF

SEQ ID NO: 7107 - protein, 121 aa, Enterococcus faecium
  misc_feature (B) LOCATION 1...121
  hypothetical: YES
RGGVGMEITMSKNAVETLIEKVGENTKIALALINDSDPFLRDKGAFAKGSFFQIIPFVSEFGEYATKIEHPLLDIYTSKLEQNYFGKRLNMDFNKQLDSFSLENEIAVLDYNIKLKNCFFS

SEQ ID NO: 7108 - protein, 115 aa, Enterococcus faecium
  misc_feature (B) LOCATION 1...115
  hypothetical: YES
NFLVTQAQTIHWVQAFRQMKHPXIGVMLGYMIPFIHSFRFNFAADAMKXPLQQIIXSIVXGVILSSVXYACGGEALFHGYNKTAVTLVASVTVLVGLVVFIYKDRKKKQGKQKHK

SEQ ID NO: 7109 - protein, 92 aa, Enterococcus faecium
  misc_feature (B) LOCATION 1...92
  hypothetical: YES
SLLVKNMGVDHLIVLSKLLFWIPFIIMTSAFFYLFKRPNKYLLLSACPMIYFIHKIRGFYYYDSGISLFCYEIGLLASAIFFIFVLEYFRKK

SEQ ID NO: 7110 - protein, 170 aa, Enterococcus faecium
  misc_feature (B) LOCATION 1...170
  hypothetical: YES
ANLVVYLSLIAASPGNSLPSSNSKLAPPPVEMCVNLSANPNCSAAAAESPPPMIVVAPSKLAIASQTPIVPLAKLLISNTPIGPFQTTVFAPCNVSANNFTDAGPMSKAIKPSGMSPSITCVSTSFENSGAQTLSIGKTSLSPAFSINSFASSTLSASTRELPILIPFAS

SEQ ID NO: 7111 - protein, 106 aa, Enterococcus faecium
  misc_feature (B) LOCATION 1...106
  hypothetical: YES
MRLVCENIHRYEQELVAYVLPKLQAIGGITIYGPQDPEHHTGVVAFNLDGIHPRDVATALDMEGVAVRSRHHCAQRFIDDFCLTNWSFKQSMIMPFERLQCRGIFE

SEQ ID NO: 7112 - protein, 114 aa, Enterococcus faecium
  misc_feature (B) LOCATION 1...114
  hypothetical: YES
KKLVILMAEDNRSQAAVSRLLGNKNKKNFKSKEVEEIELTKKNISKVIKDQGSSVRTADSIRINPILMSALKYWTTIAESDKSKPDVIEDALLKSIPEEYLIEGYKLAKKQNKI

SEQ ID NO: 7113 - protein, 336 aa, Enterococcus faecium
  misc_feature (B) LOCATION 1...336
  hypothetical: YES
DILVLSADVTIAYMLLKHRFDYSVKNNWVDSDDNIFFIFTVEELMKLLQCREGKVSKIKKELEKAGLLKQKRGRVNKRDGKIESMPNLLYLGKPEVTNQDVFKIMEEEDNTDTTVIAKIANTAKPREINDTTVIAKIANTAKPREINDTTVIAKIANTAKSSHIKDSTVIAKIADNLFYSNSIDTNRHIIDTETDQLQNQVLLDNFVDIMKEDSINTFVPENVLNLIKTFSSTYEDAQKTVQTIHNAKKKAEELEQTVVVYEELESYGIDADKGLYMTLLKAYQKQKTEKVNNLQNLIFVYVKNWFVEKAIAAKLANEQRETFNELPTVSTENWLE

SEQ ID NO: 7114 - protein, 142 aa, Enterococcus faecium
  misc_feature (B) LOCATION 1...142
  hypothetical: YES
CSMVKAIEKHITFYEAHDEVLKHIMETQPTVKNYSEAIRFLCMNYDPEIEKNNNMTNAKLNAMGKEISILIEMVSEFADLHLKDTGILIGTNSTVYQEAKERVEGKIKANQTKKYSPKIKKSINESVHARVDPFDPTKFLKR

SEQ ID NO: 7115 - protein, 65 aa, Enterococcus faecium
  misc_feature (B) LOCATION 1...65
  hypothetical: YES
MNMVQQGMCRKLLMPMGKNERLNLMVFAVLKENHYLKISNKGAHIETYEEVPREKVPEKALAIIG

SEQ ID NO: 7116 - protein, 150 aa, Enterococcus faecium
  misc_feature (B) LOCATION 1...150
  hypothetical: YES
VEMVKTLYSILHRSLDLTEFMEEVLIDDNMVFDIDNLKGFLNDTSSFGFIAKENNKIIGFAYCYTLLRPDGKTMFYLHSIGMLPNYQDKGYGSKLLSFIKEYSKEIGCSEMFLITDKGNPRACHVYEKLGGKNDYKDEIVYVYDYEKGDK

SEQ ID NO: 7117 - protein, 107 aa, Enterococcus faecium
  misc_feature (B) LOCATION 1...107
  hypothetical: YES
VEMVKTLYSILHRSLDLTPFMNLANLSSILLTIGSLFQPVLLKFTKLYWQNVIQILYAVLFIMLSLFLINKYQLIGFVYASLFANLFRLLLFILVGYFSIWRNKNND

SEQ ID NO: 7118 - protein, 126 aa, Enterococcus faecium
  misc_feature (B) LOCATION 1...126
  hypothetical: YES
VEMVKTLYSILHRSLDLTIPNIEYSYISDELSILGDKEIKGTFLTPEIYSTMSEEEQNLLKRDIASFLRQMHGLNYTDISECTIDNKQNVLEEYILLRETIYNDLPDIEXDYFDSVMERTNATTVF

SEQ ID NO: 7119 - protein, 443 aa, Enterococcus faecium
  misc_feature (B) LOCATION 1...443
  hypothetical: YES
GGMVGMRISEKVVRIGLILMVALSIYFSYAIWLSPAGKSSINVDETNTQMIESQSNRKTSEVFLPLHVTWHHSGMIQETNSENLVYRLQLIIDKARFGKLSEVVSGDKSQFEQVKNLNSGFELAYNAPFLLREYKEAFDLDLDVSNLAKESENMYFTRIQFDQGNKKIRFLNYSNHLVYEANISLNWTDINKELTAKDTKWTEMTTEPSTIDTQYATKHSIKLKKYSYILSQQPYTLFRNAFFQKPDSVKNNDESNELIFYGGNETMSIHSETQVVDFRGELPEKKENASVFSESFPYISKLGSSLGNLRYFDRSDNTIDYRIFVEGFPVFGTDSRGQIGVEVGGETNGSVQVNIQTSLNTIQVPIPSDEEVELASTNEIIQQLKAKGADSNKIGSVIVGYTWQNVKETNRVVDLLPEWYVKYKDNWYSANDLLEKLPGLEAN

SEQ ID NO: 7120 - protein, 288 aa, Enterococcus faecium
  misc_feature (B) LOCATION 1...288
  hypothetical: YES
YAVVKTSLFGGSGRSVDPNAPRQGADLQYTVDLSFEEAICGVEKEIKYNREEICHTCGGNGAKPGTQPTTCHKCHGAGTINVERQTPLGRVMSRQTCDVCHGTGKEIKEPCPTCHGSGHEKKAHSVKVNVPAGVEEGQQMRLAGQGEAGENGGPFGDLYVVFRVEESDIFDREGSEIYYELPLSFVQAALGDEVQVPTVHGDVKLKIPAGTQTGTNFRLRGKGAPKLRGGATGDQHVKVKLITPKNLNEQQREALRAFAEAGGIKVEEQQEDGFFDKFKDAFGGKKRK

SEQ ID NO: 7121 - protein, 92 aa, Enterococcus faecium
  misc_feature (B) LOCATION 1...92
  hypothetical: YES
QRVVNTTQKHRYLLSMININAAFVITKRTDGLIGISARSTGTINVQIIMESLGGGGHFTNAATQLENTTVEETKQKLFAAIKENMNQIYDKE

SEQ ID NO: 7122 - protein, 193 aa, Enterococcus faecium
  misc_feature (B) LOCATION 1...193
  hypothetical: YES
HFVVKMTVFVWLLMSVPIIGAYLIGKKLQFSDTSSLMMAGGNAVCGSSAIASIAPSIHAKEEEKGQIITLVNLLGTVMMLTLPFLGLQLFGGNLIEKSALLGGTLQSVGQVXAGASLLDNSVVEFAMLFKILRIMMLVVVVYLFEKFMHKKQPALFETPTDTQKKRKLPLPLVCIRVCDLLXGQQLVFFTCSY

SEQ ID NO: 7123 - protein, 628 aa, Enterococcus faecium
  misc_feature (B) LOCATION 1...628
  hypothetical: YES
HVVVSVTICVTQNRSNWMKRKVRFFRSVNFKIAITFILILLISIEIIGAYFIRGLERSTINTFIKDMNQTVESLATTISPELNRKDNADDEEVNANIKRFIENSATSDIIEIRVVDEKGIIRGTTDVNEQSAVGKKNDYVDINDFTTKRYVALDNDDKRVNINVQPILSPTGDAVIGALYVKSNIEQKYSEINNTAVIFFTASLIAAFISMIVSVLVARSITQPIGEMREQAIRIARGDYSRKVKVHGQDELGQLADTFNQLAERIEEAQDTMEAERNRLDSVLSHMTDGVIATDRRGKVITINDMAVSLLDIKNEEAIGQSILTLLDIEEEYTLRKLLEDPNEMVLDRSTSTLESDQMILRVDFSMIRRESGFISGLVAVLHDVTEQEKTERERREFVSNVSHELRTPLTSMRSYIEALSEGAWKDEEVAPNFLKVTLDETDRMIRMINDLLNLSRMDTGNTQLQLEYVNFNELVNFVLDRFDMMVGNQEKNYKIRREFTQRDLWVEVDTDKIIQVVDNIMNNAIKYSPDGGTITCRLLETHNNVVLSITDQGLGIPKKDLNRVFERFYRVDKARARAQGGTGLGLAISREVIKAHRGAIWAESKEGKGSTFYISLPYEPYEEEWWE

SEQ ID NO: 7124 - protein, 286 aa, Enterococcus faecium
  misc_feature (B) LOCATION 1...286
  hypothetical: YES
QSVVKCLLASRIISDCKTKNKRTGECMMECQLDQEWRLRPIKGDTGKTYIGMRDEDKVFIKRNTTPMLAALSREGITPKLVWTKRTGNGDTLTAQEWLEGRLLTPNEIGQRNDVIDVLYHLHHSNSLKTMLTRIGGRVMTPEKMLQKYEKELPEELQKNQFLQIVHRFLREQIPSIDKENLSVVHGDVNHRNWLVCKNYLYLVDWDSIMFADPAVDIATILGNYVPLSSWNQWLISYGIRPTDEMLEKFHWYAAMNLLQEITRYCKREDHRRMNEEILQLKRIFSG

SEQ ID NO: 7125 - protein, 226 aa, Enterococcus faecium
  misc_feature (B) LOCATION 1...226
  hypothetical: YES
NKVVPKKQVKEGTKMSRPNLQIALDHNDLEHALGDVMKVGDVVDIIEVGTILCLQEGQKAIRCIRSMFPDKKLVADTKCADAGGTVASNVAKAGADWMTVICCATIPTMEAAQKEIGELQVELYGNWTFEQAMDWHNIGIRQVIYHQSRDALLSGETWGEKDLSKIKKLIELGFNVSVTGGLNPHTLHLFEGIDVYTFITGRGITAANDPMKAAQNFKDEIIRIWG

SEQ ID NO: 7126 - protein, 133 aa, Enterococcus faecium
  misc_feature (B) LOCATION 1...133
  hypothetical: YES
KKVVKKMSNLWDYNQEAPIHYLIARHWDALKIEAVCRSLLAAVPKQQLENFLVADSLQREKVQAYFAAFKDQPLEYLHAQFHLFYQVAAPDDYNDLRGQLQLTFQADETAYTVLLGMARLGDQAKVEWRIFDI

SEQ ID NO: 7127 - protein, 526 aa, Enterococcus faecium
  misc_feature (B) LOCATION 1...526
  hypothetical: YES
GRVVIIKKKFTVLLTIIVTGIMSGFALVSINKQVLYRTNEFFHQTDTYTPIRLPQHFIGQEEYEQLIMVFENVSSETELSYMKKTVNESNEVDTSWNFKIQPKLEMTLYYQGDVKSSHEKVPYSNTSFRVTSIEESIKIKDFEGEFFLMTREKEAYERFISLFTDRFNQAFHTDYATNIFEDFENSYSYSVISNTDVYNYRVYLTIGLILLFLLLSSFFLLMNKEISLLLNNDFSLHQVLWCLLGKKKIIITFIIAGIIGGFIFMYYKEQFLYLFQMYVFLFSGIYGISLISLLLVEKIASLREAFNYIQYILFTFGLLFSLLLTVANVELATIVFSSSQLAVSHEPPKEIAGEDYHVFYPVTIGKNHVDFIYSNRFASAADQELYETLNKNGSILVNVSDYLNEENEQFGRGIKINLNYLKKFPLIDVSGRLIQITEKETHPVILIPERYRHTDLKNDLAQITEYYQEISEKEPKFLFIKNNQPIYTFIPSIPWIEPYPGVGNTDIEKQYVFGKTYSQRRNLSPG

SEQ ID NO: 7128 - protein, 304 aa, Enterococcus faecium
  misc_feature (B) LOCATION 1...304
  hypothetical: YES
KLVVKKMYDENEWGENVRMTRRRQQKQAARKRMIMIGAAVAVFLIIAGGVAGLYFHGKNSSEAKSTTITETTTKKTETKQTSESSTKTKETQTSEEKTANGLPEQLQAIVNDYSKKIEEKTPALIEEYQTEIQGNQEGIAGLSAVANQKARELQAISDEGIRKLRAAYQAAENKDGVDLDTLINQLSANYTNHVAKISDIYLQTSASLQAESTSTQDTTSSDSETAESVEASEMQARTTQDTTDSSETNTNSATSQAATTVVLEGEGPNQIAERTGVPVETILSLNGMSMENYFLTPGETLKLN

SEQ ID NO: 7129 - protein, 173 aa, Enterococcus faecium
  misc_feature (B) LOCATION 1...173
  hypothetical: YES
KLVVFILNFFHLTIFQWMSIISFILSTFLTGIKIKGMRPQLEVELNASYFAADMIYTKVIISNYSTEPAMLVNLELSSANLNRRWSATPFKKLIAKGGSVDDNRIYSEAVPLNIPPKSAISCYLAFEVGKINFNKLLNHQTKMIFTLNRTQIHKIVDIKNTNFPIEKLVKELN

SEQ ID NO: 7130 - protein, 74 aa, Enterococcus faecium
  misc_feature (B) LOCATION 1...74
  hypothetical: YES
EDSVTLKIPGRPSSSAFLPACITPPNNKDSSSVWATRALLFFAASFIARYIVPAVWTPTPSFVKAKAPSSISAS

SEQ ID NO: 7131 - protein, 106 aa, Enterococcus faecium
  misc_feature (B) LOCATION 1...106
  hypothetical: YES
VESVEDKKEKLFDLIANAYNSKSYNNVEVKEGFLQDAKKIREDKPYPEIIISVYKHLSKLKAEERININEIKCLMEFIKEDYTKLSAKELRKYDIGYGAMSMPYIF

SEQ ID NO: 7132 - protein, 60 aa, Enterococcus faecium
  misc_feature (B) LOCATION 1...60
  hypothetical: YES
RWSVEQHLNTLNNTKKNKRRCGRTEIIFPAEEKDTLKKDQLKVGPQTSLLAVQSEPSLVQ

SEQ ID NO: 7133 - protein, 126 aa, Enterococcus faecium
  misc_feature (B) LOCATION 1...126
  hypothetical: YES
ETAVKMSMSRSSTSRNRRPITMTKLYLLLLVACLFIVAYIPRLFPMLYFTHRKVPSWFSDWMKYVPVALFAALAFKDVFITHEHLDIAWNIKIAAMILVAGVAYKTRSMALSVLTGLASVFLLSML

SEQ ID NO: 7134 - protein, 63 aa, Enterococcus faecium
  misc_feature (B) LOCATION 1...63
  hypothetical: YES
KTFFQNRLALHLFNNGLSNDIVGIILKEVLEIVGTSLLYMKIYSMVGAIILRINPFLYKLFAY

SEQ ID NO: 7135 - protein, 635 aa, Enterococcus faecium
  misc_feature (B) LOCATION 1...635
  hypothetical: YES
HQKVDFNTSMIRSQLTSDTLLSYQRKKTFLCYNISDNFERGVTLMIRNDIQPDLQTIEQYFNRKEFYIPSYQRPYAWQVAQCEQLIEDIETHQENFDQESQDNYFFGAILIAQESGEDHEVTLIDGQQRTSTFMLLLKALLLKINKESAKLSDETLENAKLIEKLNRLKSSIISMLYNLNEDNSFYYRKGDYKLQPTDIKYLNESISELYAADMEKILIGESFEDIAGSVTQIYRRQKDNRFTNFYKNFRYFWKYCDELTNFQVAEFAEHFIKYCQVITITSFNTDQAINIFNSLNGTGVPLTPIEVIVSKATANAAERKTFESNWQAIVNKTDHSSLNLNLLMTHYIFVQLSQQHGAITRNPGIRAFFAKNKELLKHDVEFTNSLNTILDNLGDFERTELGKILNQFNSNLKPFVSSYLYFRPMNQEYLTYLLRLGAILELTDFAYANRNFKGFLERINLKYSQVDIVSDEELIEEIKKHISTAFNKEDILQTLMESGVPNSIIFLNEYVYCKQHDQEFNIYGNVDIEHVMPQSGLNRENIMADAGFTEPEEFHEYAEKLGNKILLESEINRGIGDAWFRTKKENTITSHHGFIGSQYKIAQALVGYHKDTWVKDDIKIATEKAAHRISDFLFE

SEQ ID NO: 7136 - protein, 97 aa, Enterococcus faecium
  misc_feature (B) LOCATION 1...97
  hypothetical: YES
ERKVTNMRKVKMNYQGRVQGVGFRYMTKMVADQLGVTGTVKNEDDGSVTIEAIGNDGIIQKFIEEVKKSPSPSGRVQYVDVQEDPMIEERKKFDVVG

SEQ ID NO: 7137 - protein, 435 aa, Enterococcus faecium
  misc_feature (B) LOCATION 1...435
  hypothetical: YES
GTKVLLVAYKDIPKSVHKFMEDITQKCGDIHADWAKNFTAAFANTLLTTVKKQNDGTTFLLTGDIPAMWLRDSTAQVRPYLVIAKEDEELADMISGLVKKQFFYINIDPYANAFNEEANGAGHQTDHTKMNDWIWERKYEIDSLCYPIQLAYLLYKNTGKTDQFNQSFIEGIKKILDVFKTEQDHEHSPYTFVRDTTRKEDTLINDGRGAKTAFTGMTWSGFRPTDDTCRYGYLVPSNMFAVVVLGYVEEIFQTILDDKEIVQQTQKLKKEIQEGIQNHGRTVNQKGQTIYAYEVDGMGNATVMDDSNVPNLIAAPYLGYCSEQEEDYLQTRRTLLSKENPYFYEGKYAKGIGSSHTPEKYVWPIALAMEGMTTSDKSEKERILNLLVATDAGTHLMHEGFDVNNPENYTREWFSWANMMFCELVMDYFDIRVEK

SEQ ID NO: 7138 - protein, 304 aa, Enterococcus faecium
  misc_feature (B) LOCATION 1...304
  hypothetical: YES
NSEVKYMNKKYSIHNKKEPNKKNKAQIDKVYKKTKGVKLYLGAILGFLAIGMIIVFSPYVMGKSYDFETVKMSSAQNVTSSLNMYVDDMEINREAGLFKLVLRYQDDTGTKSLSNIKSDYKLNFITNKNNEDVKTKVVKLSDEYTVIYYQNLPKDFGVISVTVNPRYIYPELEPSNDLKEKEIKFYAVDKDIKSNAKLEVESTSDLQKDNFKYQIKAIENSIKDEKKSIEKMNLANKVVQKDIDKANQNLEFQTLDEQTDTKNEISSMQTTIENNKSSIEESENKIKQFEEKIKQLEKSASRFE

SEQ ID NO: 7139 - protein, 118 aa, Enterococcus faecium
  misc_feature (B) LOCATION 1...118
  hypothetical: YES
KLEVSRMEIEKTNRMNALFEFYSTLLTEKQMNYMELYYADDFSLGEIAEEYEVSRQAVYDNIKRTSKILEDYEKKLHLFSDYIVREQILEKMTAYITDKYPEDKKLLEYVQQIQAIEE

SEQ ID NO: 7140 - protein, 291 aa, Enterococcus faecium
  misc_feature (B) LOCATION 1...291
  hypothetical: YES
IQEVNKMKMDKLLALYPQAQKKNSPASEADILSFAIDDAFIWIKQDSLSQQETSLLKALFPVINDQKKHPWYHYLFKDASCVQEKSFRLIQLHVESKGEFLKKEWQDTILELFRYSADFFFYTDTDALLVEQINRDYLDATEINGIFLSLDADFDTTTSVFVGSFHSPGTDLVPLFAEERKIFLTEQNNLYTHSRTFSMQDVALHYYTKDTVKDSKLIKSYIELIKQNEMEVIIQELWNELGNVSSAAKTLFLHRNTLKYRIEKFQEQSGFNLKKANDLLFCYLLLLHEHN

SEQ ID NO: 7141 - protein, 95 aa, Enterococcus faecium
  misc_feature (B) LOCATION 1...95
  hypothetical: YES
SKEVKEMAISKERKNEIINEYARHEGDTGSPEVQIAVLTEEINHLNEHARVHKKDHHSYRGLMKKVGHRRNLLAYLRKTDVQRYRELIKRLGLRR

SEQ ID NO: 7142 - protein, 249 aa, Enterococcus faecium
  misc_feature (B) LOCATION 1...249
  hypothetical: YES
LLEVFMDYSLMTRLAAEMIGTALLIVLGNGAVANVDLKGTKGYGSDWMLIAVGYGFGVMMPAMIFGGISGNHINPAFTIALASNGLFPWAEVVPYIIAQLIGAAIGQLIVVACYKPYYDQTEDVNHVLGTFSTINSVGSKFNGFVNEFFGSFVLFFGALGITKAPFFQDNLGTAHLALGFLVWTLVASLGGPTGPGLNPARDFAPRLVHALLPLKHKGSSQWGYAWVPVVAPICAGVVAVFLYKLLFMA

SEQ ID NO: 7143 - protein, 86 aa, Enterococcus faecium
  misc_feature (B) LOCATION 1...86
  hypothetical: YES
FLEVKKLTREEVFNKVAKIISNHFEIDTDKVTDELNIKDDLKADSISIMEFVLELEDEFGTEISDEDAEQIETVGGAVDYISSHLK

SEQ ID NO: 7144 - protein, 384 aa, Enterococcus faecium
  misc_feature (B) LOCATION 1...384
  hypothetical: YES
KSEVNLMEQNKNNNVASTLARQGMKQVSKKIGLALKIKIGVVIGLITLVGLLVIGSLATLQGTQTATNTGGAEVIGGNKPLSPEVQKWQKTVEKYAEKYGIKELVPYALAIMQCESGGKLPDLMQSSESAGLPVNTLQYEESIDQGLKHLSNVYNIAKSYGMESNYDGIVQAYNYGIAYMHYLGKNKKTHTIETAEAYSKNVVAPSLGNTTGQTYSYVNEVSIKYGKTYLYLNGGNFYYAELVKQYIGGGSGNPANPSEFWGKMKTEMEKYQGWPYVWGGKNPTTGFDCSGLTAYLYQFSAGITIDSYTVTQYEATEAVSIKEAKAGDLIFFRGTYGAPDFISHVGIYVNETTMYDSNSSGIGYHNWQDSYWQSHSPEIRRVKK

SEQ ID NO: 7145 - protein, 117 aa, Enterococcus faecium
  misc_feature (B) LOCATION 1...117
  hypothetical: YES
RNWVVYFMSYTGILSLKDICHYGKRCTATEKITKKLSTGQSKTVVQCKKYIIQKDKVSEEMIYYIGKQKQIILKDPIPLKELYPTIKHVYDQNGVLIGRRKNGVLRCTAKGMGRLIS

SEQ ID NO: 7146 - protein, 1190 aa, Enterococcus faecium
  misc_feature (B) LOCATION 1...1190
  hypothetical: YES
FKRVRYLNRGEKAYLPEFEKMQLARSLYTFQYYDPNDASKTIPHDWDVDAAKKVFRPLLDDPEQCAGHYEKMVKALAMVSPDERAYSLMEPTLQKMGAYLRGEYSLFTPLPDAVLQEERQKKQKQKQKERQDSARQTAEPATGLAAAAKALSRKKQPAPREDADGQLTLDMFGLSSEPEQPAATPEPEPELSQAETGASETAVPIASKPEPPQETPNIPEGAAPIMAESPADRYDLGYGHMGNGLTVWNRLEEEHGDYKTVAHIAPDRTVTFYDADMPEEIREKIQKVAAATEMSISATQDTPVFSTPPQEPERVQPGNSEPEPEKVQDAPAAVNPEPETGDSNIVPSPAQKAGAEPTGTGSPQTQEAPKTAAADGLNLTPNVEEYLNLKAQYPDKLVGVRVGKTMLFYGTDAEEAAPALGTKTITRDIPDLGMVSITGANGWQSVLKKLLEHGKSVVLARPDTERGGDAPYEIIKERSAADYIPVGMELTIDGRLMKIDSVDYNAGTVSLQDMELRGWYPIFRSESIPFVRQFVEEVQQEHFTAEPMQEPERPETSDLDTAKQLIEQFAYAEYGSDDVDFSDLEHIGIAYGTTEDGGLEVQVDVNLLDFSISQSVDGKCVETRQYGSLRELIDMELAFLDYDMLVSVEPDIEERLKAELNQRIRWSEMAGAREGVEPTEPEIFPEKDVSPEQEAPPELVEIDGGQITETPAQRQTRRRAQEEVDSRVFPSEIILQPLRLEPERHNFRITDENLGAGGEKTKYQYNVEAIRTLKQIEAENRLATPEEQAILSRYVGWGGISHAFEPNDPKWAKEYAELKELLTPGEYQSAQSTVLNAHYTSPTVIQAIYNAVEQMDFTPGTVLEPSMGIGNFFGMLPEKLAAAKLYGVELDDLTGRIARQLYQKADITVDGFERTDHPDDFFDLAVGNVPFGSYQVHDKRYDRQNLMIHDYFITKTLDKVRPGGIVAFITTKGTMDKKNSKAREALAQKADLLGAVRLPSNAFKANAGTEVTTDILFFQKRDRIPEKLPEWVEVGQTEDGIPLNRYFLDHPEMVLGTMTMGRSMYGNETETACQPIPGADLSGQLAEAIRHIAPPDRELLEVDSGQDGEELESIPADPTVRNFSYTLSNDKLYFRENSRMTQAVLGKTPTERVRGMIGIRDSARGLIDLQLGRRRRPRNPVRASKIKPAL

SEQ ID NO: 7147 - protein, 300 aa, Enterococcus faecium
  misc_feature (B) LOCATION 1...300
  hypothetical: YES
TIRVKCNEKGLKNVYQIVTDSCCDLPYHVLAKEKVDFLSMNLQLNDQELVDDLGKTFNYDRYMNQLKNGAMPTTSQINVGRYLEFFRSYAEKQIPVLYVAFSSGLSGSYSSALQAVELLKEEYEDPEIYVFDTKAASIGEGLLVLEAVRLKKEGKSIEETLEWLESNYLKVHSWVTVDDLKYLERGGRISKASATLGSLLSVKPIITVDKEGRLTNVDKVRGRNKSIQTIVNETVKTIVAPLDQIVYVAYAGDLESAEKAKRLLEEQIKMKDVKLYPLGPTIASHTGYGCIAIFSMGISR

SEQ ID NO: 7148 - protein, 339 aa, Enterococcus faecium
  misc_feature (B) LOCATION 1...339
  hypothetical: YES
LKRVSKMPDYHIAIVNSSSFGRVFPHHLERLKSVGDVHFFTVDQEIPGKELAELLKGFNIIIASVTPFFRRDFFENKDELLLISRHGIGYNNIDLKAAKEHQTIVSIIPALVERNAVAENNITNLLSMLRRTTQAQARVKDDRWEDRAEFVGRTLFNKTVGVIGAGNTGSGVIEILRNGFRCDVLAYDPYKSDLYIESFGAKKVELQELLEQSDIICLCANLTEENYHMISDKEVDQMKENVYLSNSARGALVDEEAMINGLKSGKIAGYATDVLEEEPGRQDHPYLAFEQVVITPHISAYTRECLEAMGEKCVRDVEQISQHLLPERSVQTKSNYIKG

SEQ ID NO: 7149 - protein, 428 aa, Enterococcus faecium
  misc_feature (B) LOCATION 1...428
  hypothetical: YES
KKRVEGEKHMIRLLERNYRKMEKIIRILSISDKWMTKKELAKRIGSSESTFVRYIEEIKIRWGTDVTIQSSQKLGYRLERNQILESYLLKVIVDQGFQLTSLKSELQLRIFVTFFFLSYYGRRTLPFPIEKKKIKEIMVKNNCQMNLFQEESPYEQSFFIMYFVVHLMRESQGTPFEWKAGDSYVQLINIDKKDFLILKNLLGKLKYSSYIKVVNYFVNTIFSEFSEKEKNEISEQIRKNMSYCSFSSADCKEKNEEYVVQLLTQIYFFSRIFPYDTTHLTIRATYFAQQMQHRQIRLYAGFRAELQFYSTLLNQNLIYYLSSYIFWMLIGNPEIHHYTSDKKILIISDLSLRHSQYIEEYISDILAVHKIHSETTAITEDQLSKYNLLEYDLIVTNQPILNAHVPHILIDDSVSFANEEELIRLFEL

SEQ ID NO: 7150 - protein, 170 aa, Enterococcus faecium
  misc_feature (B) LOCATION 1...170
  hypothetical: YES
LKGVLFLRKYTFVFKKKVVSDYLNNEGGYKYLAHKYQINRTLVRHWVRIYNYHGWEGLVGGGKSYTTKFKLDVIEYMETNGLSIQETAKKFNIGSNRTLSKWIEQYEEGGASSLESQKRGRKISMNSKLNIPKKLKDESLEEEVIRLRAENAYLKKWNGNTFFDKNYKVL

SEQ ID NO: 7151 - protein, 101 aa, Enterococcus faecium
  misc_feature (B) LOCATION 1...101
  hypothetical: YES
LKGVLFLRKYTFVFKKKVVSDYLNNEGGYKYLAHKYQINRTLVRHWVRIYNYHGWEGLVGGGKSYTTKFKLDVIEYMETNGLSIQETAKKFNIGSNRTLSK

SEQ ID NO: 7152 - protein, 184 aa, Enterococcus faecium
  misc_feature (B) LOCATION 1...184
  hypothetical: YES
LKGVLFLRKYTFVFKKKVVSDYLNNEGGYKYLAHKYQINRTLVRHWVRIYNYHGWEGLVGGGKSYTTKFKLDVIEYMETNGLSIQETAKKFNIGSNRTLSKWIEQYEEGGASSLESQKRGRKISMNSKLNIPKKLKDESLEEEVIRLRAENAYLKKLETLIQEQDLSKKKSRLKQSFSSKKNLN

SEQ ID NO: 7153 - protein, 286 aa, Enterococcus faecium
  misc_feature (B) LOCATION 1...286
  hypothetical: YES
VFLFFLRGRSKMKIDKILNNNVVISKNGFGEEVVCMGKGLAFQKKIGDEISPEAVQKEFVLRDSFAKNQFQQLMADIPAEEIEWVKQVVELAEDKLKVEFSPNIYLTLTDHLHYAITRAKENIQLPNPLLFETKKFYPKEYQAAKEALLFVKQKTGVELSEDEAGFIAFHFVNSQQGNEDMQVTMTATTMVRDILSIISKFFGIVFDEESLNYQRIITHLQFFAQRYLKGEGSDEQHEFLYALVPGKYPKAFHCVERINEYLRQTQKTGNWGSQSRFIFNDSIFQE

SEQ ID NO: 7154 - protein, 313 aa, Enterococcus faecium
  misc_feature (B) LOCATION 1...313
  hypothetical: YES
FFSLCYRYIKEINQKGKKVMKKVLLVVNPSSGGEQAKEFEQLAIAKLESVFDEVVVLHTKKAGDAKNFTREAATEGYHSVFVMGGDGTVNEGISGIAEQEHRPNFGFFPLGTVNDLARALGIPLEPEEAINHFSIESVKPLDIGKINDDYFMNVVAIGSIPESINDVDAEKKTKFGKLAYFMSGIKQLASTQSYSFHVEVDGKKEEIESSTLLIGLTNSVGGFETLLPNAKVDDGKLHLVYLKDSSLIDTLKTLPDLLKGVDESTKNLAYLTCEQLVVSLADEEELTTNVDGDEGDKLPVTIKVLPSHLQVYC

SEQ ID NO: 7155 - protein, 68 aa, Enterococcus faecium
  misc_feature (B) LOCATION 1...68
  hypothetical: YES
SFLFIFSIFFFLNFKHGSFYRYCDSMVRLGMIQAARITMFAISTATGDSKYPKTIPNTFKPIDRYDLL

SEQ ID NO: 7156 - protein, 516 aa, Enterococcus faecium
  misc_feature (B) LOCATION 1...516
  hypothetical: YES
KKFLKMVGDDMTEHIFNRKSASIILKAKFETGKSKKNNHMVELQKFVDYISRQEAIRQDKLDHDYSEDELNELARIEKALEKIEQETDQPVIKDLREMDKYIDYMTRKKAILENVDNEIVNGAFSNTKRYITKKDISKIKESVIEAKNNGSVMFQDVISFDNDFLVREGYYNPETNELNENVLYEATKSMMGKMQEKEELVDPFWFATIHRNTEHIHIHVTAMERKNTREIMEYDGVLQARGKRKQSTLDDMIFKFGSKILDRTNEFEKISKLRKEVPLELKQSVKDSLIQLYVENNSRYDKELVKYLKELKKEIPSTTRGYNELPEETKEKIDEVTNYMTKDNPKRKEYDRMTKEIDELYQTTYGKRYNPQEYYLNRKKDFNARMGNAVVGQIKLLKQSEEKNLKSNELKNLLDGKKLNVKFDREKPEFKTKYAKQSYDDFQKRLEERQLAREKNEVHFKKISEKFKDKKLIRKIDRVINDDLNMYRAKNDYEVAQRMIEQEKMRQAREFEIGMN

SEQ ID NO: 7157 - protein, 61 aa, Enterococcus faecium
  misc_feature (B) LOCATION 1...61
  hypothetical: YES
YFSFLFYKTKTANPYEGTAVFALLLFPEIIQNGNWQMSFMLCLVPPCFDFFLCLSGNFFSF

SEQ ID NO: 7158 - protein, 61 aa, Enterococcus faecium
  misc_feature (B) LOCATION 1...61
  hypothetical: YES
EKFLKYLNNKETVFKFWYDECSKRKQLMDGKGADKNEHQKVNCWSRLFSGSIRFLNRMRKC

SEQ ID NO: 7159 - protein, 80 aa, Enterococcus faecium
  misc_feature (B) LOCATION 1...80
  hypothetical: YES
LSSLIFLIVEITSSRPSGSSILVASSKIMISGRKATTPAMATRCFCPPDKRAGSREANSAILTFSSASFTRTSISSLGIP

SEQ ID NO: 7160 - protein, 64 aa, Enterococcus faecium
  misc_feature (B) LOCATION 1...64
  hypothetical: YES
RILFKIKNCKDYAQLLLQDSIYLLNFFGELKNTINNFSYFNAFLLYFYIIIFLIHFFGLYYSYK

SEQ ID NO: 7161 - protein, 519 aa, Enterococcus faecium
  misc_feature (B) LOCATION 1...519
  hypothetical: YES
TSLFRIRDCDKIFVTVPYVLQKKFFFFLVNSVKSKEKIDHRKEKLMWEKVEKKQGPIYRQIMEQIMREIENGRINPGSQLESERKLGQLFGVNRSTVVHALEELRELGVLTSKRGSGWFVNQTEWGKFAVPRIDWRQMISPRYEQTDWYEQKIREAKQIQKTSFLDLYASEMPDELLPNFEFPSYSLEEILAEEKEMDLLGYTPLRNKIKRYLESKFELAFSPNQLLVTGGGQQAIFLILQTILSAGEGIAVESPSFFYRLPLFKASGTRLFGIPMDEEGIDLEKLKESIHKNKLKAVLINPNFQNPTGKVMSQKRREKLVELCRQYRLPIIEDDVFTDLSFLNQEEVLPIRTIDPDNVLYVGSLSRVLGKTTKIGWVIGPETFISQLAQAQEMMEFSMNILTQITVANVFNEAIDLKMQDVRKKLKEKSRLISAWGDSQSFFKLHSILGGYYAWITWDGKKLDPELAEKVVDMGLGIAPSLLFGQDINGIRINYSRLDENQIPLFYSKMKILEKWLTE

SEQ ID NO: 7162 - protein, 304 aa, Enterococcus faecium
  misc_feature (B) LOCATION 1...304
  hypothetical: YES
KIIIKITKKKKKKKKKKKKKKLTKVVATTSLVLRLLEDGKIELDQPLHKYLPEFENQTITLRHLLTHTSDIKTWIPNRDKLSQEELIAAYLKLEPGEQLGKEVKYTDAGTILLGLMLEEIYQETAVEIFQEQVLEPLGMMNSLFLPFPSKKIVPTEQLPSGEVLRGQTHDPKARVLAEHAGNAGLFIDLKDSITFVQMYLNKGKIRNGRFLEEETIDSLLQDQTPKKNGYRSLGWDLKKDVEDGHAILFHTGYTGTFFLIDIKTQEALIFLSNRVHPVDHRAEYLICRDEIVENFLKEKAVLPK

SEQ ID NO: 7163 - protein, 431 aa, Enterococcus faecium
  misc_feature (B) LOCATION 1...431
  hypothetical: YES
MQLLQQIHGLRGTVRIPADKSISHRSIMFGAIAEGTTTIQNFLRAEDCLSTLHAFQQLGVEIEEEEEVIKIHGRGSHSFVQPTESIDMGNSGTTIRLLMGILAGQPFTTTLFGDASLSKRPMGRVMEPLREMGADLQGEENDQYLPITVTGTRSLSPIRYNMPVASAQVKSALLFAALQAEGTSVIVEKERSRNHTEEMIRQFGGRITVEDKTIIVTGPQKLTGQQITVPGDISSAAFFLAAGLLVPESQLLLKNVGVNPTRTGILDVLEEMGAAITQTNHNEQNQSADLSVKTSHLKKATIGGEIIPRLIDELPILALVATQAEGITIIKDAEELKVKETNRIDAVAEELQKMGAKIKATADGLIIHGPTPLHGAKVSSRGDHRIGMMLQVAALIADGPCELEGAEAVSISYPAFFDDLAELVSGGEAHG

SEQ ID NO: 7164 - protein, 67 aa, Enterococcus faecium
  misc_feature (B) LOCATION 1...67
  hypothetical: YES
FYSFSCFYFVYRKEKSVIADEWRLTIGAVDSDKRCEKNHSKQNDSSFGSFHCGCWGSCDCCWRKWSR

SEQ ID NO: 7165 - protein, 411 aa, Enterococcus faecium
  misc_feature (B) LOCATION 1...411
  hypothetical: YES
EEFFMTTTISTDQLKDLIQYRLPVYQALALDIHEHPEVSYYEFYSSAALIKQLEKEWFWVEKEVAGHRTAFDARYISNKPGPTIAFLAEFDALPGIGHACGHNLFGTYSVLSASIVKQFIDETGGDIRVYGTPGEEGGENGSAKGSFVREGFFEDVDVALCVHPAFRYGKTTESLANDPVDIKFYGVASHAAAAPEKGVNALEALIQVFNGINALRLQLPKDVNIHGIITDGGVAANVIPDYAAGRFYLRAGNRQTLDKVYEKVENIVRGAAISTGTTFEFGLFQNAVDDVIVTPSFDDLFFQHAKEAGVPDEEIETEQRTSLGSSDVGNVSQVIPTIQPTVAISETYIAGHTEEFKAAAKSDKGLASIAIAAELLANTALDLLKEPKLLERIKQEHQEIVARKKQEGATF

SEQ ID NO: 7166 - protein, 109 aa, Enterococcus faecium
  misc_feature (B) LOCATION 1...109
  hypothetical: YES
SNSFSKYIVSSLEDIVSTSIFICLAEHTKHISCHSSTKQVCYIFDNAYTDYENYLTTFFIYSIFLLSNDLYSMNNYLLDNDLFYSTWADKYNTTIDRSPFVKINCILNI

SEQ ID NO: 7167 - protein, 98 aa, Enterococcus faecium
  misc_feature (B) LOCATION 1...98
  hypothetical: YES
TNSLVKSGAKLAKLAFADEELASFTDQLGKIIDMVEMLEEVDTEGVPFTSNVVETVNVMRQDRAQAGWNRDELLKNVPETEDGFIKVPAIIDNGEAGA

SEQ ID NO: 7168 - protein, 217 aa, Enterococcus faecium
  misc_feature (B) LOCATION 1...217
  hypothetical: YES
KCLLPELFYQQFLFFTDTITLNKEVAQMRCPWSEQTENMQQYHDTVWGVPEYDDQKLFRKLMLDINQAGLSWQTILNKSEAFDKAYDQFDIQKVANYGEAKMSELMENKGIIRNRRKIEAAVQNAKAVLKIQEEFGSFSEYLWSFSNGKIVDSSYHSQEEVPTTSSLSDELAKDLKKRGFKFIGSTTIYAFLEAVGIINDHLDSCFRKEEVVRIGKK

SEQ ID NO: 7169 - protein, 289 aa, Enterococcus faecium
  misc_feature (B) LOCATION 1...289
  hypothetical: YES
TCSLLAMIEKERYPNAKGEDNMKVGFIGTGNMAQAIIDGLLKKGTVSKEEVFVSSGHFENAQKFAAETGVHACKSNQEVASQSDIVLLAVKPKIIEKVLEELREYSQKVLFISIASGKSLTDLETALEDPQASIVRVMPNVNVSVGAGVSAICKNEAATEEQLQQATMIFEAIGSVYPLAESDFSTFIGLAGSSPAFVYMLIDAMGRTGVLNGLSKQTATEIAAKAIMGSCQKFLSSDKNPWELVDQVSSPGGTTVAGVVALEEAGFIPAIIKGINTTIEKDLEMLNKK

SEQ ID NO: 7170 - protein, 119 aa, Enterococcus faecium
  misc_feature (B) LOCATION 1...119
  hypothetical: YES
FLLFKSTEILCWISVLFCFYVKLLFNEYRFFSGGNMKKKIIRLMLISLGIILILVVGYRLYLEYQTDIQLFLNPRASKAELLAHIRSHGTFASILLIVLTAVMCAVPGIPTSVVGVIAV

SEQ ID NO: 7171 - protein, 115 aa, Enterococcus faecium
  misc_feature (B) LOCATION 1...115
  hypothetical: YES
GILFFAERLGQWWACEACQVWKEAALSRFRHVSDYNETTTDFRVCFFYFYSTVKMNVPDFLARLIYRILYLYNLLQGRKNSEIELVSMEEKAAYGMIKIKRGERVHGKNSDFTYE

SEQ ID NO: 7172 - protein, 426 aa, Enterococcus faecium
  misc_feature (B) LOCATION 1...426
  hypothetical: YES
FSLFTSKQKKRKRRGKMTTTGKKLKVIFMLIILSLSNFVPLSAIADTTDDPTVLETISAEVISDQSGKKALNIKLNANNTSAEKIEKEIGLVENYLSDVERKEGDGYAYQVNSGKITLEISSNTKQTIDLSFPIDPALYHSQANKLIVDNKEYDIIDETENKKDTDVSVPKPDEIEEESSKENENSVSPFTLPTLSLPAVSVPSNQTIPTEYTTDDQGTYPKASWQPTGNTNVLDHQGNKNGTNQWDGINSWNGDPNDRTHSYIEYGGTGNQADYAIRKYAKETSTPGLFDVYLNARGNVQKDITPLDLVLVVDWSGSMNDNNRIGEVKIGVDRFVDTLADSGITDKINMGYVGYSSEGYSYSNGAVQMGSFDSVKNQVKSITPSRTNGGTFTQKALRDAGSMLSVPNGHKKVIVLLTDGVPNIFL

SEQ ID NO: 7173 - protein, 70 aa, Enterococcus faecium
  misc_feature (B) LOCATION 1...70
  hypothetical: YES
TALFAEDKEATKIIRLTIAAPPWQWITCSIVTKGLSFKSKQCHGTTNKREYKIFCVNEKIHTKKEVPSVE

SEQ ID NO: 7174 - protein, 70 aa, Enterococcus faecium; identical to SEQ ID NO: 7173
  misc_feature (B) LOCATION 1...70
  hypothetical: YES

SEQ ID NO: 7175 - protein, 61 aa, Enterococcus faecium
  misc_feature (B) LOCATION 1...61
  hypothetical: YES
KMLLFPTKPHMPTCLQDPEEPERRVQQRFSQKQSTVRTVKTASHATNAKCVDQLLLVRKKM

SEQ ID NO: 7176 - protein, 60 aa, Enterococcus faecium
  misc_feature (B) LOCATION 1...60
  hypothetical: YES
KKLFPLADTSNYVTFLPTMYPIIICRKTVKKPVESLREILAFIRYNEIKKKEYVYAIIFS

SEQ ID NO: 7177 - protein, 83 aa, Enterococcus faecium
  misc_feature (B) LOCATION 1...83
  hypothetical: YES
DFSLPTSFDKEPLFCRVNGVQKPVSRYEVKFKQKCEKLFSQNFSSYSKLSGFFTTSFLFCHEHIIIRVHYFFSNRQVHVVLFV

SEQ ID NO: 7178 - protein, 495 aa, Enterococcus faecium
  misc_feature (B) LOCATION 1...495
  hypothetical: YES
YYILNRRGIQIMKSKMIQRVSYALGAFGHDTFYVTLSTYFMVFVTSQMFAGTDKATNAKMIATVTSLVVGIRLVEIIFDPLIGGIIDNTRTKYGKFKPWLVIGGVVSSVLLVAIFTNFFGLATHNTTLFIILFAIVFILLDSFYSFKDIAFWSMIPALSTETKEREKFATFARFGSSLGANGTTLVVVPIVTFFTYLVTHKHIEGASGWFWFGVIAAVISGGTAIITALGTKEVDTAIRQQNEKAGIKDVFKAVAQNDQLMWLALAYIAYAIANVATTAVLFYFFKYVLGQPTEFWIVGLVAALLGLVAVPLFPMLTRVISRRYVYLGGIAMMISSYFFFTIAGSSLPIVIIGLVLFYFPQQLIFLSALMTITDSVEYGQWKNGIRNEAVTLSIRPLLDKIAGALSNGIVGFVAIASGMTGNATAADITAHGVTTFKAYAFYAPAALMIFSAIIFAWKITLTEKKHAQIVEKLENKLAPADTMEDELHDAVVPSH

SEQ ID NO: 7179 - protein, 98 aa, Enterococcus faecium
  misc_feature (B) LOCATION 1...98
  hypothetical: YES
TDIFFSCRSLWAITIAIIVPTAAIAINGNSRYAITTAPKKNHTAIFLLQSIRNSIAIPTAGSRFPATVNPFMMTSGILSKTLLTTSAPNKTAKNGIRA

SEQ ID NO: 7180 - protein, 67 aa, Enterococcus faecium
  misc_feature (B) LOCATION 1...67
  hypothetical: YES
LCIFLKQKFFIAIIATKKFHRGKRFGQKWKFPPKVTAPQLKSIKELEFENALVICMTCTDEVFRKHF

SEQ ID NO: 7181 - protein, 76 aa, Enterococcus faecium
  misc_feature (B) LOCATION 1...76
  hypothetical: YES
LISFLYRIKKCLGITDTLGVSWEKQLTVHSAISLFNQNNLLKLGPPKPVLFIGLTFGSFPFGKEFSQLAASNLFSP

SEQ ID NO: 7182 - protein, 70 aa, Enterococcus faecium
  misc_feature (B) LOCATION 1...70
  hypothetical: YES
KSILKKASQISSLSFDTVQRKKQIPAFSYLMKSLISTIPVLPIGVSRRFWAVAYVCIGASPNKSYSVFLR

SEQ ID NO: 7183 - protein, 92 aa, Enterococcus faecium
  misc_feature (B) LOCATION 1...92
  hypothetical: YES
LIILGIFNIYLAMRKYPRTKFQNFQLILGSLVIFFSLVNSPALWMMVVLAVLFIGLKGVEISGIDLTKNAFWRKKQIMMVQTEQLKTHNNER

SEQ ID NO: 7184 - protein, 117 aa, Enterococcus faecium
  misc_feature (B) LOCATION 1...117
  hypothetical: YES
NKILHLRIEGDVMHIQIPTVLLDGTVLAALSNEDMYGYALTKIVQESLSVSESTLYPVLRRLKKEGYLETYDEPFEGRNRRYYSLTPMGSRHLEEIIDEWIVFRDSLDRLLEESTNE

SEQ ID NO: 7185 - protein, 64 aa, Enterococcus faecium
  misc_feature (B) LOCATION 1...64
  hypothetical: YES
QEIFMNGVVTKALSQLLFLNKRCARDSLSAIRHDFVKYGKRFFKIASYRSRLNISVTTSPLNGV

SEQ ID NO: 7186 - protein, 161 aa, Enterococcus faecium
  misc_feature (B) LOCATION 1...161
  hypothetical: YES
KRILVNQIRELKRRKNMAQNYYDEFVKLPLDKMAQKMEDMTFLYNETRVPKKHYKEKLSVAVEEMIESGVEMNLIATYYRTLDELKKQNAKWFFQALLCLEVGVKPSTIKPSEYQALELTYAKFIETKKAKTVSSEWLDYFENINKYGAYYTMKKEDNENE

SEQ ID NO: 7187 - protein, 132 aa, Enterococcus faecium
  misc_feature (B) LOCATION 1...132
  hypothetical: YES
LMIFTTSLLGIANPIPSTLTLEVDSEVLAILLELIPITCPSILTKGPPEFPGLIAASVWIALILTVSFDSFVLVTCRFKEEMIPEVTEFAYSDPSGEPIAIAGSPTFRALESPKEATVSTLSELIFNTAKSE

SEQ ID NO: 7188 - protein, 220 aa, Enterococcus faecium
  misc_feature (B) LOCATION 1...220
  hypothetical: YES
FWILGGDNMKKFRIFLSLKKEEEWINSIQEEGYRLVSVSSVVPIYTFEKLASKEKFIPYVRLDFREKSMGKIKYEDYVTLFSDSGWKLIKGSRSGGAQYFQQEYPDVTRDIFSDTDSQESVKKRYVKYGYTYGTLFLLYFFIFFSSNSWNLDKILNFKSWYFTQGLWEMEGMWFWKAFIFETPFVLLRVLPLFFFLFLGIYYLLRSLINDDSTVITKYFV

SEQ ID NO: 7189 - protein, 757 aa, Enterococcus faecium
  misc_feature (B) LOCATION 1...757
  hypothetical: YES
ARILIDRDDQKGKRSMENFSLTENRTFSRLEKQMIWKKPKSHRTSAEEWRIASEIKGNWQDPEMKISNVLLEGDAGSGKTQLAKALSADLQLPYTKVTCFADMDKSDVFGALLPVVDSNKEQDQELLEAIYQTDTLEAVLTLIQNHYGIDPFSAKEKLAELVQRIEADYPDAIHYSYYPSEIVRAIEKGYLLEIQEPTVIRDASVLVALNSALEPNGMLNLPTGIIRRHPDCVIVITTNRNYQGNRPLNESLRDRMQHAEKMDLPALEVMAERAMAKTMIQKQELLLKMAEIIRLLDETAKANAIKGVAGMRSYFYWANTYKQGQDLLQSIYPKVLYKLSTDSDELAILEQALSDSGLLLELQDILRKEKWGHPQSEHTKERTISAEEANERNITENAEEILRLDEKKSLSAEEPNEGEEKQEETIEKNEIPPQMQKERSSDIEGKNQKEQQTGDDSQEMSASDMEAHDKEIKKQLNKEARQIMKETIHEKEGLIVHRPAFQGKTPEARELHMQVMPIVESLSRQILELLDNEQTETYQKGKYEGQRFNASKVAYGDLRNFDKKNPPHEQPSLAVAVRIDESGSMIRDDRIEAAKKAAIAIAEFSKKVDIPLLIYGDTADRSSREKTSLFSYKEFEDGFQWLNEKLVTMKPRQNNRDGAALRLAAEKLNRQSATTKLLLNISDGQPKALPDYTGKKAKEDIQSVLKEYERQGILFVSAAIGQDKEEIKSIYGESRFVDITDLNEFPKQMIQLIARYL

SEQ ID NO: 7190 - protein, 83 aa, Enterococcus faecium
  misc_feature (B) LOCATION 1...83
  hypothetical: YES
LLVLRKKKAQITTFTNLEIDEEVFNKKKILLLIIAGALLSVLSACGQEKEAVTTGTSIFNGTCNGLVNSRLDYLFWLFVNECW

SEQ ID NO: 7191 - protein, 66 aa, Enterococcus faecium
  misc_feature (B) LOCATION 1...66
  hypothetical: YES
PSVLAQNADFTTSSLNGVLLPTLRSQVTIFNKHEKLFVEIAPCDSELNGRLTTSLIRFIYFLVLVQ

SEQ ID NO: 7192 - protein, 63 aa, Enterococcus faecium
  misc_feature (B) LOCATION 1...63
  hypothetical: YES
PSVLAQKTAKYEELFSICFSNTQDKTLISQPPIYGVPEVASSKNKLRFHKNLRSNFRKFLLMS

SEQ ID NO: 7193 - protein, 429 aa, Enterococcus faecium
  misc_feature (B) LOCATION 1...429
  hypothetical: YES
GRFLMNEFVQVFPENWQKKYEDKGFISPSLIQRAVFQPLSNKQSIVAVSPTGSGKTLAYLWPLLLNVEPGEASALVIFASSQELAIQVADVAREWGKDKELKVQSLVGGANVKRQIEGLKEKPEILIGTPGRILELMKAKKIKAHQVKTMVFDEADQLFDAGNSQIIDQILHQAPTEYQLAFFSATADRSLESIEKITGKTFETIDVTAEDDSRKGLRHYFLRVPIRKKDDYLRRLTHIEDFHGLIFFNQLTELGVMEEKLLYRGVPVGSLASDQNKLLRKAALEQFKKKMVRALLTTDVAARGLDITGLPYVVNAEVPLSEEAYLHRSGRTGRMGNEGIVITLVQDNNLRDLKRLLRPSNITLEEIFLYGGKLQTEQPTKEDAAPAVNKKYAKTFSGKEQNPEYNKEKIRKKVKNKSKKERNKGARRK

SEQ ID NO: 7194 - protein, 67 aa, Enterococcus faecium
  misc_feature (B) LOCATION 1...67
  hypothetical: YES
RRFFMTSLKTLLFGTTLAAGAAFFMGTTAHADEAYTVQSGDTLSTISQKYVGDNSLIKCHCRIKFNF

SEQ ID NO: 7195 - protein, 77 aa, Enterococcus faecium
  misc_feature (B) LOCATION 1...77
  hypothetical: YES
QSSFYKSTKICTFKALDSFNVRVLSETKILYHQQAFTFILNDGILELTKNLDNGFEEALADGRCNKTRSAFFIRINS

SEQ ID NO: 7196 - protein, 108 aa, Enterococcus faecium
  misc_feature (B) LOCATION 1...108
  hypothetical: YES
SPSFPPLHTVRETFTSYGVPSIYFLLNVLQITHLSIKVDFCYLLWHQFQFMHVVIDYHFICCMDQKMDILMNNSQVIEFVVSTKTFWQIVMTVNGFCWQKLFCNLTLA

SEQ ID NO: 7197 - protein, 183 aa, Enterococcus faecium
  misc_feature (B) LOCATION 1...183
  hypothetical: YES
ISSLPDSIGCDWKDSVDSICCGVEKVFVCPSVFGASFFEDSIWFGFVTFEEVISLVLLEVVEDSVLEIVLLSLDEVVEDSAFEVVLLSLDEVVEDSAFEVVLLSLDEVVEDSAFEVVLLSLDEVVKSSLLSAVTSELLISVVSVLSFAILYVEFSLANTWKGVAIRSWDINITADASFKDFFI

SEQ ID NO: 7198 - protein, 145 aa, Enterococcus faecium
  misc_feature (B) LOCATION 1...145
  hypothetical: YES
FTSLIIFDYFFIFQIYSTIAMISFPATIRYSFPSYFTSVPAYFSNITWSPAFTAAGTFSPFSNKRPSPTATTVPVWGFSLAAEAKTIPPTVFSSSFATSIMTRSPNGFNTINPSDNSFFNLLALLTFECARTFLIYSCRQPRDLX

SEQ ID NO: 7199 - protein, 124 aa, Enterococcus faecium
  misc_feature (B) LOCATION 1...124
  hypothetical: YES
GGSFMAVKIQTSAGTIEITNDVIATVVGGAATDVFGVVGMASKNQIKDNITEILRKENYSRGVVVRQEDNGIAVDVYTIISYGTKISEVSRNVQEKVKYNLEALLGVTANSVNVFVQGVRVLPD

SEQ ID NO: 7200 - protein, 95 aa, Enterococcus faecium
  misc_feature (B) LOCATION 1...95
  hypothetical: YES
MASFAITIKIASLMLDKLTENGYHIPDDLSIVGTDDSSLSHLGNKKLTTLTHPKEKLGQDAARWIVTTIEKGQAQPNILYEPVLVERETVKENEK

SEQ ID NO: 7201 - protein, 550 aa, Enterococcus faecium
  misc_feature (B) LOCATION 1...550
  hypothetical: YES
EESFMLTGLNLLNNPFLNKGTAFTKEERAKYGITGMLPSTVQTLEQQSVQAYGQYLSKQTDLEKRIFLMNLFNTNRTLFYKLMGEHLVEFMPVVYDPVVADSIEQYNEIFLKPQDAAFLSIDEPENIKASLKNAADGRDIRLIVVTDAEGILGMGDWGVNGVDIAIGKLMVYTAAAGINPAQVLPVSIDAGTNNEELLNNPLYLGNRHARVEGETYYEFIDQFVQSATELFPELLLHWEDFGRGNAAAILEKYEDQITTFNDDIQGTGIVVLAGVLGGLNISGEQLKDQIILTFGAGTAGVGIANILLDEMIRQGVPEEEARQHFYQVDKQGLLFEDTEGLTPGQIPFARKRSDFTNADELTNLEAVVKAIHPTIMIGTSTQPGAFTEEIVKEMAAHTPRPIIMPLSNPTKLAEAKAKDLIEWTDGKALVGTGIPAADVEYNGVTYQIGQANNALMYPGLGLGLIASTATRVNAEIISQASRALGGIVDVTKPGAAILPPVAKITEFSQTIAETVAKSVVAQNLNREEITDIKEAVESAKWVPEYKSLED

SEQ ID NO: 7202 - protein, 122 aa, Enterococcus faecium
  misc_feature (B) LOCATION 1...122
  hypothetical: YES
ERSLWKLFLRQNMIFCRANKLNQRKKGSLGVEHASDAVILEALKKVVTPDISQTAVSEIIRQDLLDYGLIAGAQATEKREKLGDELRIGYTNGKQLEKRLKMFRITPKELAQAMKIVEEQHE

SEQ ID NO: 7203 - protein, 94 aa, Enterococcus faecium
  misc_feature (B) LOCATION 1...94
  hypothetical: YES
ISPLKISSFFSFIIPFSMFFFINNRKFVRIMQRNYDKWPTSKNKFIRKKDCDMIFVTILNIYVIFASFDTEEVLFVLEFMLHFSVFRILCSILP

SEQ ID NO: 7204 - protein, 89 aa, Enterococcus faecium
  misc_feature (B) LOCATION 1...89
  hypothetical: YES
VSPFHTIPENHLVNLLLILSQQMLPVTPVRRYSTVLISYLINLHKATTLARFTYIFMTGVKSIFTLVGFSLLSCYTNVIVCKEAHFCGI

SEQ ID NO: 7205 - protein, 61 aa, Enterococcus faecium
  misc_feature (B) LOCATION 1...61
  hypothetical: YES
WKPLKPILSYFIPNNKNILGEVCYLNEYLENRRISRVFIRTYVLLRLKRKARRPVFIVNLS

SEQ ID NO: 7206 - protein, 90 aa, Enterococcus faecium
  misc_feature (B) LOCATION 1...90
  hypothetical: YES
LSTFLHKFGLIPRNWLLNTVYPEVVSLPFHSESQGTISKSSFSCLLNIVTCDRGVGRRIPFTGEFVTCHNFFSSTKIESVLLVRTSCCSV

SEQ ID NO: 7207 - protein, 72 aa, Enterococcus faecium
  misc_feature (B) LOCATION 1...72
  hypothetical: YES
ADTFLDCEARTIIRLLRKKVVESVHIKNKKPSIFVGLKEVITLKKIGFLSLWTLDGARIACEISSRCLFAID

SEQ ID NO: 7208 - protein, 147 aa, Enterococcus faecium
  misc_feature (B) LOCATION 1...147
  hypothetical: YES
MDTFRKAGGSEMKRKWELLLGMVGGSLSLIFFGGLAVTLSNMSASEFKKSYQSLAVDHSTLSLENTFGLLQDMTGLFAVVLFISLAFLAVALFLTAKGKYLTTATGLYFITGFILLIGTQFIAFPFAFFYFAAGAFSLYRVRMRKGA

SEQ ID NO: 7209 - protein, 75 aa, Enterococcus faecium
  misc_feature (B) LOCATION 1...75
  hypothetical: YES
SCTLRVVFNHESVCRLHHAASRYRTICRCKCRRRKSRGNAETASSFLWGYLSRLVFDYLLPANRHVATQYAELGE

SEQ ID NO: 7210 - protein, 125 aa, Enterococcus faecium
  misc_feature (B) LOCATION 1...125
  hypothetical: YES
RNTLRIEAKQKTEELLLPSKFFSYLFAILRSKELDFRCPLFKFEVASCEGSIMEEEKIFEKRWELASVEQRARYHNLMSSYRNIDWTYKEKKYLLWLCQLDVNTFETFEVILDKIKNSNEKRADL

SEQ ID NO: 7211 - protein, 740 aa, Enterococcus faecium
  misc_feature (B) LOCATION 1...740
  hypothetical: YES
MKTLKEPTAEEIKKKRIYAEWGLTDEEYRMIEEDILGRMPNYTETGLFSVMWSEHCSYKNSKPVLRKFPTSGPHVLQGPGEGAGIVDIGDGLAVVFKAESHNHPSAVEPYEGAATGVGGIIRDIFSMGARPIALLDSLRFGELDNPRTKYLLEEVVAGIGGYGNCIGIPTVGGEIAFDPCYEGNPLVNAMCVGLIEHKHIQKGQAAGVGNSIMYVGAKTGRDGIHGATFASEEFNQEEEQQRSAVQVGDPFMEKLLLEACLELILHHSDSLIGIQDMGAAGLVSSSAEMASKAGSGLILTLDEVPQRETGMTPYEMMLSESQERMLICVKSGEEEKIQELFQKYDLDAVTIGKVTDDGQYRLYHQGEEVANLPVDALAEDAPVYHKEMKEPARIVEFQQLAPYQPVIEEPGQVLLDLLQQPTIASKRSIYETYDSQVQTNTVVRPGSDAAVMRVRGTNKALAMTTDCNARYLYLDPKIGGQIAVAEAARNIIASGGKPLAITDCLNYGSPDKPEVFWELSTSADGIAAACETLGTPVISGNVSLYNETDGQAIYPTPMIGMVGLIEDHKHITTQEFKKSGDLIYILGKTFADFDGSELQKMQLGRIEGVIRNFDLSIEKRNQELVLTAIQNGLIESAHDCSEGGLAIALAESAFKHQLGISVQFELSSAQLFAETQSRFVLTVAPENKTRFEEMMGDAAVLAGKVTDEAIIEISATDGQIKIETAVARKCWEDAIVCLMK

SEQ ID NO: 7212 - protein, 486 aa, Enterococcus faecium
  misc_feature (B) LOCATION 1...486
  hypothetical: YES
FRTFYFQLLLKEITFSVFFLQFIEKSLYFASYSFFVTIRNGTSKKMKKQGTRYMEKKQKIILGATSALTIVILILSLFFVIRSSTKKEPIIPEKKITEKAKEPTDDKQQLVTQAKNLAQSYDYDQAIALLEKDSKNGSTETQQLLQTLKKEKEQLIDWSDPTQISHVFFHSLIVDPQKAFHSQQAQGYKDYMVTVEEFNRSIEQLYQNDFVLVNLNDLIQKDEQGNLSFNGLALPEGKKPLVLSQDDVSYYEYMDNSGFPSRLVVSNNNEIKNVYKEKDKEEIGDFDMVPLIDAFVKKHPDFSYRGAKGTLALTGYNGVLGYRTSKSQYGDNEKTKKEIKEAKKVAEQLKKDGWSFASHTWGHLNMTQASLEDVKKDNELWQQEVAPILGKTNILIYPFGADISDWQPYSAENQKFAYLKSQGFDIFCNVDASTPAWGQLGTDFYRNARINIDGIRFQSDLDGKNPILDPFINVHDVYDKEARESA

SEQ ID NO: 7213 - protein, 277 aa, Enterococcus faecium
  misc_feature (B) LOCATION 1...277
  hypothetical: YES
ERTLENKNVSMLLSLYDKEKPEYLKEALTSIFEQTVMPKEIVLVYDGPINEKLQVVVTYFQQKDPHLFTVVKLEKNQGLGIALAIGLEHTKNRLVARMDTDDIMEPQRLEKQLEIFQKDPEIAIVGSNIEEFTGTLSNVIGKRIVPEYNNAIRVFSKRRNPFNHMTVMFDKKAILEVGNYQPLSGFEDYYLWARLLKAGYKGYNIQETLVYARTGKDMYARRGGMKYLGSGLMGRYRIWKDGLGSVKDFIIVSCGHIFISLLPNQLRGKFYQTQLRK

SEQ ID NO: 7214 - protein, 223 aa, Enterococcus faecium
  misc_feature (B) LOCATION 1...223
  hypothetical: YES
MMTFGLVYICQKIPLMLQTTQIPTKLAPAVLKARQKKIKNHRMSSIRGGIIMERAIFAGGCFWCMIQPFDTLPGIHTVMSGYTGGHVPDPTYEQVKSQTTGHTEAVEIIYDPTLISYEQLVELYWQQTDPTDAFGQFEDRGDNYRPVIFYLTEEQRIIAEKSKKQLAESGRFEQPIVTKIEPAQPFYLAEEDHQEYYKKHPENFKRNHARRAAFIEENWRNEG

SEQ ID NO: 7215 - protein, 230 aa, Enterococcus faecium
  misc_feature (B) LOCATION 1...230
  hypothetical: YES
AFMIGLSLISNKNGDGAVFVRNYIESHGGIAAQIGFEGYEYATCISINDEICHGFPRKKPLKNGDLVKVDMCIDLKGGISDSCWAYVVGESTPEIDRLMEVTKKALYIGIEQAQVGNRIGDIGHAIQTYVEGENLAIVRDFIGHGVGPTIHEEPAVPHYGEAGKGLRLKEGMVITIEPMVNTGTWKMKMDPNGWTAYTRDGGLSCQYEHTLAITKDGPRILTSQGEEGTY

SEQ ID NO: 7216 - protein, 314 aa, Enterococcus faecium
  misc_feature (B) LOCATION 1...314
  hypothetical: YES
NTFFRHFCQKRRYDLKIGLIDVDSHNWPNLCLMKLSAYHKARGGLVEWWNPKNHYDFVYKSRVFTDTYSKDTIAVTNADAVILGGTGYDLGENLPDAVEHTRPDAALYPQFSDTAYGFLSRGCPRNCGFCIVSGKEGRRSRKVADLSEFWDGQKEIKLLDANLLACPDHEALILQLAESRAWVDFSQGLDIRLITPDNVALLNRVRTRAVHFAWNNPDEDLTGYFRRFLELTAIKSDRKRRVYVLTNYGSTHEQDLYRVETLRGMGYDPYVMVYDRPAAPKITRQLQRWVNNKRIFYTVKNFADYIPNRTGGIT

SEQ ID NO: 7217 - protein, 392 aa, Enterococcus faecium
  misc_feature (B) LOCATION 1...392
  hypothetical: YES
KMAFFKARQNTTGDPFLQHVVSIQSDDYTTSFTSVRALRNSDVFAAVRIIASDIASSPIQLVKNNMPQADNELVKLLNEKPNSEMDGWHLKFALAVNMLLNGNSFAEIKRNGEKVEEIHLLPNSSVTVTQLDNGTLSYQIGDKKRRVKSSDILHFKYFTQDGLTGLPPLYALRDELKIQQAGNRTLHNFFTRGVSGSGILKVHKSDLDGSAKNAIREKFEEANGSSSGDNALRTIILDETMDYKTLEINTDVLKLINSNDWNTKQIAKAFGVPIERLGVENEHSSTVQSNLQYIQSTLIHYFNVFVSELDTKLETNIRFNSDQLLETDPETKVKNVLDQVKGSLLTINEGRSKMGLPPMDGGDRLLASLNFTYLDTLEKYQLKEQEGVTPVE

SEQ ID NO: 7218 - protein, 72 aa, Enterococcus faecium
  misc_feature (B) LOCATION 1...72
  hypothetical: YES
GXSFFSQKQGLXGAXRLIXKIGGGGRKFLWEKEGEKNPPPGGGLKKKKKILFVGRTRNHPPGMSTPPPKEKF

SEQ ID NO: 7219 - protein, 270 aa, Enterococcus faecium
  misc_feature (B) LOCATION 1...270
  hypothetical: YES
RIPFFSLEKFSGKINKCEKTHSMHRYSEKYRENGGIRVKYVEVKNEYKRYKMGETTITANDDISFSIEKGELVIILGPSGAGKSTILNILGGMDTPDEGQIIIDDTDIAQFSDKQLTAYRRTDVGFVFQFYNLVPNLTAKENVELATEVSPDALDPVEVLRQVGLAHRLNNFPSQLSGGEQQRVSIARALAKNPKLLLCDEPTGALDFETGKQVLKLLQNASRQHGNTVLIITHNSALAPIADRVIHINDAKVRSVELNDHPSSIDEIVW

SEQ ID NO: 7220 - protein, 263 aa, Enterococcus faecium
  misc_feature (B) LOCATION 1...263
  hypothetical: YES
SLFFSKNNCPMTDIIVILYTVGDYVKKEKKYAKMPDGSEIYYEKSGQGFPLFLLHGNDGSGRFFSEQVPVLERYYTVYLVDSRGHGRSTNEASMLNFQLMAEDLNTIMLLEKIDQADFLGFSDGANLALVFASSFPKKVHRLILNSGNTLVKGVRFSARVISNIHYAWVWLLSLFRPSLRKNLLVIKLLLHDIGLTENDLKKINSPTLIIVGKKDVIKLKHSLYIAKTIPKASFVLVKEQGHELARKDPERFNREVLQFLSET

SEQ ID NO: 7221 - protein, 390 aa, Enterococcus faecium
  misc_feature (B) LOCATION 1...390
  hypothetical: YES
NHQFNETVKTSQIATQGGPSFMANGTDKKTYEAAVAAFIKENKPKRQVVYDDLSNQLATPFTLNADEMDKLIQKIEDAGISVVDENGDPSIHSLKSAEKKAEQAKTEDLSAPTGVKINDPVRMYLKEIGRVSLLTAEEEVALALKIEEGDQEAKQRLAEANLRLVVSIAKRYVGRGMQFLDLIQEGNMGLMKAVEKFDYRKGFKFSTYATWWIRQAITRAIADQARTIRIPVHMVETINKLIRIQRQLLQDLGREPTPEEIGAEMDLPTEKVREILKIAQEPVSLETPIGEEDDSHLGDFIEDQEATSPAEHAAYELLKEQLEDVLDTLTDREENVLRLRFGLDDGRTRTLEEVGKVFGVTRERIRQIEAKALRKLRHPSRSKQLKDFLE

SEQ ID NO: 7222 - protein, 104 aa, Enterococcus faecium
  misc_feature (B) LOCATION 1...104
  hypothetical: YES
QNQLFVPFKSHMLKLISKEGGYIMSWLWTLIVGAVIGAIAGAITSKGNSMGCVTNIIAGLVGSSIGQAIFGEWGPKAAGMALIPSILGAVILVAVVSFFFGKRS

SEQ ID NO: 7223 - protein, 140 aa, Enterococcus faecium
  misc_feature (B) LOCATION 1...140
  hypothetical: YES
PSPLVHWINSKGVVEMKKSYPVIFSAEENGYSVVFPDFAGATQGDNFEEAMSNAKEFLDGILAYYIDEDISVPSPTDIHQLNNLGNNKIVSLIQSDPSPFIQKKTVRKNVTVPEWLVARGEKDKINFSKVLTDALLKIYE

SEQ ID NO: 7224 - protein, 334 aa, Enterococcus faecium
  misc_feature (B) LOCATION 1...334
  hypothetical: YES
RRQFFSRIILNDGAVSKAGRQASLSFEAAFFKKKNTQEELNMADVTAKMVKELREMTGVGMMDAKKALVEVEGDMEKAVDLLREKGMAKAAKKNDRIAAEGLASVAVKGNTAAIVEVNSETDFVSKNEMFQDLVKEIAELVAENKPADMEAAMKIKTDKGTIESDLIEATQVIGEKISFRRFEVVEKDDNAAFGGYLHMGGRIAVLTVLDGTTDETVARDVAMHVAAINPRYVNESQIPEAELEHEKTVLTEQALNEGKPANIVEKMVEGRLKKFKAEIALVDQPFVKDPDMTVEKYVASKGATVKTFVRFEVGEGIEKREDNFVEEVMSQVKK

SEQ ID NO: 7225 - protein, 183 aa, Enterococcus faecium
  misc_feature (B) LOCATION 1...183
  hypothetical: YES
RRQLGIYGGNIMRTYKNKEELKKEINRTYTKYILEFETIPEELKDKRVEEVDRTPAENLAYQVGWTNLILKWENDERNGLSVKTPSDQFKWNQLGELYKWFTNTYAHLPLKELEEILNRNIDDINMMIDSMSDEDLFTAHKRKWADEATKTAVWEVYKFIHVNTVAPFGTFRTKIRKWKRLAL

SEQ ID NO: 7226 - protein, 292 aa, Enterococcus faecium
  misc_feature (B) LOCATION 1...292
  hypothetical: YES
QVQLFMEKPQAKKKVLRRTRQKKQRVCWGIAIRDDPALDEIYRGIKDGLKEEGLKEGENLEIKFQNGQADQSKLATMSQQLVQSDPDALIGIATPAAQSLANTTSSIPVVLGAVTDPVGAGLVASLEKPGGNVTGVSDQPPVTSQIKLASDLLPNAKKVGILYASSEDNSKYQVAQAEEAAKKEGLESVKYAVPSTNEIAQTVQVMSRQVDFIYVPLDNTIANAMQTVVKEANKANIPVIPSVDTMVEQGGLATIGINQYQLGLQSGKMAAELASGKEKPETTPVYTFDQGD

SEQ ID NO: 7227 - protein, 119 aa, Enterococcus faecium
  misc_feature (B) LOCATION 1...119
  hypothetical: YES
RQQLFGNQRIGNDVYEWDDINIAIISGDTIIDLGNTLLPKDDNIVIVRKGIGRTRILVPLGVAIRLEHATLVGNVLFEEEQFSLKNEQIKICSSDYDENPRRLKIITNTLVGDVEVIRI

SEQ ID NO: 7228 - protein, 112 aa, Enterococcus faecium
  misc_feature (B) LOCATION 1...112
  hypothetical: YES
VEQFQGSAKMKKNAKQIVHELYNDISISKDPKYSDILEVLQKVYLKLEKQKYELDPSPLINRLVNYLYFTAYTNKIRFTEYQEELIRNLSEIGRTAGINGLYRADYGDKSQF

SEQ ID NO: 7229 - protein, 197 aa, Enterococcus faecium
  misc_feature (B) LOCATION 1...197
  hypothetical: YES
KRQLTKVYQVQKIVGNEGILFMLEYIKKGTGKQDKCVPCSLFDCSYYWVQNSFFTFFILGVSEVASSKNKPNFHKNLRNNLCKTPSYFLKLILSVTTFFYFFLFLYIWINASIAKKIMTNAAIAYVNIPNKETTSAFSTGAAWTSREDPTINAAKIIPKTSRLIILSILLNNLSCFFNSKLTFPCPEVHISNRWWSC

SEQ ID NO: 7230 - protein, 166 aa, Enterococcus faecium
  misc_feature (B) LOCATION 1...166
  hypothetical: YES
NNKLTNLIKKEEVGMKYKEMFVPSLIQLAVEVKNKEEAFLIAAQQLEKMGYVNENYLNGLIAREREFPTGLITKYLNIALPHSECEYVEKPFVFVMQLKNPIYFYQMGDNQEMTVENLFFLGIKEPKEQVGLLQAFMNLFMDETFVENYKKQETPQNIYELITNYI

SEQ ID NO: 7231 - protein, 204 aa, Enterococcus faecium
  misc_feature (B) LOCATION 1...204
  hypothetical: YES
LVKLVGEEAFTVECDVSSDESIEKAMNAIGEYAGEIHGLVHAVAYANKEELSGNVSDISRDGYQLAQDISSYSLIAVSKYAQPFLAPNSGIVSMTYLGSERAIPNYNMMGIAKASLEAAIRYLAAEFSPKGIRVNGISAGAIKTLAVTGVKDYQKLIQLSESRTPDQQGVTIEEVGNACAFLISPLSSGIIGDIIYVDNGVHLS

SEQ ID NO: 7232 - protein, 445 aa, Enterococcus faecium
  misc_feature (B) LOCATION 1...445
  hypothetical: YES
RNKLNTRRSDMSIKKTRLVLLLASLILCLASFLPAVAVQAEDTFKVNAKAAFAVDAQSGKILYDQDGEKTMGIASITKIIGLYIVLDQVKEGKLSWDDKVSISDYAENLSVTPDLSNVPLHKENTYTVKELFDSAIIQSANASMVALAEKISGSEAKFTERMKEQLKDWGIKDATIVNASGLNNSYLGENRPEGTGENDENQMSAQDVAIVARHLILDFPEILDVSSTTTQMFGENTQSPVEMVNWNWMLPGFVNYKEGVDGLKTGTTELAGACFVGTITKNDQRIITVVLNADGHAENPSARFNETARLMDYCYDNWSEKELGKANASIPSLKTIDVXERXESTVPVVLKSPVKVWVRNDMDTGKLTITPTLDKKQVTDNEIQAPMDKGTKIGTATITLAEDKLGYLEDNNAPSTEIITDKTVEKANIFVIGWRRVAEFFGNLF

SEQ ID NO: 7233 - protein, 354 aa, Enterococcus faecium
  misc_feature (B) LOCATION 1...354
  hypothetical: YES
IIKLGGRKMKLWKKLAFTGVSALLLGTLAACGGSGSKDQAEASNSDTLQMYQIGDKPDNFDQLMEVANKRIEKEIGVKVNINYIGWGDYEKKMNVIISSGENYDIAFANNYVSNAQKGAFADLTELAPKYAEKAYNDLDEAYIKGNLVNGKLYAFPVNGNVFAQQVLTFNKALLDKYDLSIDGIQSYADAEKVLKEFHEKEPNTAAFAIGQGFKVQGNFDYPLGNTLPFAIDLDGDDSKIINQYDNETYIGLLRTMHSWYKQGLIPSDAATSNKDYPLEGNTWLMRGETQGPYDYGDTILTNAAKQELVSKAITVPLKSTAQAQMANFVVSNTSKNKEKSVELLGLLNSESYNY

SEQ ID NO: 7234 - protein, 291 aa, Enterococcus faecium
  misc_feature (B) LOCATION 1...291
  hypothetical: YES
LKKLHIESGGEKMKKIIRFVVITFVAIIWLAGCSQGKADTTDKKETIVKLGIIGEDTDVWDNVKDRLKKENINLEYVKFTDYNQPNVALADGSIDLNSFQHQFFLDNYNKEHGTDLVSIGNTVNAPLGIYSNTLKDVADIKDGAKVAIPNDVTNGGRALLLLQTAGLIKVDKAKGQAPTVSDITENRKNLDISELDASQTARALSDVDISVINSGVAVDAGFNPASDAIFLEPVDDHARPYVNIIVARKEDENNKTYQKIVDAYQTEDTVKVIEKTSKGSSVPAWETFGRI

SEQ ID NO: 7235 - protein, 543 aa, Enterococcus faecium
  misc_feature (B) LOCATION 1...543
  hypothetical: YES
GKKLITVNDVSLHFSDRKLFDDVNIKFTPGNCYGLIGANGAGKSTFLKVLSGDLQPSTGSVTMGPDERMAVLKQNHYDYEDYTVLETVIMGHKRLYEVLKEKDAIYMKEDFTDEDGIRAAELEGEFAELNGWEAEPEAAVLLQGLNIPEELHHQQMSELTGGQKVKVLLAQTLFGKPDVLLLDEPTNGLDIQSINWLEEFLINFENTVIVVSHDRHFLNKVCTHMADLDFGKIKLYVGNYDFWLESSQLAAKLQANANAKKEEQIKELQEFIARFSANASKSKQATSRKKMLEKITLDDIQPSSRRYPFVGFKPEREIGNDLLQVENVSVTIDGKKILDDISFNLSKEDKVAFVAENDITTTTLFKVIMGEITPDTGTVRWGVTTSNSYLPKDTTKEFDTDLTILDWLRQYASKEEDDNTFLRSFLGRMLFSGEEVLKPVNVLSGGEKVRCMLSKMMLSKANVLVLDDPTNHLDLESITALNDGLMAFTGSILFASHDHQFIQTLANRIIAVSDKGVIDRADTTYDEFLENADIQKQLNELWA

SEQ ID NO: 7236 - protein, 275 aa, Enterococcus faecium
  misc_feature (B) LOCATION 1...275
  hypothetical: YES
MKKFKWSYLYLGIVFLFLYAPIFYLIFYSFNEGGTMNSFTGFTWENYEAVFEDTRLIIIVLNTFMLAFLSALIATIIGTFGAMGIYYTKKRRARTALLSMNNILLVSPDVIIGASFLIFFTLLGFGLGFQSVLLSHIAFSIPIVVLMVLPKLQEMNDSMVDAARDLGANNFQVVKNIILPYLSPGIIAGYFMAFTYSLDDFAVTFFVTGNGFTTLSVEIYSRARQGISLEINALSALVFLFSMILVIGYYFISKENRPKRLKKNRRVREGVARLR

SEQ ID NO: 7237 - protein, 74 aa, Enterococcus faecium
  misc_feature (B) LOCATION 1...74
  hypothetical: YES
ATFSQPLVHGVPKVASSEISWNFTKIQEVIFVNSFLFLEADYFCHNLFLLLRIWSRNNRFCHPNIRFVPAICIW

SEQ ID NO: 7238 - protein, 174 aa, Enterococcus faecium
  misc_feature (B) LOCATION 1...174
  hypothetical: YES
ETFSKIQMKSEHSNLSVKLSIIDRRKKMRRLKKIRLIFLLGIAFLALAGCKGNGLANEDILERSKSTNEIIWGVKYDTRLFGMMDIESRTVQGFDVDIAKAITKKILGDNGKTEFVEVTSKTRIPLLKNGNIDAIIATMTITDERKKQVDFFRCLFRCWPSFVGKERKPNQKCR

SEQ ID NO: 7239 - protein, 506 aa, Enterococcus faecium
  misc_feature (B) LOCATION 1...506
  hypothetical: YES
RRKFMKKATLVKLGLSFAGILALAACGSSSSNSSSETEDGKAKITWLNILHHASPPTDTIVNLIEEKTDTELTFNWIPDASKEERLTTALASDELGDIVTLQIAMLKNSSVRNALKSGVFWDVSEYLKDYKNLSQISEDRIEAASIDGALYGVPIQKDYARAGLVIRKDWLDNLGLDVPTTMDELYEVAKQFTENDPDGNGVDDTVGFGDRAPSDIRYTSFKLFTSYFGAPNGWAVDDNGKFTPEFDTEEYMKALNFSRDLFENGYLAQDFAVTQKTDQQEQFAQGRTGIYTGMVDIKNLKTMGQGIQDDMELVPVNKISDGEGGGYHVWSEGNGIGGLLAFPKSQVKDEAQLKKLLQFVDDLLEEDVYKLMTGGIEGTHYELNDDGSIEFIDMDLWQQEVQPLSSSRPSEVTFSFKDTDPEKEFSNQLIKENEEFAVMDPSVPLDSPTNNEVGSEIEKIVIDATVQYIMGQLDEDGFKKAVEDWKAQGGDRITQEYEEAYKAAAQ

SEQ ID NO: 7240 - protein, 63 aa, Enterococcus faecium
  misc_feature (B) LOCATION 1...63
  hypothetical: YES
LPFSSCIRSFIYSFVLIKLVFDTFLSGESYNHKALLFSTDSLAASQLEIPELLVDCVVVVVAC

SEQ ID NO: 7241 - protein, 533 aa, Enterococcus faecium
  misc_feature (B) LOCATION 1...533
  hypothetical: YES
TLKFDVKKILLPNLPYLFIFWFFNRVAEGYRLAEGADMVTKAMGAVSGLGALISKNPLPSFYPRDLLLGAVVAVIIRAVVYFKAKNAKKYRHGVEYGSARWGNSDDIKPFINPQFDQNILLTQTERVMVGRNKIPKYNINKNVLVIGGSGSGKTRFHIKPNLMQMNASYIITDPKGTVFLECEKMLQRGGYEIKILNTIDIKQFMKYNPFRYIYCENDILKLVNCIMENTKGEDSKGGEDLWAKAEAFYYQALIAYIWYEAPEEEKNMTTLLEMLNASEVREDDENFKNAVDLMFDALEKRDPQHFAVRQYKKYKMAAGKTAKSILISCGARMAPFDIREVRELMEGDELELEKIGDRKTALFCIVSDTDMTFNFISAMVYTQMFNVLCDKALENGGALKTHVTCLLDEFANQKIPNFQHLISVIRSREISAHIVVQTQSQLKAVYKDHAETIIGNCSCVLFLGGKERSTLKEISETLGKETIDLFNTSDTRGSQRSMGVNYQKLGKELMSTDELAVMDGGKCILHVQSDRLL

SEQ ID NO: 7242 - protein, 90 aa, Enterococcus faecium
  misc_feature (B) LOCATION 1...90
  hypothetical: YES
WSLSCISFVSVSRSVGIPFSWFSLKRLSARSLTLATKKIFTSAFGNTAVPMSLPSMTTPPRSPIFRWTATNSSLTFPCAETSETAFVTSG

SEQ ID NO: 7243 - protein, 97 aa, Enterococcus faecium
  misc_feature (B) LOCATION 1...97
  hypothetical: YES
IMKFFEVKSPYYYALIAAKNEEECAELYEQVVTDIENREEFIRCLHELNRNEAIQEDAKKISEETLQPIGMEEATKDIFTIIDEQKSCVLSIDSTLV

SEQ ID NO: 7244 - protein, 112 aa, Enterococcus faecium
  misc_feature (B) LOCATION 1...112
  hypothetical: YES
EMKLFGKEKRNPLLWWWVEIAHQETMQNAENKKQEQGIKILGSGCAKCMELEKATRTAISELQLDYEIEHITDFAEIASYGVMSTPALVFNGEVISYGKVLTVDEVKALLSK

SEQ ID NO: 7245 - protein, 189 aa, Enterococcus faecium
  misc_feature (B) LOCATION 1...189
  hypothetical: YES
YPKLADYLSNRVDFSRKEQQQSHWHWFTLILFGLMTVATLSQKLILLTLFIAIVALIKGPVMILWGMLYSFLVGLFPPIGILLSAIFFLLNIGTFTKNWRMTLVGIYFYFYPFGVMALSEVMHWDNHWFIAGSLLLGLILLHVMLTKLYQHYGIGRTIFWYVFSIPFALLTALLPSRLKTKIKGYHKIK

SEQ ID NO: 7246 - protein, 72 aa, Enterococcus faecium
  misc_feature (B) LOCATION 1...72
  hypothetical: YES
IWLSTFLHIFSLIPRNWLLNTVYSEQEVVTRLLSQPLCLYSLLFLSELIILFLHFFQYLIIASLVQSVFQFR

SEQ ID NO: 7247 - protein, 76 aa, Enterococcus faecium
  misc_feature (B) LOCATION 1...76
  hypothetical: YES
KWLSTFLHKFGLIPRNWLLNTVYQEFVSLPFNSESQGAISKNSFSGLLTIVTCDRGVCRRTPFKEELVKSAVRPEY

SEQ ID NO: 7248 - protein, 512 aa, Enterococcus faecium
  misc_feature (B) LOCATION 1...512
  hypothetical: YES
TKKLNKARDQSMSFSLEDIRHLLLKENLLKEFVSTRGWHLDVPEKAEFLQLSYDSRKADASTLFFCKGMNFKEEYLDSAIEQGIQYYVSEQPYENSAVGIIVTDIRKAMALLAMAFYDYPQNKLKVIGFTGTKGKTTAAYFTKAILDHTTNKKTALLSTMNTTLDGKTYFKSHLTTPESLDLYRMMSEAVENGMTHLVMEVSSQAYKTQRVYGLTLDVGIFLNISPDHISPIEHPTFDDYFYCKRQLILNSKTVVLNHESDYFDLLRETADLFQIPTITYGRSEESNYQVIRSDKGTHGFTLSSHEDRLAICDTAYDILLAGGFNQENAASAIIAAALTGASSQDAQDGLKEARVPGRMDQLIQSNGAHVYVDYAHNYLSLKTLLKFAKNEHPDGRVIVVLGSPGNKAISRRHDFGKVLSETADIAFLTADDPAFEDPKKIAEEINEAITNPDLIVHYEMDRPEAIRRALAESAPQDSVVIAGKGVDPYQKINGVDEPYEGDYAIVKRLIEE

SEQ ID NO: 7249 - protein, 160 aa, Enterococcus faecium
  misc_feature (B) LOCATION 1...160
  hypothetical: YES
TLISSWTMATMEPAQSPAPRAGRLSRTIPANRWAMAALKPCCGKRRNTWAIPMCGAAPIHPLPLTVPVMFRGSLTTPGVGSVGRQTAQGLYNLCTPVSAVNAQPGDLIFFTGTYSSPGPVSHVGIYVGGGRFIHCGDPISYANTGSPYWSAHLYGYGRIP

SEQ ID NO: 7250 - protein, 594 aa, Enterococcus faecium
  misc_feature (B) LOCATION 1...594
  hypothetical: YES
EKKLNAGEEKMKVYKKLFSYVPKMKYYGWLATLFSDFSVVLTVYGYYSIYKFLQSLIIVGDEYLAKSYAVQTVAWLTLGALFYIFSGLFSHILGFRLETNLRKKGISGLTEASFRFFDLNSSGYIRKTIDDNAAKTHMAIAHLIPDSAQAIVTPVLSVALGFFINFKIGLVLIAMLVIGVFLLKKMTENTNFIQKYQESLDVLSSETVEYIRGIQVIKIFGAKVTSFKALNKAINDYAKFAYKYSLSGKTPFVLFQWLFFGIVCILIVPITFFITSLTTPKILAVDLLMLFFLSGIIFVSFMRIMYVSMHLFEARYAVETLDSLYLEMKQDQLKYGNETQIKNCDIAFENVSFSYKEECVLENFNLVLEQKRIYALVGKSGSGKSTIAKLISGFYNVDKGQIKIGGKPLNHYSKDTIINTIAFVFQDTKLFNQSIYDNVSIANPQAPASKVFDALRLAGCESILEKFPEREHTLIGSKGVYLSGGEKQRIAIARAILKDAKIVIMDEASASIDPDNEYELQKAFQYLMKEKTVIMIAHRLSSIKSVDEILVLSEGKIVERGNHNELMAKHRVYKQLVTNYENANDWRLDNEKFL

SEQ ID NO: 7251 - protein, 100 aa, Enterococcus faecium
  misc_feature (B) LOCATION 1...100
  hypothetical: YES
AVISTGSMIVVYFLARSAVPMSKTTNRTDKTAVDFFLINLNNSCFTSNVIFLLPPLLNPEFPIEKIPNHSSDAGRLSHGYFVQTIAGSRFLIILRFLLKA

SEQ ID NO: 7252 - protein, 664 aa, Enterococcus faecium
  misc_feature (B) LOCATION 1...664
  hypothetical: YES
PSISSKNKRNEKYTFRRCWYGIRKLCNLVVYQKKNRSEKMKNHKKINVMLGVLFLILPLLTNSFGAKKVFAEETAAQVILHKKKMTDLPDPLIQNSGKEMSEFDQYQGLADISFSVYNVTQEFYAQRDKGASVDAAKQAVQSLTPGTPVASGTTDADGNVTLSLPKKQNGKDAVYTIKEEPKDGVSAAANMVLAFPVYEMIKQADGSYKYGTEELDTIHLYPKNTVGNDGTLKVTKIGTAENEALNGAEFIISKEEGTPSVKKYIQSVTDGLYTWTTDQTKAKHFITGHSYDIGNNDFAEASIEKGQLIVNHLEVGKYNLEEVKAPDNAEMIEKQTITPFEILANSQTPVEKTIKNDTSKVDKTTPQLNGKDVAIGEKIQYEISVNIPLGIADKEGTQNKYTTFKLIDTHDAALTFDNDSSGTYAYALYDGNKEIDPVNYSVTEQTDGFTVSVDPNYIPSLTPGGTLKFVYYMHLNEKADPTKGFSNQANVDNGHTNDQTPPSVDVVTGGKRFVKVDGDVTSDQTLAGAEFVVRDQDSDTAKYLSIDPSTKAVSWVSAKESATVFTTTSNGLIDVTGLKYGTYYLEETKAPEKYVPLTNRVAFTIDEQSYVTAGQLISPEKIPNKHKGTLPSTGGKGIYVYIGAGVVLLLIAGLYFARRKHSQI

SEQ ID NO: 7253 - protein, 158 aa, Enterococcus faecium
  misc_feature (B) LOCATION 1...158
  hypothetical: YES
WTISTTLAERFYFIMRLYHLRSLEELRKLDFNKKFFWEISDLSCFVESERLSNGNNSVLNEYDKVVINKVKSLCEEARESISHINGSNFKQTLFNLIKLDAKISSYLFFLIHDEFMDYQKLDQLIERESWEDYYVGLTFSEKLNNYKLIDYKYLSESN

SEQ ID NO: 7254 - protein, 212 aa, Enterococcus faecium
  misc_feature (B) LOCATION 1...212
  hypothetical: YES
VKISKFYVRSYLMTKNIFDSIANHYDSPDRQALAKIIREELTTYLPRDSHQKVLLDYGGGTGLVSLPLAERFKELIIADASETMLKMAEEKIQAADLKNVRTIHADASVEFPAVQANLILLSLVLLHIPDTENILTKLYEILAPGGQLIIVDFDKNEQISHPKVHNGFSQEELNNRLEKTGFVSATSHTFHRGEKLFMNKNASLFLSISQKA

SEQ ID NO: 7255 - protein, 134 aa, Enterococcus faecium
  misc_feature (B) LOCATION 1...134
  hypothetical: YES
EGISLAQVQYIGTGRRKNAVARVRLVPGTGKITVNKKDVEEYIPHADLREVINQPFAVTETKGAYDVFVNVNGGGYAGQSGAIRHGIARALLEVDPDFRLALKRAGLLTRDARMVERKKPGLKKARKASQFSKR

SEQ ID NO: 7256 - protein, 62 aa, Enterococcus faecium
  misc_feature (B) LOCATION 1...62
  hypothetical: YES
ALISVTTPAPTVRPPSRIENLVPFSIAIGWINSTSIVTLSPGITISVPSGNSTTPVTSVVRK

SEQ ID NO: 7257 - protein, 67 aa, Enterococcus faecium
  misc_feature (B) LOCATION 1...67
  hypothetical: YES
RMISMARPRKYNTEEERKEAMKKARKKWVEKNQETIAYIRAKSLAKKFIEMWADEDIALIGDRYIRR

SEQ ID NO: 7258 - protein, 616 aa, Enterococcus faecium
  misc_feature (B) LOCATION 1...616
  hypothetical: YES
DNVSRKEINLSFEENRSKMARERSGKMNDLLKQYFGYDEFRPGQKEIIQKVIDQENVLGIMPTGSGKSICYQLPALLLDGLTVVVSPLISLMKDQVDAANQLGIPATFINSSLDGYETARRFQEIDRQQYRLLYIAPERFIMPDFIQAMKRWNVRMIAIDEAHCISQWGHDFRPSYLQMANQLDQLPNRPVIVALTATATVQVAADIKRLLKIPENNHIQTGFERENLRFQVIKDQKKEQYLIEYLKINKNQSGIIYAATRKEVDRLYHLLKKFDFSVGRYHGGLNENERTEMQEAFLYDRLQLIVATNAFGMGINKSNVRFVIHYQIPGSLEAYYQEAGRAGRDGLSSEAILLFSPQDIQVQKFFIQQSQREEGQKQKEYEKLKAMTEYVYIESCLQQYILNYFGETSSPCNRCGNCLDDREIVEVTTEAQMVLSCLKRMGENYGKQMLMKVLAGSKEQKLQALGFGHLSTYGLMKNQSQKETMQLIEYLISNGYLLTINGEYPVLKVTERGIQVLKGQESVYRKEPKKVQQLSDEETDTLFEVLRELRTDLASEAGVPPYVVFSDSTLKEMSRIRPSSRLEMLQIKGVGQSKLDKYGEAFLCRIKNADSNVLDK

SEQ ID NO: 7259 - protein, 87 aa, Enterococcus faecium
  misc_feature (B) LOCATION 1...87
  hypothetical: YES
RNVSRDSSVSSSSTVLMIRAGFPAITTLSGKDLVTTEPAPTTTLSPRVTPGVTITPPPNQTLLPILMGFAYSRPLLRFTGCSGCVAV

SEQ ID NO: 7260 - protein, 167 aa, Enterococcus faecium
  misc_feature (B) LOCATION 1...167
  hypothetical: YES
YTVSVVFIRKKGSFLLKYFFDHQLIHYPDKEITDWREAIAESCLVLIDKEIIDETYVEEIIHCVEKYGPYIVIAPQVAMPHSSEKSDGVFGTAISFTKLKQPIRFESEGENEEKTASLFFTLAAKDPEEHLENIQKLSELLMTDGLVERLISTNSIDDYQVVMAEYN

SEQ ID NO: 7261 - protein, 199 aa, Enterococcus faecium
  misc_feature (B) LOCATION 1...199
  hypothetical: YES
VSVSCFIFKSCFLSIVRKKRFLKRRNNMLRLIAKIDDSIINKFAKQRKTDSRKINFLKFISNISNGGFIWLLLAAVLVLIPDTREYGLAILIGSLIYFFVGLLFIKKTTRRKRPYEKNRRLVLYTSKPKTSSFPSGHTALAFLSVAALFELSPVAGILAFLFACLIAYSRIFLLLHYPTDILGGAILGSVIGILCAAVI

SEQ ID NO: 7262 - protein, 165 aa, Enterococcus faecium
  misc_feature (B) LOCATION 1...165
  hypothetical: YES
MKVSLIAAMDKNRVIGKENDIPWRIPKDWEYVKNTTKGHPIILGRKNLESIGRALPDRRNIILTRDKGFTFNGCEIVHSIEDVFELCKNEEEIFIFGGEQIYNLFFPYVEKMYITKIHHEFEGDTFFPEVNYEEWNEVFAQKGIKNDKNPYNYYFHVYERKNLLS

SEQ ID NO: 7263 - protein, 78 aa, Enterococcus faecium
  misc_feature (B) LOCATION 1...78
  hypothetical: YES
FFSSNLYVPSCKSPPATTFADDAVVLFAVEDCAVDDSEEEFELPLSSAPQAPNTRAENANTANPVTKRFFFILIPHHS

SEQ ID NO: 7264 - protein, 160 aa, Enterococcus faecium
  misc_feature (B) LOCATION 1...160
  hypothetical: YES
TISSWKATNSLIASKPNSNAPSMSSSETSFAPLSTILMACFVPATVNSISVCSACSTVGFKTYSPFTRPTSTPAIGPSNGISEIDSAKEEPSIAAIAGEQSVFTLITMFVTWTSLRKPSANIGRIGRSIKRAVNVASVLGRLSRLMKPPGIFPAAYIFSS

SEQ ID NO: 7265 - protein, 499 aa, Enterococcus faecium
  misc_feature (B) LOCATION 1...499
  hypothetical: YES
ISSSNLTLSEQEKVIAKPILKEVNDRLSFLENVGLDYLTLSRASGTLSGGEAQRIRLATQIGSNLSGVLYILDEPSIGLHQRDNDRLIGSLKKMRDLGNTLVVVEHDEDTMWAADYLIDVGPGAGEQGGQIVAAGTPEEVANDENSLTGKYLSGKKSIPVPKERRKGNGKAIKITGASENNLKNISVEFPLGEFVAVTGVSGSGKSTLVNSILKKSLAQKLNKNSAKPGKFKTISGYESIEKIIDIDPSPIGRTPRSNPATYTSVFDDIRGLFAQTNEAKMRGYKKGRFSFNVKGGRCEACRGDGIIKIEMHFLPDVYVPCEVCHGKRYNSETLEVHYKGKSIADILEMTVEDAVEFFKHIPKIHRKLQTIVDVGLGYVTMGQPATTLSGGEAQRMKLASELHKISNGKNFYIIDEPTTGLHSDDIARLLHVLQRLVDAGNTVLVIEHNLDVIKTADYIIDLGPEGGEGGGTILATGTPEEIINVKESYTGHYLKKIMV

SEQ ID NO: 7266 - protein, 402 aa, Enterococcus faecium
  misc_feature (B) LOCATION 1...402
  hypothetical: YES
HLEFGGENLAQRNLDYRLLKDRRNEYGVSQNKLATACGLSRPYLNQIENGGVTASIKTMRKIFDQLESFNPDLPLTLLFDYVRIRFPTTDARKIIQEILHLKFEYMLHEDYAFYSYQEQYVMGDIVVMLSHEEDKGVLLELKGRGCRQFETFLLAQKRSWYDFFEDCLKAGGVMKRLDLAINDRVGLLDIPELTKKCQKEECISLFRTFKSYRSGELLKADEKDGMGNTLYIGSLKSEVYFCLYEKDYEQYIKLGIPLDQTETKNRFEIRLKNDRAFHAIQDLLKGRSIESTTFSIINRYLRFADKVEGKRRTNWPLNEQWGRFIGRNRKEIQLTSEPKPYAIERTLNWLGRQVAPTWKMAKELDRLNRTTYIQDMVQNARLSDRHKKILEQQSMAIENLII

SEQ ID NO: 7267 - protein, 457 aa, Enterococcus faecium
  misc_feature (B) LOCATION 1...457
  hypothetical: YES
LISSIRRNKMQIYDYIVIGGGSGGIASANRAGMHGAKVLLIEANELGGTCVNVGCVPKKVMWQASTILETIERDASSYGIQADLKNVDFAGLVERREKYIDFLHGAYQRGLDSNHVEAIKGYATFIDSQTIEVNGETYRAPKILIATGGRASKMTIPGGEYAIDSNGFFELTELPKRAIVLGAGYIAAELSGVFRGLGSEVMWAYRKERPLRTFDKMLSDNLIQMYQEAGIKTYAHHIAKEITKNNDEYTVLFENGETLTGDCVLFAGGRVPNTEKLGLENTNVELDKKGFIKVDKYQNTTDEHIFAVGDVIGKLDLTPVAIAAGRRLSERLFNGKKDSYLDYKLVPTVVFTHPPIATIGLTEEEALEKYGENELKVYRSRFTPMYFALNDYRQKCEMKLICVGKEERIVGLHAIGVGVDEMLQGFAVAIKMGATKEDFDNTVAIHPTGAEEFVTMR

SEQ ID NO: 7268 - protein, 465 aa, Enterococcus faecium
  misc_feature (B) LOCATION 1...465
  hypothetical: YES
LVEFIRQQIVFGGYIMGIRSHFAIAVGKTSQWALKTFFKGGSSLPGKLALKVDPHILDSLAKDYQVVVVTGTNGKTLTTALTVNILRQQFDEVLTNPTGANMVQGIVSTFLQAKPKKGQKKFAVLEIDEASLSKVTEYMKPELFLFTNIFRDQMDRYGEIYTTYKMIVDGAAKSPNATIISNGDSPIFNSIETVNPRKYYGFDHEEDREQMAHYNTDGVLCPNCHHILHYKMITYANLGKYYCPNCDFKRPELDYRLTDMVRMDNVSADFVIDGHEYGIEVGGMYNVYNALAATAVAEYFNVDPDKIKQGLGYDEKVFGRQEVININGKKCTLVLVKNPVGINQVIDMIGLAPYPFSLVALLNANYADGIDVSWIWDGNFENFADMDIPAVISGGDRHTDMTLRLKVAGIPENKLTETKELPEVIEKIKELPTEHVYILATYTAVLQLRKELAAQGFIKGGMNRG

SEQ ID NO: 7269 - protein, 139 aa, Enterococcus faecium
  misc_feature (B) LOCATION 1...139
  hypothetical: YES
RNSSIPKTNRLRETTNASVKNKPIEVFKWKYFLKMRGGIVVPPLEELFLYKIATPKAKIALPKMTDNNRSEVIIVSGTIAMIKGKNKLPKSTLKKGFLPKNRRASTNITIFNTKITIARSNPKTASSNIPRPLTPPAAI

SEQ ID NO: 7270 - protein, 139 aa, Enterococcus faecium; identical to SEQ ID NO: 7269
  misc_feature (B) LOCATION 1...139
  hypothetical: YES

SEQ ID NO: 7271 - protein, 133 aa, Enterococcus faecium
  misc_feature (B) LOCATION 1...133
  hypothetical: YES
TKSSISLIIRKEVKYMKKLIGVLVVLGIFLGGSFAAYHYFYGGEAYYTKITTNGEMSATQADNGEKFTTYTYKQAAYNKDGEKKQVTLREEREHPLKMNAYLKLKVNPRKGVLSWEEIKASEVPKNAAEKIDN

SEQ ID NO: 7272 - protein, 342 aa, Enterococcus faecium
  misc_feature (B) LOCATION 1...342
  hypothetical: YES
LLSSPPRLPLAPRGVPGPPCLSWWLRLEAALPAGRCLGFVCRPPRLCAYDXLYYGINVSNLTVEKANEKLKEAYSDKKLAIKEDGKVWQEVPKSELGYKDDFTSELSPILNEQNGWTWGMTYVSAAEKQEIDPVSQNHQKLDTTVQTLTTKLTDLNKDRTPTTDATIEKAGDSFVIKPEVNKKYDRVDAAVKQLKSAVNSGKDTIELTEFKEKPKVTSEDSSLKEQLASMNAIANVKATYSINGETFQIPSSDIMSWLTYNDGKVDLDTEQVRQYVTDLGTKYNTSTNDTKFKSTKRGEVTVPVGTYSWTIQTDSGDRSIEKSDSGRPRFYSFTHCARWHNR

SEQ ID NO: 7273 - protein, 101 aa, Enterococcus faecium
  misc_feature (B) LOCATION 1...101
  hypothetical: YES
PDPLVNIRTSQRWRCLQNHPTKTEYQGVFLAQEQKLVPVTMVQINKANQFIFLFEHGKAPLAMKDIFLFLMKNREKAVYYQSKQELIPLYGVKEIENKVVI

SEQ ID NO: 7274 - protein, 312 aa, Enterococcus faecium
  misc_feature (B) LOCATION 1...312
  hypothetical: YES
KSEFILKKKKKSKAGEYSGMKGMERTMTIQWFPGHMAKARREVSEKMKYVDIVFELVDARLPLSSRNPMLDQIIQQKPRLVLLNKADLADPQQTKLWQEYFRKQGHLALAITAQESKGIKGLVPAAKEALKEKRARDAARGIKPRAIRAMVLGIPNVGKSTLMNRLVGKKIAQTGNKPGVTKGQQWLRLGNELELLDTPGILWPKFEDEEIGKKLALTGAIKDQLVHLDDLAIYGLDFFARYYSGRISDRYGLSIEQEEKLAPELLMDITAKRGYKEDYDRGSELVVHDIRQGKLGRYTLDRCEEMEQKSDD

SEQ ID NO: 7275 - protein, 61 aa, Enterococcus faecium
  misc_feature (B) LOCATION 1...61
  hypothetical: YES
SLPSGLXNDYYEKLIQLASDEGVAVVLDCSGAPLETILKSSVKPTAIKPNNENFHSCLEKK

SEQ ID NO: 7276 - protein, 74 aa, Enterococcus faecium
  misc_feature (B) LOCATION 1...74
  hypothetical: YES
LSPSNKSSSIAMEVNTCPGCRVNCSAIAVWIVCARIQLMAILLTYVDFPDALEPVTNVFFCQLTGLTTASFNNG

SEQ ID NO: 7277 - protein, 644 aa, Enterococcus faecium
  misc_feature (B) LOCATION 1...644
  hypothetical: YES
RLTSIRTVGISYLVVKRGENTMKHPVPLLRTRQDYFDLFKKINQPLQPFYRASGAQIDYIHQGVGYGNKIAGMEGFSRVLWGAGPAIDQLDERWLKLILSGIKAGTDPSHPDYWGEIHERDQRMVEMPAMLLALYHHEQLLWKKLDTGEKSQIIHWFSQIFEYECADGNWQFFKIIVGTIIQKFGYPVKESALKEAFDNIENCYLQNGWYRDSSRGRQDYYNPFAFHYYGLIYSVLEPEKPISQIYKNRAIDFSRDYIHFFAEDGANVPFGRSMIYRFAVSSFWSAMLWADLLPFKLGEIKGLVNRNIRWWMQKEIFDEKGILNIGYTYPQLTLTEPYNSTLSPLWLNKIFLLLALPEDHEYWTAKEMPMPIREGTKLLSEANLLIQHDNGHTFFLNAGQLGPNFHTLTNEKYLKFAYSSQFGFSIPRANQLKAEMAMDSMLGIQRADTYITTSFKNESIKTYGQFIVRNNVRDIVCKKEVLASTWEPTLQAKIRTWLIPFEGWQIRVHKVELDTEYVLYETGFAIECSPEKEGIIIEEDKENYRVSEAGFSGIICLSDDTIKRKSTAIMGLPNTNLMTWENTFIPGLEGTFGKGTHWLGTGVVAHQDRDYSLEVWNNRPKIDFDGTTGLTIQNKNNKKRLKLC

SEQ ID NO: 7278 - protein, 81 aa, Enterococcus faecium
  misc_feature (B) LOCATION 1...81
  hypothetical: YES
MITSVEITKKYQQSVRELVALAVQAGVPVPTFSSAIAYFDSYRAERLPANIIQAQRDYFGAHTYERVDKEGIFHYSWYHEE

SEQ ID NO: 7279 - protein, 64 aa, Enterococcus faecium
  misc_feature (B) LOCATION 1...64
  hypothetical: YES
KFELKSENMWELIYLVLYLIGKSTEFVYNNKVIFILFLIVCIIVFDVYDLLIHKNENSNIGRIR

SEQ ID NO: 7280 - protein, 350 aa, Enterococcus faecium
  misc_feature (B) LOCATION 1...350
  hypothetical: YES
METSQKISPKIFLNKVLAGTATGIIIGLIPNAVLGAILKYFSAYPFAVTIAQLAVIFQLATPLIIGGLIALQFGFDPMRMMVVAGASFVGSGVIKFTPDLGETGVYVGAGTGDIINTMLTASIAVGLILLIGNSFGSVSIVLTPIVVGVGAGLLGFYLFPFVTAITSAIGSLINNFTTLQPLLMSILIGCSFAFLIISPISTVAIGMAIQLDGVSAGAAAMGVAATTFVLVVNSWKVNKSGVTIAIALGAMKMMMPNLFRKPVILIPCLVSAVITAIPVALFSISGTPASAGFGVVGLVGPLASLDAGLNGFLVVLCWLVIPVFAALITQFLCEKVFKLYDREEVFKFLG

SEQ ID NO: 7281 - protein, 107 aa, Enterococcus faecium
  misc_feature (B) LOCATION 1...107
  hypothetical: YES
APTSNAASSPYSRIRSSISLRDFSTISSIRAGWIRPSCISFSKVIRAISLRIGSNPERTTASGVSSMIKSIPVSVSSVRILRPSRPMIRPFISSFGRVTTETVVSET

SEQ ID NO: 7282 - protein, 483 aa, Enterococcus faecium
  misc_feature (B) LOCATION 1...483
  hypothetical: YES
RHELCQAQNFYWVIHSKPLMSKDDSLMKNKSQNYVNYSKISYSLSQSLVNCNMRTKQINVKPKAFHGKRFNRGEQTKMKLIGIVGSAAELSYNRKLLTFIQKQYHELFNLEIIEIKDLPLFNQDDDQTNSPAIQQLNRKILMADGVIIATPEHNHTVPAGLKSALEWLSFKIHPLENKPVMVVGASYYDQGTSRAQLHLRQILDAPGVNALVMPGNEFLLGKAKEAFDQEDRLIDPRTVDFLGSTLASFVKFIKVVSTLAGPKKLPPEDLHATGTIATTIPDVDMSDDHWLEKASEAVGAVSGNTYVKLNRGLLTVDQINYFLDSMPMELTFADNNNQFLYYNLRQEAKEMLAARVPGQVGNPLANCHPEKSYKNVEWVIQQLRSGATDAVRVHVPKQVPEKYIVHNYQAMHDENGEYAGINEYILDFKPIIEWYLQQTGQQLVGNEDAVSSASVHGGKTDAVTSASTHDETAVDAVSSASVK

SEQ ID NO: 7283 - protein, 132 aa, Enterococcus faecium
  misc_feature (B) LOCATION 1...132
  hypothetical: YES
FSASAPILPARFCVAVRGYPAGRSAMQGQCAPAPLSAGLSAKCGRVWSGGGSVPRRRTRPAPCSATISILWADSRATLSRSYSRSLPCSFKTAAVFAAFPAREDREGFWYSGRISSSKRSRRFIFPLASSGW

SEQ ID NO: 7284 - protein, 300 aa, Enterococcus faecium
  misc_feature (B) LOCATION 1...300
  hypothetical: YES
MGASLNEIKTRIASTKKTSQITRAMQMVSASKLTKSEASSQKFQVYATKVREIVTHLTATQLNDIASENPRGDINYNSMLLSRPVKKTGYIVITADGGLVGGYNSSILKQTMSILEEDHQSPDDYVMIAIGGTGADFFKARGINLAYELRNLSDQPSFDEVRKIVNMATTMYQNEVFDELYVCYNHHINSLTSQFRVEKMLPISDLDPEEATTFEQEYIFEPSKEEILSQLLPQYAESLIYGAIVDAKTAEHAAGMTAMKTATDNAANIIDELTVSYNRARQGAITQEITEIVAGASALE

SEQ ID NO: 7285 - protein, 139 aa, Enterococcus faecium
  misc_feature (B) LOCATION 1...139
  hypothetical: YES
KGEFFNYKKRCVFTMGKLVAVAQSLLDILKWLMEGSNWIFVLPLLLISLFIMFRMVRKKETFLIFIWYAASVGVATLMVELALGSWEACVFALFFAVLYLIIYIPYMKRKSRIGRKGRHTTTFSSTDSLEQSRRTRRRR

SEQ ID NO: 7286 - protein, 171 aa, Enterococcus faecium
  misc_feature (B) LOCATION 1...171
  hypothetical: YES
MSEFFIQEKQLGRATRTIVKNEKGHSLFLMVGRWGTKGDALSLYAMNGDLVAHIKQISLTFGTRFELYKEFEKVGTMQKIFNWPGDFYYIRRLHWTVQGDIYNHQYQIHHFNQQIMKMDKATLFSGDYYVLDVSNDEDAPVCICIAAVLDYWLYRKDKSRDKPVSYRLNLS

SEQ ID NO: 7287 - protein, 314 aa, Enterococcus faecium
  misc_feature (B) LOCATION 1...314
  hypothetical: YES
MTELITIKDLKVHYPIRSGFFNRVTDHVYAVDGVDFIIEKGKTYGLVGESGSGKSTTGKAVVGLEKVTAGQIMYEGKDVTKRSNRKKMGYNKDVQMIFQDSMSSLNPKKRVLDIIAEPIRNFERLSDQEEKKKVKGLLDIVGMPEDALYKYPHEFSGGQRQRLGVARAVATNPKLIVADEPVSALDLSVQAQVLNFMKRIQQEYGLSYLFISHDLGVVKHMCDNIAIMYKGRFVEIGTREDIYNDPRHIYTKRLLSAIPQIDVENRESHKENRRRVEQEYIQNQKEYYDATGRVYDLRTITTTHKVALKDGGAS

SEQ ID NO: 7288 - protein, 284 aa, Enterococcus faecium
  misc_feature (B) LOCATION 1...284
  hypothetical: YES
MAELINGKELAEKMQAEIAEKIQKLKDNGIHPGLVVLLVGENPASQIYVRNKERVAKEIGIHSLVERYPETISEDELLAEIEKYNQDPSFHGILVQLPLPKHIDEEKILLAIRPEKDVDGFHPMNLGRLLAGKPDKIPCTPYGIMKMFEAYSIDPAGKRAVVIGRSNIVGKPMAQLLLMADATVTVAHSKTENLAELAQEADILVVAIGRGHFVTKEFVKPGAVVIDVGMNRDANGKLIGDVKFDEVEPIAGWITPVPKGVGPMTITMLMYQTVKSAEAFGAGE

SEQ ID NO: 7289 - protein, 60 aa, Enterococcus faecium
  misc_feature (B) LOCATION 1...60
  hypothetical: YES
TKELILWQSSNDRNRKERGYARVNQQVNWVNDFEKEFRLKFFGNPTAESTEEKNYDWSEF

SEQ ID NO: 7290 - protein, 179 aa, Enterococcus faecium
  misc_feature (B) LOCATION 1...179
  hypothetical: YES
YLYSIGLVSTKNERRKINMERFIASNATVIGDVTLSEDVTIWYQAVLRGDSNWIKIGQRTNIQDGTIIHVDHDAPVDIAENVTVGHQCMLHGCTIEKGALIGMGTTILNHAVIGENSLIGAGSLVTEGKVIPPNVLAFGRPAKVIRPLTKEEIQKNKENIQHYVEIGRMHAQGKFKEQR

SEQ ID NO: 7291 - protein, 213 aa, Enterococcus faecium
  misc_feature (B) LOCATION 1...213
  hypothetical: YES
SIYSEKGVTMSEIADLIEKMYGHHYTPQTMSNMTKVLTEEVNAFKSRALNDKYVAIFMDATYIPLKRQTVSKEAIYIAIGIREDGTKEVLSYAIAPTESTYVWNELLQDINSRGVQEVLLFITDGLKGMKDTIHQIYPKAKYQHCCIHVSRNIAHKVRVKDRKEICDDFKAVYQANSKEEANTFLSGMIEKWKKNYPKVTQSLNRKPRLINFL

SEQ ID NO: 7292 - protein, 145 aa, Enterococcus faecium
  misc_feature (B) LOCATION 1...145
  hypothetical: YES
WDYSQGTPISIQLRTKVKQQGEVQDFYFDLKGQMVTIGDTLYIRYIEIQEETGDEIPVTIKLVPDGHVQLIRAGEMRMRLKFGYIERLETSYRTPYGMIQIATFTKELHVSLKDHPTGGKVRIDYDLFMGPEKIGEYYLTLDFTA

SEQ ID NO: 7293 - protein, 656 aa, Enterococcus faecium
  misc_feature (B) LOCATION 1...656
  hypothetical: YES
KGELNMIVSKKLARNLVSEGYDLRLVEKYQPSGGIKFDERYISTGDGYVTSIAVIEFAEDVNSRWLTDIMAIPNTIATFDVCTADKEDLLHKINTSIGELDYRSTNENRTTDKTDALLDKYNLEDFAQEITKRGEVVKTVHARIFVYSDSLEELEKRISEIRKDLASVNHKAIVPQFRMKDEWMSLFQDGMEQESKLFAKKGLTVPAKNIGGGIPFHHKSLKDPRGFYLGTTSTGGAFIFDPFYSTKQRRSFNGFILGKMGFGKSTLIKQLQEGLQAKNCFIRGFDKSGEFEGMVKKAGGVYVDLGGGDMVVNPLQIYATVMKKDQFGNDVVDESKSFQNHITKCSNQIRFLEPEIDTATVREYTLMLQDFYIHYGILPKEWREARDDNERNQLNTNICNLPNDSYPIYGEFLKFIENQQFKIKNATPERVRSIELIKLIVTDMCTTYPQIFNGVTTMPNFDTTKIVYYNIDSISKMSAPVFHCQLFTALTTIWNSALQNGKIQKENFKKYGSDYYKYAQDFMVLIDECHNVINSNNKYACEYVLSFEREMRKMRAGVYFATQTPEEIIPKDSGSEVADVIRNIFNLCTFKCFFNLDSALLEDIKKVLGNTITDTEIMLLPELEVGQAVVQTSSEDTYMINFDPYPEQIERFDGGQ

SEQ ID NO: 7294 - protein, 480 aa, Enterococcus faecium
  misc_feature (B) LOCATION 1...480
  hypothetical: YES
LMYSLMKKIITEKDIRRHVSLVEQLLNHTKITVNELAEIIGTTERTIFSDLQSIRSQLPEGWDIISDQAGISLQNQQNLLTNDLWEIFFKQSVSVELLKNLLFTKKVAVPDFLADHGLSYGTLKRHVTKINQRLASYDLQIDLTKYTACILGKERAIRTFYHRLLIPFTHNNYFFEDYSIHESHYFQFLRNLSQTELAVETEEIFGTCWFFINTIRIKANCRLDSSIHTNSTLSSLYDSALKKLYLTEGIYLKDTELSFASFCFLESWNYNNNYGQETARCLHHSPFLEVLETFVEELASELSLDQLKKTSLTDNLALLILKYHESPILIEALDRQYHRFLETYDQQYAHLYQQKENLLNDLKKEIEINEPNYFLQLLSLLIQQTIFSIKPNLFNVYFIFQGEPSWKAFLQQELKDYLGKRVCFLPIELTDLSTISFEKTDILISNFPLDSLDIPIVYISSIPTKNELNRLTELTFKTFL

SEQ ID NO: 7295 - protein, 414 aa, Enterococcus faecium
  misc_feature (B) LOCATION 1...414
  hypothetical: YES
DMEFSIDNNINDGAVIKVIGVGGGGGNAVNRMIEENVKGVEFITANTDVQALKNSKAETVIQLGPKYTRGLGAGSQPEVGQKAAEESEQSLREALDGADMIFITAGMGGGTGTGAAPIVAGIAKELGALTVGVVTRPFTFEGPKRGRFAAEGIARLKENVDTLLIISNNRLLEVVDKKTPMLEAFREADNVLRQGVQGISDLITAPGYVNLDFADVKTVMENQGTALMGIGVASGEDRVVEATKKAISSPLLETSIDGAEQVLLNITGGLDMTLFEAQDASDIVANAATGDVNIILGTSINEEMGDEIRVTVIATGIDESKKERKSSRPARQAQMQSPAQKTVLDMDQAKPTSSEEENSFGDWDIRREQNVRPRVDDSNFDNIEKKEFDTFNREETKSHGDDELNTPPFFRRKK

SEQ ID NO: 7296 - protein, 70 aa, Enterococcus faecium
  misc_feature (B) LOCATION 1...70
  hypothetical: YES
QRHSPLLFLFLLFHDCSRRPSNYPTLFRIYPKVAEVRRQKKDNQFVVGIKNDRAVLPAKDMFLHTRLDFV

SEQ ID NO: 7297 - protein, 188 aa, Enterococcus faecium
  misc_feature (B) LOCATION 1...188
  hypothetical: YES
YTHSIDHCQYLNFYFHFLLVILHDFWYDKNKGINTSLLFMTRRNMMKKIVGADEWIRAASCFLRYQVFVLEQGIPAELEFDGKDIPQQTYYLFLDQKRPVATLRYEKKTPTCFKPERFCVAKEYRGKGLGGQLLEAAEKRAVSEGCQTSYVVAEMTAVDFYEKQGYHTCTEPFIEDEVLCIGMKKSLA

SEQ ID NO: 7298 - protein, 340 aa, Enterococcus faecium
  misc_feature (B) LOCATION 1...340
  hypothetical: YES
IQHSKNGQRRNRSMRAISIKHPGSVDVLEQIEVPVPKPKQGELLIKVHTAAVNRTDIMKRESVSLKPPYPILGVEVAGEVVENKSDISTFTPGTKVYGLVNLGGYAEYAVMPADRAILLPDTLDYVSAAGISEVFLTAYQTLYWLGKLQEGETVLIHAGASGVGTAAIQLARQLSHAKIIVTAGSEEKLAFCKELGADELINYKKQDFQEEVRKITEGRGVDVILDFIGASYWEKNLASIAVDGRWVLIGMLGGTIVPEIDLGVLIGKRVQLLGTLLTPRSDQYKAELAQTFMQKAGPFLENGKIRPIIDRTFQFSAVKQAHEYMEANKNIGKIILKITE

SEQ ID NO: 7299 - protein, 532 aa, Enterococcus faecium
  misc_feature (B) LOCATION 1...532
  hypothetical: YES
GGHSMVKRPAKLFHKHRLIEHTNGLSLAEVNGTVDVPKGKSFFKTLLAYSGPGALVAVGYMDPGNWSTSITGGQNFQYLLMSVILMSSLIAMLLQYMAAKLGIVSQMDLAQAIRARTSKTLGVILWILTELAIMATDIAEVIGAAIALYLLFDIPLVIAVFITVLDVFVLLLLTKVGFRKIEALVVCLIFVILFVFVYQVGLSNPDWHSLFAGFIPNSHTFSDSPVIGGETPLTGALGIIGATVMPHNLYLHSAVSQTRKIDHQNEEDVAQAVRFSTWDSNIQLSMAFLVNALLLIMGVAVFKTGSVQDPSFFGLYEALSDPSAMSNGILIAVAKSGILSTLFAVALLASGQNSTITGTLTGQVIMEGFIHMRIPIWLRRLVTRLLSVIPVLICVLFTSTKGTIEEHAALNNLMNESQVFLAFALPFSMIPLLMMTNSQAEMGSRFKNSFIVKLLGWFSVISLTYLNLRGLPGQIESFFGEQATSAQLALADHIAYVIIVLVLLLLAWTIGDLYKGNKKYEQLLQETVEEIE

SEQ ID NO: 7300 - protein, 141 aa, Enterococcus faecium
  misc_feature (B) LOCATION 1...141
  hypothetical: YES
VKELKKQSNVILGFVLVLIIVLFAVLNNKNVPVSFGFTSFSAPLILVIIGSALIGALIVFLTASATLWQQKKQIKQLTQEMSEYQTELQKKIEEAKEEQQREFRNERAELEAAYQAELQAKTAQTSQLKVAGRTIIAKIAP

SEQ ID NO: 7301 - protein, 270 aa, Enterococcus faecium
  misc_feature (B) LOCATION 1...270
  hypothetical: YES
KEEFAMKVSQKIILSILLLLTLVVGYFSIEFIHGFSSAKQSSTVKKVEPKSVPTTLNVALIGSDARSKDENGRSDSLLVAQYNQKTQQAKLISIMRDSYVDIPGYGMNKINAAYSYGGVDLLNQTLKENFKFEAPYYASITFQDFIDCVNELFPGGVKIDAEKSLDLDGVYINKGEQVIKAISQQLKDVTSIFKLPKAVGKLLGSIQTNLPESVLLDCGMDFLKDNNKKIDTLSVPVDGSWDFNDNTPSGSVLELDLTKNQEAIKKFLNN

SEQ ID NO: 7302 - protein, 225 aa, Enterococcus faecium
  misc_feature (B) LOCATION 1...225
  hypothetical: YES
LEELRYFTTYRLKTNQPKQYVSDMLNIIEEIDSEMKAFSKTSMDLGERYDFKGFMEDKMDEVSSREIPEGTPKAVRDTKDTLLEAIDNVNTALLTNDVKLLEQGQLCFSIAQAIYTEFLDGNIKEKSLNEKLNSFVETYTAIPPTWKLVNEDKGITINTDTEISTDAQSLSDLLANLTGISNAVTEKVGKDIPLRLLENGKKDYSVVFKNGQVTDYNEVFKKVIE

SEQ ID NO: 7303 - protein, 221 aa, Enterococcus faecium
  misc_feature (B) LOCATION 1...221
  hypothetical: YES
WPNSGVKSLHRLSSNLAYTIKIIRYFFIKKLTKGELVGIIDSFPSPLCKPVRNRQAKLLNQIAKVGYNSTKKSYFYGLKIHMIVTKTGFPITYSITNPGVHDVKVLETLSEEANLPNILGDKGYISHKIHEKLALKGITISVPPRKNMDKSEKLDHSLLGKQRKTVETVFSSLEKLGCQNFNSRSVKGLESRFESILLAYSVLLSRAQRRFEGTLRYSLGY

SEQ ID NO: 7304 - protein, 549 aa, Enterococcus faecium
  misc_feature (B) LOCATION 1...549
  hypothetical: YES
SVNSRYRKRFPMKKIPITILTGYLGSGKTILLNHILYGDHGKEIAVIVNDIGEVNVDGVLVDKKGFKRTGEKLVSMPNGCICCTLREDLIVELDQLVQFSDLNQIVIEASGISKPIPIIQAIILAKNPLDIDLTQRLEIGAIIIVVDVKRFWDNFETGEKIQERKAEGNVVEEEQDIRGLLIDQFECCNILLLNNSDLVSTKTIYKINGLIAKLQSNAKIIRTIKGEVDLSKILNTNLFNIDETSYSVGWFKELELGYQNHIPETEEYGISSFIYRNRLLLDAQKFAHLTDKNFPGNITRAKGFLWFAQHSDFSTIFETSGSYKSIESLNYWVASLPKIECQMIIQKNPELKEAWHPLFGERINKLVFIGMKMDQQCIKEQLEGCLTDSLNADNFRKISPFPWKKSNMFSQISLMKFLRKAGVKIGDVIIIGILIITSFIPLFVFSIEKENETTEDAIKYAIVRIDGKEMDRFDLDKINHKLVNYHPAKGQYNIVEIKDGRIRVKEDNSPDQIAVRTGWISKPGQTSICLPHKLVISIEKKESTDYYIY

SEQ ID NO: 7305 - protein, 98 aa, Enterococcus faecium
  misc_feature (B) LOCATION 1...98
  hypothetical: YES
TLNSFRVNRTVGGSKMKEKPINKWSLYKNSMFGVVIFGVCAGLFLFILLQTVTLFSSNPTYGWRDSIALGMFAGGYGFLLLFSILTLSPIHGLIQLWK

SEQ ID NO: 7306 - protein, 169 aa, Enterococcus faecium
  misc_feature (B) LOCATION 1...169
  hypothetical: YES
LMNSSKKQMKNGNIYLVIALIVVIILFYSSSQTYGQQSQVSRLESWLPNQPFKDTLAGIRFNYGGSMVSIDHLGYAKFLEFFLRKGAHFGTYFILGGSLFLGVFPKLKIWWLTAILAWLSATGYAGLDEFHQMMTGGRTPMFQDVMLDSIGALTAVILCVLFAAFKKRL

SEQ ID NO: 7307 - protein, 68 aa, Enterococcus faecium
  misc_feature (B) LOCATION 1...68
  hypothetical: YES
LIDSIHPIEENKRYSAKKRQRSVPKRLTRECSNKADRRKLIVLKKSTHNNRNRKLWKRYSYIGRIRIS

SEQ ID NO: 7308 - protein, 403 aa, Enterococcus faecium
  misc_feature (B) LOCATION 1...403
  hypothetical: YES
SSDSLRKRKRKVNKEWEKWTDKETKEFQDQFIQWYEQEKRNLPWRYNRDPYRIWISEIMLQQTRVDTVIDYFYRFMEWFPTIEELANAPEEKLLKAWEGLGYYSRARNIQAAAKQIMSEFDGEMPQTPEEISSLKGIGPYTTGAIASIAFGLPEPAVDGNVMRVVSRLFCIEADIAKASSRKIFDEAMRKIIDEKHPGEFNQAMMDLGSAICTPTSPKCETCPIQAFCLANKRGIQTSFPVKTKKAKPKDVYYISAALQNHSGAYYFEERDSQKLLANMWTFPMMEVTQEEYERLKKEWETKPEIDLFDDLVAEEEQNLPFEKQELFVWQTRHLGEVTHIFSHLKWHVLLFYGRATEGAEQEFTENKTSKWLKPDAFDSVVFPKVQMKLVDQLEKNRNNRNPF

SEQ ID NO: 7309 - DNA, 15 bp, Enterococcus faecium; double-stranded, circular
  hypothetical: NO
  anti-sense: NO
gtgttcaccacgggg

SEQ ID NO: 7310 - DNA, 11 bp, Enterococcus faecium; double-stranded, circular
  hypothetical: NO
  anti-sense: NO
gtggtgaagac
